US011464842B1

(12) United States Patent
Gifford et al.

(10) Patent No.: US 11,464,842 B1
(45) Date of Patent: *Oct. 11, 2022

(54) COMPOSITIONS AND METHOD FOR OPTIMIZED PEPTIDE VACCINES USING RESIDUE OPTIMIZATION

(71) Applicant: Think Therapeutics, Inc., Newton, MA (US)

(72) Inventors: David Gifford, Newton, MA (US); Brandon Carter, Cambridge, MA (US)

(73) Assignee: Think Therapeutics, Inc., Newton, MA (US)

( * ) Notice: Subject to any disclaimer, the term of this patent is extended or adjusted under 35 U.S.C. 154(b) by 0 days.

This patent is subject to a terminal disclaimer.

(21) Appl. No.: 17/243,096

(22) Filed: Apr. 28, 2021

(51) Int. Cl.
| | |
|---|---|
| *A61K 39/00* | (2006.01) |
| *A61K 38/00* | (2006.01) |
| *A61P 35/00* | (2006.01) |
| *A61K 38/10* | (2006.01) |
| *A61K 38/08* | (2019.01) |
| *A61K 38/04* | (2006.01) |
| *C07K 5/00* | (2006.01) |
| *C07K 7/00* | (2006.01) |
| *C07K 16/00* | (2006.01) |
| *C07K 17/00* | (2006.01) |
| *C07K 7/06* | (2006.01) |
| *C07K 7/08* | (2006.01) |
| *A61K 48/00* | (2006.01) |

(52) U.S. Cl.
CPC ........ *A61K 39/00116* (2018.08); *A61K 38/08* (2013.01); *A61K 38/10* (2013.01); *A61K 39/001152* (2018.08); *A61K 39/001158* (2018.08); *A61P 35/00* (2018.01); *C07K 7/06* (2013.01); *C07K 7/08* (2013.01); *A61K 48/00* (2013.01); *A61K 2039/812* (2018.08); *A61K 2039/82* (2018.08); *A61K 2039/86* (2018.08)

(58) Field of Classification Search
None
See application file for complete search history.

(56) References Cited

U.S. PATENT DOCUMENTS

| | | | |
|---|---|---|---|
| 5,961,978 A | 10/1999 | Gaudernack et al. | |
| 6,602,510 B1 | 8/2003 | Fikes et al. | |
| 7,488,718 B2 | 2/2009 | Scheinberg et al. | |
| 7,756,644 B2 | 7/2010 | Fridman et al. | |
| 8,007,810 B2 | 8/2011 | Fikes et al. | |
| 8,653,237 B2 | 2/2014 | Liu et al. | |
| 8,741,576 B2 | 6/2014 | Tangri et al. | |
| 8,765,687 B2 | 7/2014 | Scheinberg et al. | |
| 9,340,577 B2 | 5/2016 | Grey et al. | |
| 9,913,884 B2 | 3/2018 | Fikes et al. | |
| 10,335,473 B2 | 7/2019 | Eriksen | |
| 10,456,457 B2 | 10/2019 | Eriksen | |
| 10,556,943 B2 | 2/2020 | Knutson et al. | |
| 10,596,239 B2 | 3/2020 | Eriksen | |
| 10,738,355 B2 | 8/2020 | Sahin et al. | |
| 11,058,751 B1* | 7/2021 | Gifford | ................... A61P 35/00 |
| 11,161,892 B1 | 11/2021 | Gifford et al. | |
| 11,222,711 B2 | 1/2022 | Sahin et al. | |
| 2002/0155093 A1 | 10/2002 | Houghton et al. | |
| 2002/0164346 A1 | 11/2002 | Nicolette | |
| 2003/0220239 A1 | 11/2003 | Simard et al. | |
| 2003/0224036 A1 | 12/2003 | Fikes et al. | |
| 2004/0037843 A1 | 2/2004 | Fikes et al. | |
| 2004/0072240 A1 | 4/2004 | Kosmatopoulos et al. | |
| 2006/0018915 A1 | 1/2006 | Ishioka et al. | |
| 2006/0093617 A1 | 5/2006 | Buyse et al. | |
| 2007/0054262 A1 | 3/2007 | Baker et al. | |
| 2007/0098776 A1 | 5/2007 | Fikes et al. | |
| 2011/0002963 A1 | 1/2011 | Weinschenk et al. | |
| 2011/0257890 A1 | 10/2011 | Weinschenk et al. | |
| 2014/0178421 A1 | 6/2014 | Kosmatopoulos | |
| 2016/0125129 A1 | 5/2016 | Sahin et al. | |
| 2018/0066017 A1 | 3/2018 | Hunt et al. | |

(Continued)

FOREIGN PATENT DOCUMENTS

| | | |
|---|---|---|
| WO | WO-97/33602 A1 | 9/1997 |
| WO | WO-99/63945 A2 | 12/1999 |

(Continued)

OTHER PUBLICATIONS

Merriam-Webster, "Prevent", available online at https://www.merriam-webster.com/dictionary/prevent, 10 pages (accessed on Sep. 24, 2021) (Year: 2021).*
U.S. Appl. No. 17/551,679, filed Dec. 2021, Gifford; David, CPC Classification A61K39/0005, U.S. Classification 424/185.1.*
Alhadj et al., "Metabolic and immune effects of immunotherapy with proinsulin peptide in human new-onset type 1 diabetes," Science Translational Medicine, Aug. 9, 2017, vol. 9;9(402):eaaf7779. 9 pages.
Asahara et al., "Phase I/II clinical trial using HLA-A24-restricted peptide vaccine derived from KIF20A for patients with advanced pancreatic cancer," Journal of Translational Medicine, Nov. 16, 2013, vol. 11:291. 13 pages.

(Continued)

*Primary Examiner* — Thea D'Ambrosio
(74) *Attorney, Agent, or Firm* — Wilmer Cutler Pickering Hale and Dorr LLP

(57) ABSTRACT

Described herein is an immunogenic composition comprising nucleic acid sequences encoding two or more amino acid sequences selected from the group consisting of SEQ ID NOs: 19 to 50. Also described herein is an immunogenic composition comprising nucleic acid sequences encoding two or more amino acid sequences selected from the group consisting of SEQ ID NOs: 141 to 272. Also described herein is an immunogenic composition comprising nucleic acid sequences encoding two or more amino acid sequences selected from the group consisting of SEQ ID NOs: 273 to 322. Also described herein is an immunogenic composition comprising nucleic acid sequences encoding two or more amino acid sequences selected from the group consisting of SEQ ID NOs: 354 to 458.

8 Claims, 14 Drawing Sheets

Specification includes a Sequence Listing.

(56) References Cited

U.S. PATENT DOCUMENTS

| | | |
|---|---|---|
| 2018/0102585 A1 | 4/2018 | Forster |
| 2018/0134804 A1 | 5/2018 | Scheinberg et al. |
| 2018/0141998 A1 | 5/2018 | Nguyen et al. |
| 2019/0175727 A1 | 6/2019 | Huang et al. |
| 2019/0322714 A1 | 10/2019 | Petit et al. |
| 2020/0061166 A1 | 2/2020 | Sahin et al. |
| 2020/0069782 A1 | 3/2020 | Biskup et al. |
| 2020/0237885 A1 | 7/2020 | Levey et al. |
| 2021/0177955 A1 | 6/2021 | Petit et al. |
| 2021/0196806 A1 | 7/2021 | Yelensky et al. |
| 2021/0268091 A1 | 9/2021 | Juneja |

FOREIGN PATENT DOCUMENTS

| | | | |
|---|---|---|---|
| WO | WO-2005/042698 A2 | 5/2005 | |
| WO | WO-2016/187508 | 11/2016 | |
| WO | WO-2018/102585 A1 | 6/2018 | |
| WO | WO-2019/246286 | 12/2019 | |
| WO | WO-2021055594 A1 * | 3/2021 | ........... A01K 67/027 |
| WO | WO-2021/087840 A1 | 5/2021 | |

OTHER PUBLICATIONS

Bae et al., "Myeloma-Specific Multiple Peptides Able to Generate Cytotoxic T Lymphocytes: A Potential Therapeutic Application in Multiple Myeloma and other Plasma Cell Disorders," Clinical Cancer Research, published online Jul. 2, 2012, vol. 18(17), pp. 4850-4860.

Bhasin, M. and Raghava, G.P.S., "Prediction of Promiscuous and High-Affinity Mutated MHC Binders", Hybridoma and Hybridomics, Nov. 4, 2003, vol. 22, 229-234, (8 pages).

Cleveland et al., "Routine large-scale production of monoclonal antibodies in a protein-free culture medium," Journal of Immunological Methods, Jan. 28, 1983, vol. 56, Issue 2, pp. 221-234.

Dastagir et al., "Efficient Presentation of Multiple Endogenous Epitopes to Both CD4+ and CD8+ Diabetogenic T Cells for Tolerance," Molecular Therapy: Methods & Clinical Development, Mar. 2017, vol. 4, pp. 27-38.

Dey et al., "A Bioinformatics approach to designing a Zika virus vaccine," Computational Biology and Chemistry, available online Mar. 10, 2017, vol. 68, pp. 143-152.

Hoppes et al., "Altered Peptide Ligands Revisited: Vaccine Design through Chemically Modified HLA-A2-Restricted T Cell Epitopes," Journal of Immunology, published online Oct. 13, 2014, vol. 193, pp. 4803-4813. (12 pages).

Jain et al., "Synthetic Tumor-Specific Breakpoint Peptide Vaccine in Patients With Chronic Myeloid Leukemia and Minimal Residual Disease," Cancer, Sep. 1, 2009, vol. 115, pp. 3924-3934.

Liu et al., "Maximum n-times Coverage for COVID-19 Vaccine Design," arXiv (arXiv:2101.10902v1), submitted Jan. 24, 2021. 13 pages.

Longmate et al., "Population coverage by HLA class-1 restricted cytotoxic T-lymphocyte epitopes," Immunogenetics (2001), published online Dec. 19, 2000, vol. 52, pp. 165-173.

Maa et al., "Biopharmaceutical Powders: Particle Formation and Formulation Considerations," Current Pharmaceutical Biotechnology, Nov. 2000, vol. 1, No. 3, pp. 283-302.

Mashiba et al., "Identification of CTL epitopes in hepatitis C virus by a genome-wide computational scanning and a rational design of peptide vaccine," Immunogenetics, published online Jan. 16, 2007, vol. 59, pp. 197-209.

Nair et al., "A simple practice guide for dose conversion between animals and human," Journal of Basic and Clinical Pharmacy, Article Review, Mar.-May 2016, vol. 7, Issue 2, pp. 27-31.

Schipper et al., "Minimal Phenotype Panels, A Method for Achieving Maximum Population Coverage with a Minimum of HLA Antigens," Human Immunology, vol. 51, Dec. 1996, pp. 95-98.

Ali et al., "Metabolic and immune effects of immunotherapy with proinsulin peptide in human new-onset type 1 diabetes," Science Translation Medicine, Aug. 9, 2017, vol. 9(402):eaaf7779. 10 pages.

Alvarez et al., "NNAlign_MA; MHC Peptidome Deconvolution for Accurate MHC Binding Motif Characterization and Improved T-cell Epitope Predictions," Molecular & Cellular Proteomics, Dec. 2019, vol. 18(12), pp. cover, 2459-2477.

Candia et al., "On Peptides and Altered Peptide Ligands: From Origin, Mode of Action and Design to Clinical Application (Immunotherapy)," International Archives of Allergy and Immunology, published online Sep. 20, 2016; vol. 170(4), pp. 211-233.

Chicz et al. "Predominant naturally processed peptides bound to HLA-DR1 are derived from MHC-related molecules and are heterogeneous in size," Nature, Aug. 27, 1992, vol. 358(6389), pp. 764-768.

Croft et al., "Most viral peptides displayed by class I MHC on infected cells are immunogenic," Proceedings of the National Academy of Sciences, Feb. 19, 2019, vol. 116(8), pp. 3112-3117.

Dai et al., "Machine learning optimization of peptides for presentation by class II MHCs," bioRxiv, posted Aug. 18, 2020 (https://doi.org/10.1101/2020.08.18.256081). 35 pages.

Gibson et al., "Proinsulin multi-peptide immunotherapy induces antigen-specific regulatory T cells and limits autoimmunity in a humanized model," Clinical Experimental Immunology, Dec. 2015, vol. 182(3), pp. 251-260.

Guevara-Patino et al., "Optimization of a self antigen for presentation of multiple epitopes in cancer immunity," The Journal of Clinical Investigation, May 2006, vol. 116(5), pp. cover, 1382-1390.

Hollingsworth et al., "Turning the corner on therapeutic cancer vaccines," NPJ Vaccines, published online Feb. 8, 2019, vol. 4(7). 10 pages.

Hong et al., "Epitope-optimized alpha-fetoprotein genetic vaccines prevent carcinogen-induced murine autochthonous hepatocellular carcinoma," Hepatology, Apr. 2014, vol. 59(4), pp. 1448-1458.

Houghton et al., "Immunological validation of the EpitOptimizer program for streamlined design of heteroclitic epitopes," Vaccine, Jul. 2007, vol. 25(29), pp. 5330-5342.

Jaravine et al., "Assessment of cancer and virus antigens for cross-reactivity in human tissues," Bioinformatics, Sep. 10, 2016, vol. 33(1), pp. 104-111.

Jaravine et al., "Expitope 2.0: a tool to assess immunotherapeutic antigens for their potential cross-reactivity against naturally expressed proteins in human tissues," BMC Cancer, published online Dec. 27, 2017, vol. 17(1):892. 9 pages.

Jurtz et al., "NetMHCpan-4.0: Improved Peptide—MHC Class I Interaction Predictions Integrating Eluted Ligand and Peptide Binding Affinity Data," The Journal of Immunology, prepublished online Oct. 4, 2017, vol. 199, pp. 3360-3368.

Klinger et al., "Multiplex identification of antigen-specific T cell receptors using a combination of immune assays and immune receptor sequencing," PLOS One, Oct. 28, 2015, vol. 10(10), e0141561. 21 pages.

Kranz et al., "Systemic RNA delivery to dendritic cells exploits antiviral defence for cancer immunotherapy," Nature, Jun. 16, 2016, vol. 534(7607), pp. 396-401, Methods. 16 pages.

Kreiter et al., "Increased antigen presentation efficiency by coupling antigens to MHC class I trafficking signals," The Journal of Immunology, Jan. 2008, vol. 180(1), pp. 309-318, Corrections. 12 pages.

Krienke et al., "A noninflammatory mRNA vaccine for treatment of experimental autoimmune encephalomyelitis," Science, Jan. 8, 2021, vol. 371 (6525): 145-153. 10 pages.

Liu et al. "Computationally Optimized SARS-CoV-2 MHC Class I and II Vaccine Formulations Predicted to Target Human Haplotype Distributions," Cell Systems, Aug. 26, 2020, vol. 11 (2), pp. 131-144, e1-e6, Supplementary Table. 23 pages.

Liu et al., "Predicted Cellular Immunity Population Coverage Gaps for SARS-CoV-2 Subunit Vaccines and their Augmentation by Compact Peptide Sets," Cell Systems, Journal Pre-proof, Nov. 26, 2020. (https://doi.org/10.1016/j.cels.2020.11.010). 36 pages.

Mahanty et al., "Immunogenicity of infectious pathogens and vaccine antigens," BMC Immunology, published online May 29, 2015, vol. 16:31. 6 pages.

Mosch et al., "Machine Learning for Cancer Immunotherapies Based on Epitope Recognition by T Cell Receptors," Frontiers in Genetics, Nov. 19, 2019, vol. 10(1141). 17 pages.

(56) References Cited

OTHER PUBLICATIONS

Ng et al., "In silico-guided sequence modifications of K-ras epitopes improve immunological outcome against G12V and G13D mutant KRAS antigens," PeerJ, Jul. 20, 2018 vol. 6:e5056. 21 pages.

Nielsen et al., "NN-align. An artificial neural network-based alignment algorithm for MHC class II peptide binding prediction," BMC Bioinformatics, Sep. 18, 2009, vol. 10:296. 10 pages.

Nielsen et al., "NNAlign: a platform to construct and evaluate artificial neural network models of receptor-ligand interactions," Nucleic Acids Research, published online Apr. 12, 2017, vol. 45, pp. W344-W349.

Nielsen et al., "Quantitative predictions of peptide binding to any HLA-DR molecule of known sequence: NetMHCIIpan," PLoS Computational Biology, Jul. 4, 2008, vol. 4(7):e1000107. 10 pages.

Nielsen et al., "The role of the proteasome in generating cytotoxic T-cell epitopes: insights obtained from improved predictions of proteasomal cleavage," Immunogenetics, published online Mar. 3, 2005, vol. 57, pp. 33-41.

O'Donnell et al., "MHCflurry 2.0: Improved Pan-Allele Prediction of MHC Class I-Presented Peptides by Incorporating Antigen Processing," Cell Systems, Jul. 22, 2020, vol. 11(1), pp. cover, 42-48, e1-e7.

O'Donnell et al., "MHCflurry: Open-Source Class I MHC Binding Affinity Prediction," Cell Systems, Jul. 25, 2018, vol. 7(1), pp. cover, 129-132, e1-e4.

Ogishi et al., "Quantitative Prediction of the Landscape of T Cell Epitope Immunogenicity in Sequence Space," Frontiers in Immunology, Apr. 16, 2019, vol. 10(827). 20 pages.

Park et al., "Accurate structure prediction of peptide-MHC complexes for identifying highly immunogenic antigens," Author Manuscript: Mol. Immunol. Nov. 2013, vol. 56:81-90. 25 pages.

Reynisson et al., "NetMHCpan-4.1 and NetMHCIIpan-4.0: improved predictions of MHC antigen presentation by concurrent motif deconvolution and integration of MS MHC eluted ligand data," Nucleic Acids Research, published online May 14, 2020, vol. 48, pp. W449-W454.

Rist et al., "HLA peptide length preferences control CD8+ T cell responses," The Journal of Immunology, Jul. 15, 2013, vol. 191(2), 561-571.

Sahin et al., "Personalized RNA mutanome vaccines mobilize poly-specific therapeutic immunity against cancer," Nature, Jul. 13, 2017, vol. 547(7662), pp. 222-226, Methods. 19 pages.

Sette et al., "Peptides and Methods for Creating Synthetic Peptides With Modulated Binding Affinity for HLA Molecules," Application for U.S. Appl. No. 09/226,775, filed Jan. 6, 1999—not published, abandoned. 133 pages.

Shimokawa et al., "CD8+ regulatory T cells are critical in prevention of autoimmune-mediated diabetes," Nature Communications, Apr. 22, 2020, vol. 11:1922. 9 pages.

Slota et al., "ELISpot for measuring human immune responses to vaccines," Author Manuscript: Expert Review of Vaccines, Mar. 2011, vol. 10(3):299-306. 14 pages.

Soria-Guerra et al., "An overview of bioinformatics tools for epitope prediction: implications on vaccine development," Journal of Biomedical Informatics (2015), available online Nov. 10, 2014, vol. 53, pp. 405-414.

Tapia-Calle et al., "A PBMC-Based System to Assess Human T Cell Responses to Influenza Vaccine Candidates In Vitro," Vaccines, Nov. 13, 2019, vol. 7(4):181. 26 pages.

Toussaint et al., "A mathematical framework for the selection of an optimal set of peptides for epitope-based vaccines," PLoS Computational Biology, Dec. 2008, vol. 4(12):e1000246. 10 pages.

Trolle et al., "The length distribution of class 1 restricted T cell epitopes is determined by both peptide supply and MHC allele-specific binding preference," Author manuscript: The Journal of Immunology, Feb. 15, 2016, vol. 196(4): 1480-1487. 21 pages.

Woodham et al., "Nanobody-Antigen Conjugates Elicit HPV-Specific Antitumor Immune Responses," Cancer Immunology Research, Jul. 2018, vol. 6(7); pp. 870-880.

Zirlik et al., "Cytotoxic T cells generated against heteroclitic peptides kill primary tumor cells independent of the binding affinity of the native tumor antigen peptide," Blood, Dec. 2006, vol. 108(12), pp. 3865-3870.

Sette et al., "The Relationship Between Class 1 Binding Affinity and Immunogenicity of Potential Cytotoxic T Cell Epitopes," The Journal of Immunology, Dec. 15, 1994, vol. 153, pp. 5586-5592.

Dyall et al., "Heteroclitic Immunization Induces Tumor Immunity," J. Exp. Med., Nov. 2, 1998, vol. 188(9), pp. 1553-1561.

Liu et al., "Predicted Cellular Immunity Population Coverage Gaps for SARS-CoV-2 Subunit Vaccines and their Augmentation by Compact Peptide Sets," bioRxiv, posted Oct. 21, 2020, 2 9 pages. (https://www.biorxiv.org/content/10.1101/2020.08.04.200691V2).

Sim et al., "Correction—High-affinity oligoclonal TCRs define effective adoptive T cell therapy targeting mutant KRAS-G12D," Proc. Natl. Acad. Sci. USA, Nov. 3, 2020, vol. 117(44), pp. 27743-27744.

Sim et al., "High-affinity oligoclonal TCRs define effective adoptive T cell therapy targeting mutant KRAS-G12D," Proc. Natl. Acad. Sci. USA, first published May 27, 2020, vol. 117(23), pp. 12826-12835.

Zhang et al., "Cancer vaccines: Targeting KRAS-driven cancers," Expert Review of Vaccines, published online Mar. 14, 2020, vol. 19(2), pp. 163-173. 12 pages.

International Search Report and Written Opinion dated Mar. 28, 2022, in the International Application No. PCT/US2021/060013. 14 pages.

Berzofsky et al., "Progress on new vaccine strategies for the immunotherapy and prevention of cancer," The Journal of Clinical Investigation, Jun. 2004, vol. 113(11), pp. 1515-1525.

Berzofsky et al., "Strategies for designing and optimizing new generation vaccines," Nature Reviews: Immunology, vol. 1(3), Dec. 2001, pp. 209-219.

Berzofsky, "Epitope selection and design of synthetic vaccines. Molecular approaches to enhancing immunogenicity and cross-reactivity of engineered vaccines," Annals of the New York Academy of Sciences, Aug. 12, 1993, vol. 690(1), pp. 256-264.

Fong et al., "Altered peptide ligand vaccination with Flt3 ligand expanded dendritic cells for tumor immunotherapy," PNAS, Jul. 17, 2001, vol. 98(15), pp. 8809-8814.

Rosenberg et al., "Immunologic and therapeutic evaluation of a synthetic peptide vaccine for the treatment of patients with metastatic melanoma," Nature Medicine, Mar. 1998, vol. 4(3), pp. 321-327.

Slansky et al., "Enhanced antigen-specific antitumor immunity with altered peptide ligands that stabilize the MHC-peptide-TCR complex," Immunity, Oct. 2000, vol. 13(4), pp. 529-538.

Takahashi et al., "Induction of Broadly Cross-Reactive Cytotoxic T Cells Recognizing an HIV-1 Envelope Determinant," Science, Jan. 17, 1992, vol. 255(5042), pp. 333-336.

Tangri et al., "Structural Features of Peptide Analogs of Human Histocompatibility Leukocyte Antigen Class I Epitopes That Are More Potent and Immunogenic than Wild-Type Peptide," Journal of Experimental Medicine, Sep. 17, 2001, vol. 194(6), pp. 833-846.

Vita et al., "The Immune Epitope Database (IEDB): 2018 update," Nucleic Acids Research (2019), published online Oct. 24, 2018, vol. 47, database issue D339-D343. 5 pages.

Zaremba et al., "Identification of an enhancer agonist cytotoxic T lymphocyte peptide from human carcinoembryonic antigen," Cancer Research, Oct. 15, 1997, vol. 57(20), pp. 4570-4577.

* cited by examiner

Factoring of disease presentation type probabilities and for each presentation, probability of targets presented

| | Brain Cancer | Bronchus and Lung Cancer | Colorectal Cancer | Pancreatic Cancer | Skin Cancer | Thyroid Cancer | Breast Cancer | Ovarian Cancer |
|---|---|---|---|---|---|---|---|---|
| BRAF_V600E | - | - | 0.1029 | - | 0.4392 | 0.5854 | - | - |
| BRAF_V600M | - | - | - | - | 0.0853 | - | - | - |
| EGFR_A289V | 0.0230 | - | - | - | - | - | - | - |
| EGFR_G598V | 0.0208 | - | - | - | - | - | - | - |
| EGFR_L858R | - | 0.0216 | - | - | - | - | - | - |
| HRAS_Q61K | - | - | - | - | - | 0.0061 | - | - |
| HRAS_Q61R | - | - | - | - | - | 0.0285 | - | - |
| IDH1_R132C | 0.0197 | - | - | - | - | - | - | - |
| IDH1_R132H | 0.4178 | - | - | - | - | - | - | - |
| KRAS_G12A | - | 0.0169 | - | - | - | - | - | - |
| KRAS_G12C | - | 0.0583 | - | - | - | - | - | - |
| KRAS_G12D | - | 0.0188 | 0.1235 | 0.3280 | - | - | - | - |
| KRAS_G12R | - | - | - | 0.1505 | - | - | - | - |
| KRAS_G12V | - | 0.0376 | 0.0947 | 0.2258 | - | - | - | 0.0092 |
| KRAS_G13D | - | - | 0.0700 | - | - | - | - | - |
| NRAS_Q61K | - | - | - | - | 0.0832 | 0.0163 | - | - |
| NRAS_Q61L | - | - | - | - | 0.0384 | - | - | - |
| NRAS_Q61R | - | - | - | - | 0.1215 | 0.0630 | - | 0.0069 |
| PIK3CA_E542K | - | 0.0169 | - | - | - | - | 0.0435 | - |
| PIK3CA_E545K | - | 0.0197 | 0.0700 | - | - | - | 0.0638 | - |
| PIK3CA_H1047R | - | - | - | - | - | - | 0.1225 | - |
| TP53_R158L | - | 0.0188 | - | - | - | - | - | - |
| TP53_R175H | 0.0186 | - | 0.0679 | - | - | - | 0.0202 | 0.0343 |
| TP53_R248Q | - | - | - | - | - | - | - | 0.0252 |
| TP53_R273C | 0.0581 | - | - | - | - | - | 0.0051 | 0.0137 |
| TP53_R273H | - | - | - | - | - | - | 0.0121 | 0.0206 |

FIG. 7

```
def merge_multi(lists):
    values = []

# While any list in lists has elements remaining
    while max(map(lambda l: len(l), lists)) > 0:
        # Find list with largest value at its head.
        cur_max = None
        cur_max_idx = None
        for idx, l in enumerate(lists):
            if not l:  # List is empty.
                continue
            if cur_max is None or l[0] > cur_max:
                cur_max = l[0]
                cur_max_idx = idx
        # Pop that value from list l.
        values.append((lists[cur_max_idx].pop(0), cur_max_idx))

return values
```

FIG. 13

COMPOSITIONS AND METHOD FOR OPTIMIZED PEPTIDE VACCINES USING RESIDUE OPTIMIZATION

This patent disclosure contains material that is subject to copyright protection. The copyright owner has no objection to the facsimile reproduction of the patent document or the patent disclosure as it appears in the U.S. Patent and Trademark Office patent file or records, but otherwise reserves any and all copyright rights.

INCORPORATION BY REFERENCE

All documents cited herein are incorporated herein by reference in their entireties

SEQUENCE LISTING

The Sequence Listing is submitted on one compact disc (Copy 1), together with a duplicate thereof (Copy 2), each created on Apr. 26, 2021, and each containing one 229,374, 097 byte file in ASCII-format entitled "2215269_00125US1_SL.txt." Each compact disc was prepared in Macintosh machine format, is compatible with the Macintosh operating system. The material contained on the compact disc is specifically incorporated herein by reference.

TECHNICAL FIELD

The present invention relates generally to compositions, systems, and methods of peptide vaccines. More particularly, the present invention relates to compositions, systems, and methods of designing peptide vaccines to treat or prevent disease optimized based on predicted population immunogenicity.

BACKGROUND

The goal of a peptide vaccine is to train the immune system to recognize and expand its capacity to engage cells that display target peptides to improve the immune response to cancerous cells or pathogens. A peptide vaccine can also be administered to someone who is already diseased to increase their immune response to a causal cancer, other diseases, or pathogen. Alternatively, a peptide vaccine can be administered to induce the immune system to have therapeutic tolerance to one or more peptides. There exists a need for compositions, systems, and methods of peptide vaccines based on prediction of the target peptides that will be displayed to protect a host from cancer, other disease, or pathogen infection.

SUMMARY OF THE INVENTION

In one aspect, the invention provides for nucleic acid sequences encoding one or more amino acid sequences selected from the group consisting of SEQ ID NOs: 1 to 474.

In some embodiments, the nucleic acid sequences encode two or more amino acid sequences selected from the group consisting of SEQ ID NOs: 1 to 474.

In another aspect, the invention provides for an immunogenic composition comprising nucleic acid sequences encoding one or more amino acid sequences selected from the group consisting of SEQ ID NOs: 1 to 474.

In some embodiments, the immunogenic composition is administered to a subject. In some embodiments, the immunogenic composition comprises nucleic acid sequences encoding two or more amino acid sequences selected from the group consisting of SEQ ID NOs: 1 to 474. In some embodiments, the nucleic acid sequences are administered in a construct for expression in vivo. In some embodiments, the in vivo administration of the nucleic acid sequences is configured to produce one or more peptides that is displayed by an HLA class I molecule. In some embodiments, the one or more peptides is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, the one or more peptides is a modified or unmodified fragment of a protein, wherein the protein comprises a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the immunogenic composition is administered in an effective amount to a subject to prevent cancer. In some embodiments, the immunogenic composition is administered in an effective amount to a subject to treat cancer. In some embodiments, the cancer is selected from the group consisting of pancreatic cancer, skin cancer, thyroid cancer, brain cancer, colorectal cancer, bronchus and lung cancer, breast cancer, and ovarian cancer. In some embodiments, the immunogenic composition comprises nucleic acid sequences encoding at least three amino acid sequences selected from the group consisting of SEQ ID NOs: 1 to 474.

In another aspect, the invention provides for an immunogenic peptide composition comprising one or more peptides selected from the group consisting of SEQ ID NOs: 1 to 474.

In some embodiments, the immunogenic peptide composition comprises two or more peptides selected from the group consisting of SEQ ID NOs: 1 to 474.

In another aspect, the invention provides for an immunogenic composition comprising nucleic acid sequences encoding one or more amino acid sequences selected from the group consisting of SEQ ID NOs: 1 to 18.

In some embodiments, the immunogenic composition comprises nucleic acid sequences encoding one or more amino acid sequences derived from a AKT1 protein mutation. In some embodiments, the immunogenic composition comprises nucleic acid sequences encoding two or more amino acid sequences selected from the group consisting of SEQ ID NOs: 1 to 18.

In another aspect, the invention provides for an immunogenic peptide composition comprising one or more peptides selected from the group consisting of SEQ ID NOs: 1 to 18.

In some embodiments, the immunogenic peptide composition comprises two or more peptides selected from the group consisting of SEQ ID NOs: 1 to 18. In some embodiments, the one or more peptides is a modified or unmodified fragment of a mutated AKT1 protein.

In another aspect, the invention provides for an immunogenic composition comprising nucleic acid sequences encoding one or more amino acid sequences selected from the group consisting of SEQ ID NOs: 19 to 50.

In some embodiments, the immunogenic composition comprises nucleic acid sequences encoding one or more amino acid sequences derived from a BRAF protein mutation. In some embodiments, the immunogenic composition comprises nucleic acid sequences encoding two or more amino acid sequences selected from the group consisting of SEQ ID NOs: 19 to 50.

In another aspect, the invention provides for an immunogenic peptide composition comprising one or more peptides selected from the group consisting of SEQ ID NOs: 19 to 50.

In some embodiments, the immunogenic peptide composition comprises two or more peptides selected from the group consisting of SEQ ID NOs: 19 to 50. In some embodiments, the one or more peptides is a modified or unmodified fragment of a mutated BRAF protein.

In another aspect, the invention provides for an immunogenic composition comprising nucleic acid sequences encoding one or more amino acid sequences selected from the group consisting of SEQ ID NOs: 51 to 98.

In some embodiments, the immunogenic composition comprises nucleic acid sequences encoding one or more amino acid sequences derived from a EGFR protein mutation. In some embodiments, the immunogenic composition comprises nucleic acid sequences encoding two or more amino acid sequences selected from the group consisting of SEQ ID NOs: 51 to 98.

In another aspect, the invention provides for an immunogenic peptide composition comprising one or more peptides selected from the group consisting of SEQ ID NOs: 51 to 98.

In some embodiments, the immunogenic peptide composition comprises two or more peptides selected from the group consisting of SEQ ID NOs: 51 to 98. In some embodiments, the one or more peptides is a modified or unmodified fragment of a mutated EGFR protein.

In another aspect, the invention provides for an immunogenic composition comprising nucleic acid sequences encoding one or more amino acid sequences selected from the group consisting of SEQ ID NOs: 99 to 118.

In some embodiments, the immunogenic composition comprises nucleic acid sequences encoding one or more amino acid sequences derived from a GTF2I protein mutation. In some embodiments, the immunogenic composition comprises nucleic acid sequences encoding two or more amino acid sequences selected from the group consisting of SEQ ID NOs: 99 to 118.

In another aspect, the invention provides for an immunogenic peptide composition comprising one or more peptides selected from the group consisting of SEQ ID NOs: 99 to 118.

In some embodiments, the immunogenic peptide composition comprises two or more peptides selected from the group consisting of SEQ ID NOs: 99 to 118. In some embodiments, the one or more peptides is a modified or unmodified fragment of a mutated GTF2I protein.

In another aspect, the invention provides for an immunogenic composition comprising nucleic acid sequences encoding one or more amino acid sequences selected from the group consisting of SEQ ID NOs: 119 to 140.

In some embodiments, the immunogenic composition comprises nucleic acid sequences encoding one or more amino acid sequences derived from a IDH1 protein mutation. In some embodiments, the immunogenic composition comprises nucleic acid sequences encoding two or more amino acid sequences selected from the group consisting of SEQ ID NOs: 119 to 140.

In another aspect, the invention provides for an immunogenic peptide composition comprising one or more peptides selected from the group consisting of SEQ ID NOs: 119 to 140.

In some embodiments, the immunogenic peptide composition comprises two or more peptides selected from the group consisting of SEQ ID NOs: 119 to 140. In some embodiments, the one or more peptides is a modified or unmodified fragment of a mutated IDH1 protein.

In another aspect, the invention provides for an immunogenic composition comprising nucleic acid sequences encoding one or more amino acid sequences selected from the group consisting of SEQ ID NOs: 141 to 229.

In some embodiments, the immunogenic composition comprises nucleic acid sequences encoding one or more amino acid sequences derived from a KRAS protein mutation. In some embodiments, the immunogenic composition comprises nucleic acid sequences encoding two or more amino acid sequences selected from the group consisting of SEQ ID NOs: 141 to 229.

In another aspect, the invention provides for an immunogenic peptide composition comprising one or more peptides selected from the group consisting of SEQ ID NOs: 141 to 229.

In some embodiments, the immunogenic peptide composition comprises two or more peptides selected from the group consisting of SEQ ID NOs: 141 to 229. In some embodiments, the one or more peptides is a modified or unmodified fragment of a mutated KRAS protein.

In another aspect, the invention provides for an immunogenic composition comprising nucleic acid sequences encoding one or more amino acid sequences selected from the group consisting of SEQ ID NOs: 230 to 272.

In some embodiments, the immunogenic composition comprises nucleic acid sequences encoding one or more amino acid sequences derived from a NRAS protein mutation. In some embodiments, the immunogenic composition comprises nucleic acid sequences encoding two or more amino acid sequences selected from the group consisting of SEQ ID NOs: 230 to 272.

In another aspect, the invention provides for an immunogenic peptide composition comprising one or more peptides selected from the group consisting of SEQ ID NOs: 230 to 272.

In some embodiments, the immunogenic peptide composition comprises two or more peptides selected from the group consisting of SEQ ID NOs: 230 to 272. In some embodiments, the one or more peptides is a modified or unmodified fragment of a mutated NRAS protein.

In another aspect, the invention provides for an immunogenic composition comprising nucleic acid sequences encoding one or more amino acid sequences selected from the group consisting of SEQ ID NOs: 273 to 322.

In some embodiments, the immunogenic composition comprises nucleic acid sequences encoding one or more amino acid sequences derived from a PIK3CA protein mutation. In some embodiments, the immunogenic composition comprises nucleic acid sequences encoding two or more amino acid sequences selected from the group consisting of SEQ ID NOs: 273 to 322.

In another aspect, the invention provides for an immunogenic peptide composition comprising one or more peptides selected from the group consisting of SEQ ID NOs: 273 to 322.

In some embodiments, the immunogenic peptide composition comprises two or more peptides selected from the group consisting of SEQ ID NOs: 273 to 322. In some embodiments, the one or more peptides is a modified or unmodified fragment of a mutated PIK3CA protein.

In another aspect, the invention provides for an immunogenic composition comprising nucleic acid sequences encoding one or more amino acid sequences selected from the group consisting of SEQ ID NOs: 323 to 353.

In some embodiments, the immunogenic composition comprises nucleic acid sequences encoding one or more amino acid sequences derived from a PTEN protein mutation. In some embodiments, the immunogenic composition comprises nucleic acid sequences encoding two or more amino acid sequences selected from the group consisting of SEQ ID NOs: 323 to 353.

In another aspect, the invention provides for an immunogenic peptide composition comprising one or more peptides selected from the group consisting of SEQ ID NOs: 323 to 353.

In some embodiments, the immunogenic peptide composition comprises two or more peptides selected from the group consisting of SEQ ID NOs: 323 to 353. In some embodiments, the one or more peptides is a modified or unmodified fragment of a mutated PTEN protein.

In another aspect, the invention provides for an immunogenic composition comprising nucleic acid sequences encoding one or more amino acid sequences selected from the group consisting of SEQ ID NOs: 354 to 458.

In some embodiments, the immunogenic composition comprises nucleic acid sequences encoding one or more amino acid sequences derived from a TP53 protein mutation. In some embodiments, the immunogenic composition comprises nucleic acid sequences encoding two or more amino acid sequences selected from the group consisting of SEQ ID NOs:
354 to 458.

In another aspect, the invention provides for an immunogenic peptide composition comprising one or more peptides selected from the group consisting of SEQ ID NOs: 354 to 458.

In some embodiments, the immunogenic peptide composition comprises two or more peptides selected from the group consisting of SEQ ID NOs: 354 to 458. In some embodiments, the one or more peptides is a modified or unmodified fragment of a mutated TP53 protein.

In another aspect, the invention provides for an immunogenic composition comprising nucleic acid sequences encoding one or more amino acid sequences selected from the group consisting of SEQ ID NOs: 141 to 272.

In some embodiments, the immunogenic composition comprises nucleic acid sequences encoding one or more amino acid sequences derived from a RAS protein mutation. In some embodiments, the immunogenic composition comprises nucleic acid sequences encoding two or more amino acid sequences selected from the group consisting of SEQ ID NOs: 141 to 272.

In another aspect, the invention provides for an immunogenic peptide composition comprising one or more peptides selected from the group consisting of SEQ ID NOs: 141 to 272.

In some embodiments, the immunogenic peptide composition comprises two or more peptides selected from the group consisting of SEQ ID NOs: 141 to 272. In some embodiments, the one or more peptides is a modified or unmodified fragment of a mutated RAS protein.

In another aspect, the invention provides for an immunogenic composition comprising nucleic acid sequences encoding one or more amino acid sequences selected from the group consisting of SEQ ID NOs: 19 to 33.

In some embodiments, the immunogenic composition comprises nucleic acid sequences encoding one or more amino acid sequences derived from a BRAF V600E protein mutation. In some embodiments, the immunogenic composition comprises nucleic acid sequences encoding two or more amino acid sequences selected from the group consisting of SEQ ID NOs: 19 to 33.

In another aspect, the invention provides for an immunogenic peptide composition comprising one or more peptides selected from the group consisting of SEQ ID NOs: 19 to 33.

In some embodiments, the immunogenic peptide composition comprises two or more peptides selected from the group consisting of SEQ ID NOs: 19 to 33. In some embodiments, the immunogenic peptide composition comprises a peptide derived from a BRAF V600E protein mutation.

In another aspect, the invention provides for an immunogenic composition comprising nucleic acid sequences encoding one or more amino acid sequences selected from the group consisting of SEQ ID NOs: 34 to 50.

In some embodiments, the immunogenic composition comprises nucleic acid sequences encoding one or more amino acid sequences derived from a BRAF V600M protein mutation. In some embodiments, the immunogenic composition comprises nucleic acid sequences encoding two or more amino acid sequences selected from the group consisting of SEQ ID NOs: 34 to 50.

In another aspect, the invention provides for an immunogenic peptide composition comprising one or more peptides selected from the group consisting of SEQ ID NOs: 34 to 50.

In some embodiments, the immunogenic peptide composition comprises two or more peptides selected from the group consisting of SEQ ID NOs: 34 to 50. In some embodiments, the immunogenic peptide composition comprises a peptide derived from a BRAF V600M protein mutation.

In another aspect, the invention provides for an immunogenic composition comprising nucleic acid sequences encoding one or more amino acid sequences selected from the group consisting of SEQ ID NOs: 51 to 66.

In some embodiments, the immunogenic composition comprises nucleic acid sequences encoding one or more amino acid sequences derived from a EGFR A289V protein mutation. In some embodiments, the immunogenic composition comprises nucleic acid sequences encoding two or more amino acid sequences selected from the group consisting of SEQ ID NOs: 51 to 66.

In another aspect, the invention provides for an immunogenic peptide composition comprising one or more peptides selected from the group consisting of SEQ ID NOs: 51 to 66.

In some embodiments, the immunogenic peptide composition comprises two or more peptides selected from the group consisting of SEQ ID NOs: 51 to 66. In some embodiments, the immunogenic peptide composition comprises a peptide derived from a EGFR A289V protein mutation.

In another aspect, the invention provides for an immunogenic composition comprising nucleic acid sequences encoding one or more amino acid sequences selected from the group consisting of SEQ ID NOs: 67 to 81.

In some embodiments, the immunogenic composition comprises nucleic acid sequences encoding one or more amino acid sequences derived from a EGFR G598V protein mutation. In some embodiments, the immunogenic composition comprises nucleic acid sequences encoding two or more amino acid sequences selected from the group consisting of SEQ ID NOs: 67 to 81.

In another aspect, the invention provides for an immunogenic peptide composition comprising one or more peptides selected from the group consisting of SEQ ID NOs: 67 to 81.

In some embodiments, the immunogenic peptide composition comprises two or more peptides selected from the group consisting of SEQ ID NOs: 67 to 81. In some embodiments, the immunogenic peptide composition comprises a peptide derived from a EGFR G598V protein mutation.

In another aspect, the invention provides for an immunogenic composition comprising nucleic acid sequences encoding one or more amino acid sequences selected from the group consisting of SEQ ID NOs: 82 to 98.

In some embodiments, the immunogenic composition comprises nucleic acid sequences encoding one or more amino acid sequences derived from a EGFR L858R protein mutation. In some embodiments, the immunogenic composition comprises nucleic acid sequences encoding two or more amino acid sequences selected from the group consisting of SEQ ID NOs: 82 to 98.

In another aspect, the invention provides for an immunogenic peptide composition comprising one or more peptides selected from the group consisting of SEQ ID NOs: 82 to 98.

In some embodiments, the immunogenic peptide composition comprises two or more peptides selected from the group consisting of SEQ ID NOs: 82 to 98. In some embodiments, the immunogenic peptide composition comprises a peptide derived from a EGFR L858R protein mutation.

In another aspect, the invention provides for an immunogenic composition comprising nucleic acid sequences encoding one or more amino acid sequences selected from the group consisting of SEQ ID NOs: 125 to 140.

In some embodiments, the immunogenic composition comprises nucleic acid sequences encoding one or more amino acid sequences derived from a IDH1 R132H protein mutation. In some embodiments, the immunogenic composition comprises nucleic acid sequences encoding two or more amino acid sequences selected from the group consisting of SEQ ID NOs: 125 to 140.

In another aspect, the invention provides for an immunogenic peptide composition comprising one or more peptides selected from the group consisting of SEQ ID NOs: 125 to 140.

In some embodiments, the immunogenic peptide composition comprises two or more peptides selected from the group consisting of SEQ ID NOs: 125 to 140. In some embodiments, the immunogenic peptide composition comprises a peptide derived from a IDH1 R132H protein mutation.

In another aspect, the invention provides for an immunogenic composition comprising nucleic acid sequences encoding one or more amino acid sequences selected from the group consisting of SEQ ID NOs: 119 to 124.

In some embodiments, the immunogenic composition comprises nucleic acid sequences encoding one or more amino acid sequences derived from a IDH1 R132C protein mutation. In some embodiments, the immunogenic composition comprises nucleic acid sequences encoding two or more amino acid sequences selected from the group consisting of SEQ ID NOs: 119 to 124.

In another aspect, the invention provides for an immunogenic peptide composition comprising one or more peptides selected from the group consisting of SEQ ID NOs: 119 to 124.

In some embodiments, the immunogenic peptide composition comprises two or more peptides selected from the group consisting of SEQ ID NOs: 119 to 124. In some embodiments, the immunogenic peptide composition comprises a peptide derived from a IDH1 R132C protein mutation.

In another aspect, the invention provides for an immunogenic composition comprising nucleic acid sequences encoding one or more amino acid sequences selected from the group consisting of SEQ ID NOs: 167 to 178.

In some embodiments, the immunogenic composition comprises nucleic acid sequences encoding one or more amino acid sequences derived from a KRAS G12D protein mutation. In some embodiments, the immunogenic composition comprises nucleic acid sequences encoding two or more amino acid sequences selected from the group consisting of SEQ ID NOs: 167 to 178.

In another aspect, the invention provides for an immunogenic peptide composition comprising one or more peptides selected from the group consisting of SEQ ID NOs: 167 to 178.

In some embodiments, the immunogenic peptide composition comprises two or more peptides selected from the group consisting of SEQ ID NOs: 167 to 178. In some embodiments, the immunogenic peptide composition comprises a peptide derived from a KRAS G12D protein mutation.

In another aspect, the invention provides for an immunogenic composition comprising nucleic acid sequences encoding one or more amino acid sequences selected from the group consisting of SEQ ID NOs: 203 to 213.

In some embodiments, the immunogenic composition comprises nucleic acid sequences encoding one or more amino acid sequences derived from a KRAS G12V protein mutation. In some embodiments, the immunogenic composition comprises nucleic acid sequences encoding two or more amino acid sequences selected from the group consisting of SEQ ID NOs: 203 to 213.

In another aspect, the invention provides for an immunogenic peptide composition comprising one or more peptides selected from the group consisting of SEQ ID NOs: 203 to 213.

In some embodiments, the immunogenic peptide composition comprises two or more peptides selected from the group consisting of SEQ ID NOs: 203 to 213. In some embodiments, the immunogenic peptide composition comprises a peptide derived from a KRAS G12V protein mutation.

In another aspect, the invention provides for an immunogenic composition comprising nucleic acid sequences encoding one or more amino acid sequences selected from the group consisting of SEQ ID NOs: 179 to 191.

In some embodiments, the immunogenic composition comprises nucleic acid sequences encoding one or more amino acid sequences derived from a KRAS G12R protein mutation. In some embodiments, the immunogenic composition comprises nucleic acid sequences encoding two or more amino acid sequences selected from the group consisting of SEQ ID NOs: 179 to 191.

In another aspect, the invention provides for an immunogenic peptide composition comprising one or more peptides selected from the group consisting of SEQ ID NOs: 179 to 191.

In some embodiments, the immunogenic peptide composition comprises two or more peptides selected from the group consisting of SEQ ID NOs: 179 to 191. In some embodiments, the immunogenic peptide composition comprises a peptide derived from a KRAS G12R protein mutation.

In another aspect, the invention provides for an immunogenic composition comprising nucleic acid sequences encoding one or more amino acid sequences selected from the group consisting of SEQ ID NOs: 154 to 166.

In some embodiments, the immunogenic composition comprises nucleic acid sequences encoding one or more amino acid sequences derived from a KRAS G12C protein mutation. In some embodiments, the immunogenic composition comprises nucleic acid sequences encoding two or more amino acid sequences selected from the group consisting of SEQ ID NOs: 154 to 166.

In another aspect, the invention provides for an immunogenic peptide composition comprising one or more peptides selected from the group consisting of SEQ ID NOs: 154 to 166.

In some embodiments, the immunogenic peptide composition comprises two or more peptides selected from the group consisting of SEQ ID NOs: 154 to 166. In some embodiments, the immunogenic peptide composition comprises a peptide derived from a KRAS G12C protein mutation.

In another aspect, the invention provides for an immunogenic composition comprising nucleic acid sequences encoding one or more amino acid sequences selected from the group consisting of SEQ ID NOs: 214 to 229.

In some embodiments, the immunogenic composition comprises nucleic acid sequences encoding one or more amino acid sequences derived from a KRAS G13D protein mutation. In some embodiments, the immunogenic composition comprises nucleic acid sequences encoding two or more amino acid sequences selected from the group consisting of SEQ ID NOs: 214 to 229.

In another aspect, the invention provides for an immunogenic peptide composition comprising one or more peptides selected from the group consisting of SEQ ID NOs: 214 to 229.

In some embodiments, the immunogenic peptide composition comprises two or more peptides selected from the group consisting of SEQ ID NOs: 214 to 229. In some embodiments, the immunogenic peptide composition comprises a peptide derived from a KRAS G13D protein mutation.

In another aspect, the invention provides for an immunogenic composition comprising nucleic acid sequences encoding one or more amino acid sequences selected from the group consisting of SEQ ID NOs: 141 to 153.

In some embodiments, the immunogenic composition comprises nucleic acid sequences encoding one or more amino acid sequences derived from a KRAS G12A protein mutation. In some embodiments, the immunogenic composition comprises nucleic acid sequences encoding two or more amino acid sequences selected from the group consisting of SEQ ID NOs: 141 to 153.

In another aspect, the invention provides for an immunogenic peptide composition comprising one or more peptides selected from the group consisting of SEQ ID NOs: 141 to 153.

In some embodiments, the immunogenic peptide composition comprises two or more peptides selected from the group consisting of SEQ ID NOs: 141 to 153. In some embodiments, the immunogenic peptide composition comprises a peptide derived from a KRAS G12A protein mutation.

In another aspect, the invention provides for an immunogenic composition comprising nucleic acid sequences encoding one or more amino acid sequences selected from the group consisting of SEQ ID NOs: 192 to 202.

In some embodiments, the immunogenic composition comprises nucleic acid sequences encoding one or more amino acid sequences derived from a KRAS G12S protein mutation. In some embodiments, the immunogenic composition comprises nucleic acid sequences encoding two or more amino acid sequences selected from the group consisting of SEQ ID NOs: 192 to 202.

In another aspect, the invention provides for an immunogenic peptide composition comprising one or more peptides selected from the group consisting of SEQ ID NOs: 192 to 202.

In some embodiments, the immunogenic peptide composition comprises two or more peptides selected from the group consisting of SEQ ID NOs: 192 to 202. In some embodiments, the immunogenic peptide composition comprises a peptide derived from a KRAS G12S protein mutation.

In another aspect, the invention provides for an immunogenic composition comprising nucleic acid sequences encoding one or more amino acid sequences selected from the group consisting of SEQ ID NOs: 256 to 272.

In some embodiments, the immunogenic composition comprises nucleic acid sequences encoding one or more amino acid sequences derived from a NRAS Q61R protein mutation. In some embodiments, the immunogenic composition comprises nucleic acid sequences encoding two or more amino acid sequences selected from the group consisting of SEQ ID NOs: 256 to 272.

In another aspect, the invention provides for an immunogenic peptide composition comprising one or more peptides selected from the group consisting of SEQ ID NOs: 256 to 272.

In some embodiments, the immunogenic peptide composition comprises two or more peptides selected from the group consisting of SEQ ID NOs: 256 to 272. In some embodiments, the immunogenic peptide composition comprises a peptide derived from a NRAS Q61R protein mutation.

In another aspect, the invention provides for an immunogenic composition comprising nucleic acid sequences encoding one or more amino acid sequences selected from the group consisting of SEQ ID NOs: 230 to 238.

In some embodiments, the immunogenic composition comprises nucleic acid sequences encoding one or more amino acid sequences derived from a NRAS Q61K protein mutation. In some embodiments, the immunogenic composition comprises nucleic acid sequences encoding two or more amino acid sequences selected from the group consisting of SEQ ID NOs: 230 to 238.

In another aspect, the invention provides for an immunogenic peptide composition comprising one or more peptides selected from the group consisting of SEQ ID NOs: 230 to 238.

In some embodiments, the immunogenic peptide composition comprises two or more peptides selected from the group consisting of SEQ ID NOs: 230 to 238. In some embodiments, the immunogenic peptide composition comprises a peptide derived from a NRAS Q61K protein mutation.

In another aspect, the invention provides for an immunogenic composition comprising nucleic acid sequences encoding one or more amino acid sequences selected from the group consisting of SEQ ID NOs: 239 to 255.

In some embodiments, the immunogenic composition comprises nucleic acid sequences encoding one or more amino acid sequences derived from a NRAS Q61L protein mutation. In some embodiments, the immunogenic composition comprises nucleic acid sequences encoding two or more amino acid sequences selected from the group consisting of SEQ ID NOs: 239 to 255.

In another aspect, the invention provides for an immunogenic peptide composition comprising one or more peptides selected from the group consisting of SEQ ID NOs: 239 to 255.

In some embodiments, the immunogenic peptide composition comprises two or more peptides selected from the group consisting of SEQ ID NOs: 239 to 255. In some embodiments, the immunogenic peptide composition comprises a peptide derived from a NRAS Q61L protein mutation.

In another aspect, the invention provides for an immunogenic composition comprising nucleic acid sequences encoding one or more amino acid sequences selected from the group consisting of SEQ ID NOs: 273 to 285.

In some embodiments, the immunogenic composition comprises nucleic acid sequences encoding one or more amino acid sequences derived from a PIK3CA E542K protein mutation. In some embodiments, the immunogenic composition comprises nucleic acid sequences encoding two or more amino acid sequences selected from the group consisting of SEQ ID NOs: 273 to 285.

In another aspect, the invention provides for an immunogenic peptide composition comprising one or more peptides selected from the group consisting of SEQ ID NOs: 273 to 285.

In some embodiments, the immunogenic peptide composition comprises two or more peptides selected from the group consisting of SEQ ID NOs: 273 to 285. In some embodiments, the immunogenic peptide composition comprises a peptide derived from a PIK3CA E542K protein mutation.

In another aspect, the invention provides for an immunogenic composition comprising nucleic acid sequences encoding one or more amino acid sequences selected from the group consisting of SEQ ID NOs: 286 to 293.

In some embodiments, the immunogenic composition comprises nucleic acid sequences encoding one or more amino acid sequences derived from a PIK3CA E545K protein mutation. In some embodiments, the immunogenic composition comprises nucleic acid sequences encoding two or more amino acid sequences selected from the group consisting of SEQ ID NOs: 286 to 293.

In another aspect, the invention provides for an immunogenic peptide composition comprising one or more peptides selected from the group consisting of SEQ ID NOs: 286 to 293.

In some embodiments, the immunogenic peptide composition comprises two or more peptides selected from the group consisting of SEQ ID NOs: 286 to 293. In some embodiments, the immunogenic peptide composition comprises a peptide derived from a PIK3CA E545K protein mutation.

In another aspect, the invention provides for an immunogenic composition comprising nucleic acid sequences encoding one or more amino acid sequences selected from the group consisting of SEQ ID NOs: 294 to 309.

In some embodiments, the immunogenic composition comprises nucleic acid sequences encoding one or more amino acid sequences derived from a PIK3CA H1047R protein mutation. In some embodiments, the immunogenic composition comprises nucleic acid sequences encoding two or more amino acid sequences selected from the group consisting of SEQ ID NOs: 294 to 309.

In another aspect, the invention provides for an immunogenic peptide composition comprising one or more peptides selected from the group consisting of SEQ ID NOs: 294 to 309.

In some embodiments, the immunogenic peptide composition comprises two or more peptides selected from the group consisting of SEQ ID NOs: 294 to 309. In some embodiments, the immunogenic peptide composition comprises a peptide derived from a PIK3CA H1047R protein mutation.

In another aspect, the invention provides for an immunogenic composition comprising nucleic acid sequences encoding one or more amino acid sequences selected from the group consisting of SEQ ID NOs: 359 to 374.

In some embodiments, the immunogenic composition comprises nucleic acid sequences encoding one or more amino acid sequences derived from a TP53 R158L protein mutation. In some embodiments, the immunogenic composition comprises nucleic acid sequences encoding two or more amino acid sequences selected from the group consisting of SEQ ID NOs: 359 to 374.

In another aspect, the invention provides for an immunogenic peptide composition comprising one or more peptides selected from the group consisting of SEQ ID NOs: 359 to 374.

In some embodiments, the immunogenic peptide composition comprises two or more peptides selected from the group consisting of SEQ ID NOs: 359 to 374. In some embodiments, the immunogenic peptide composition comprises a peptide derived from a TP53 R158L protein mutation.

In another aspect, the invention provides for an immunogenic composition comprising nucleic acid sequences encoding one or more amino acid sequences selected from the group consisting of SEQ ID NOs: 375 to 386.

In some embodiments, the immunogenic composition comprises nucleic acid sequences encoding one or more amino acid sequences derived from a TP53 R175H protein mutation. In some embodiments, the immunogenic composition comprises nucleic acid sequences encoding two or more amino acid sequences selected from the group consisting of SEQ ID NOs: 375 to 386.

In another aspect, the invention provides for an immunogenic peptide composition comprising one or more peptides selected from the group consisting of SEQ ID NOs: 375 to 386.

In some embodiments, the immunogenic peptide composition comprises two or more peptides selected from the group consisting of SEQ ID NOs: 375 to 386. In some embodiments, the immunogenic peptide composition comprises a peptide derived from a TP53 R175H protein mutation.

In another aspect, the invention provides for an immunogenic composition comprising nucleic acid sequences encoding one or more amino acid sequences selected from the group consisting of SEQ ID NOs: 387 to 401.

In some embodiments, the immunogenic composition comprises nucleic acid sequences encoding one or more amino acid sequences derived from a TP53 R248Q protein mutation. In some embodiments, the immunogenic composition comprises nucleic acid sequences encoding two or more amino acid sequences selected from the group consisting of SEQ ID NOs: 387 to 401.

In another aspect, the invention provides for an immunogenic peptide composition comprising one or more peptides selected from the group consisting of SEQ ID NOs: 387 to 401.

In some embodiments, the immunogenic peptide composition comprises two or more peptides selected from the group consisting of SEQ ID NOs: 387 to 401. In some embodiments, the immunogenic peptide composition comprises a peptide derived from a TP53 R248Q protein mutation.

In another aspect, the invention provides for an immunogenic composition comprising nucleic acid sequences encoding one or more amino acid sequences selected from the group consisting of SEQ ID NOs: 422 to 432.

In some embodiments, the immunogenic composition comprises nucleic acid sequences encoding one or more amino acid sequences derived from a TP53 R273C protein mutation. In some embodiments, the immunogenic composition comprises nucleic acid sequences encoding two or more amino acid sequences selected from the group consisting of SEQ ID NOs: 422 to 432.

In another aspect, the invention provides for an immunogenic peptide composition comprising one or more peptides selected from the group consisting of SEQ ID NOs: 422 to 432.

In some embodiments, the immunogenic peptide composition comprises two or more peptides selected from the group consisting of SEQ ID NOs: 422 to 432. In some embodiments, the immunogenic peptide composition comprises a peptide derived from a TP53 R273C protein mutation.

In another aspect, the invention provides for an immunogenic composition comprising nucleic acid sequences encoding one or more amino acid sequences selected from the group consisting of SEQ ID NOs: 433 to 446.

In some embodiments, the immunogenic composition comprises nucleic acid sequences encoding one or more amino acid sequences derived from a TP53 R273H protein mutation. In some embodiments, the immunogenic composition comprises nucleic acid sequences encoding two or more amino acid sequences selected from the group consisting of SEQ ID NOs: 433 to 446.

In another aspect, the invention provides for an immunogenic peptide composition comprising one or more peptides selected from the group consisting of SEQ ID NOs: 433 to 446.

In some embodiments, the immunogenic peptide composition comprises two or more peptides selected from the group consisting of SEQ ID NOs: 433 to 446. In some embodiments, the immunogenic peptide composition comprises a peptide derived from a TP53 R273H protein mutation.

In another aspect, the invention provides for an immunogenic composition comprising nucleic acid sequences encoding one or more amino acid sequences selected from the group consisting of SEQ ID NOs: 402 to 421.

In some embodiments, the immunogenic composition comprises nucleic acid sequences encoding one or more amino acid sequences derived from a TP53 R248W protein mutation. In some embodiments, the immunogenic composition comprises nucleic acid sequences encoding two or more amino acid sequences selected from the group consisting of SEQ ID NOs: 402 to 421.

In another aspect, the invention provides for an immunogenic peptide composition comprising one or more peptides selected from the group consisting of SEQ ID NOs: 402 to 421.

In some embodiments, the immunogenic peptide composition comprises two or more peptides selected from the group consisting of SEQ ID NOs: 402 to 421. In some embodiments, the immunogenic peptide composition comprises a peptide derived from a TP53 R248W protein mutation.

In another aspect, the invention provides for an immunogenic composition comprising nucleic acid sequences encoding one or more amino acid sequences selected from the group consisting of SEQ ID NOs: 447 to 449.

In some embodiments, the immunogenic composition comprises nucleic acid sequences encoding one or more amino acid sequences derived from a TP53 R282W protein mutation. In some embodiments, the immunogenic composition comprises nucleic acid sequences encoding two or more amino acid sequences selected from the group consisting of SEQ ID NOs: 447 to 449.

In another aspect, the invention provides for an immunogenic peptide composition comprising one or more peptides selected from the group consisting of SEQ ID NOs: 447 to 449.

In some embodiments, the immunogenic peptide composition comprises two or more peptides selected from the group consisting of SEQ ID NOs: 447 to 449. In some embodiments, the immunogenic peptide composition comprises a peptide derived from a TP53 R282W protein mutation.

In another aspect, the invention provides for an immunogenic composition comprising nucleic acid sequences encoding one or more amino acid sequences selected from the group consisting of SEQ ID NOs: 450 to 458.

In some embodiments, the immunogenic composition comprises nucleic acid sequences encoding one or more amino acid sequences derived from a TP53 Y220C protein mutation. In some embodiments, the immunogenic composition comprises nucleic acid sequences encoding two or more amino acid sequences selected from the group consisting of SEQ ID NOs: 450 to 458.

In another aspect, the invention provides for an immunogenic peptide composition comprising one or more peptides selected from the group consisting of SEQ ID NOs: 450 to 458.

In some embodiments, the immunogenic peptide composition comprises two or more peptides selected from the group consisting of SEQ ID NOs: 450 to 458. In some embodiments, the immunogenic peptide composition comprises a peptide derived from a TP53 Y220C protein mutation.

In another aspect, the invention provides for an immunogenic composition comprising nucleic acid sequences encoding one or more amino acid sequences selected from the group consisting of SEQ ID NOs: 310 to 322.

In some embodiments, the immunogenic composition comprises nucleic acid sequences encoding one or more amino acid sequences derived from a PIK3CA R88Q protein mutation. In some embodiments, the immunogenic composition comprises nucleic acid sequences encoding two or more amino acid sequences selected from the group consisting of SEQ ID NOs: 310 to 322.

In another aspect, the invention provides for an immunogenic peptide composition comprising one or more peptides selected from the group consisting of SEQ ID NOs: 310 to 322.

In some embodiments, the immunogenic peptide composition comprises two or more peptides selected from the group consisting of SEQ ID NOs: 310 to 322. In some embodiments, the immunogenic peptide composition comprises a peptide derived from a PIK3CA R88Q protein mutation.

In another aspect, the invention provides for an immunogenic composition comprising nucleic acid sequences encoding one or more amino acid sequences selected from the group consisting of SEQ ID NOs: 99 to 118.

In some embodiments, the immunogenic composition comprises nucleic acid sequences encoding one or more amino acid sequences derived from a GTF2I L424H protein mutation. In some embodiments, the immunogenic composition comprises nucleic acid sequences encoding two or more amino acid sequences selected from the group consisting of SEQ ID NOs: 99 to 118.

In another aspect, the invention provides for an immunogenic peptide composition comprising one or more peptides selected from the group consisting of SEQ ID NOs: 99 to 118.

In some embodiments, the immunogenic peptide composition comprises two or more peptides selected from the group consisting of SEQ ID NOs: 99 to 118. In some embodiments, the immunogenic peptide composition comprises a peptide derived from a GTF2I L424H protein mutation.

In another aspect, the invention provides for an immunogenic composition comprising nucleic acid sequences encoding one or more amino acid sequences selected from the group consisting of SEQ ID NOs: 338 to 353.

In some embodiments, the immunogenic composition comprises nucleic acid sequences encoding one or more amino acid sequences derived from a PTEN R130Q protein mutation. In some embodiments, the immunogenic composition comprises nucleic acid sequences encoding two or more amino acid sequences selected from the group consisting of SEQ ID NOs: 338 to 353.

In another aspect, the invention provides for an immunogenic peptide composition comprising one or more peptides selected from the group consisting of SEQ ID NOs: 338 to 353.

In some embodiments, the immunogenic peptide composition comprises two or more peptides selected from the group consisting of SEQ ID NOs: 338 to 353. In some embodiments, the immunogenic peptide composition comprises a peptide derived from a PTEN R130Q protein mutation.

In another aspect, the invention provides for an immunogenic composition comprising nucleic acid sequences encoding one or more amino acid sequences selected from the group consisting of SEQ ID NOs: 1 to 18.

In some embodiments, the immunogenic composition comprises nucleic acid sequences encoding one or more amino acid sequences derived from a AKT1 E17K protein mutation. In some embodiments, the immunogenic composition comprises nucleic acid sequences encoding two or more amino acid sequences selected from the group consisting of SEQ ID NOs: 1 to 18.

In another aspect, the invention provides for an immunogenic peptide composition comprising one or more peptides selected from the group consisting of SEQ ID NOs: 1 to 18.

In some embodiments, the immunogenic peptide composition comprises two or more peptides selected from the group consisting of SEQ ID NOs: 1 to 18. In some embodiments, the immunogenic peptide composition comprises a peptide derived from a AKT1 E17K protein mutation.

In another aspect, the invention provides for an immunogenic composition comprising nucleic acid sequences encoding one or more amino acid sequences selected from the group consisting of SEQ ID NOs: 323 to 337.

In some embodiments, the immunogenic composition comprises nucleic acid sequences encoding one or more amino acid sequences derived from a PTEN R130G protein mutation. In some embodiments, the immunogenic composition comprises nucleic acid sequences encoding two or more amino acid sequences selected from the group consisting of SEQ ID NOs: 323 to 337.

In another aspect, the invention provides for an immunogenic peptide composition comprising one or more peptides selected from the group consisting of SEQ ID NOs: 323 to 337.

In some embodiments, the immunogenic peptide composition comprises two or more peptides selected from the group consisting of SEQ ID NOs: 323 to 337. In some embodiments, the immunogenic peptide composition comprises a peptide derived from a PTEN R130G protein mutation.

In another aspect, the invention provides for an immunogenic composition comprising nucleic acid sequences encoding one or more amino acid sequences selected from the group consisting of SEQ ID NOs: 354 to 358.

In some embodiments, the immunogenic composition comprises nucleic acid sequences encoding one or more amino acid sequences derived from a TP53 H179R protein mutation. In some embodiments, the immunogenic composition comprises nucleic acid sequences encoding two or more amino acid sequences selected from the group consisting of SEQ ID NOs: 354 to 358.

In another aspect, the invention provides for an immunogenic peptide composition comprising one or more peptides selected from the group consisting of SEQ ID NOs: 354 to 358.

In some embodiments, the immunogenic peptide composition comprises two or more peptides selected from the group consisting of SEQ ID NOs: 354 to 358. In some embodiments, the immunogenic peptide composition comprises a peptide derived from a TP53 H179R protein mutation.

In another aspect, the invention provides for an immunogenic composition comprising nucleic acid sequences encoding one or more amino acid sequences selected from the group consisting of SEQ ID NOs: 168 to 169, SEQ ID NO: 171, SEQ ID NOs: 179 to 180, SEQ ID NOs: 182 to 183, SEQ ID NOs: 203 to 204, and SEQ ID NO: 207.

In some embodiments, the immunogenic composition comprises nucleic acid sequences encoding two or more amino acid sequences selected from the group consisting of SEQ ID NOs: 168 to 169, SEQ ID NO: 171, SEQ ID NOs: 179 to 180, SEQ ID NOs: 182 to 183, SEQ ID NOs: 203 to 204, and SEQ ID NO: 207. In some embodiments, the nucleic acid sequences are administered in a construct for expression in vivo. In some embodiments, the in vivo administration of the nucleic acid sequences is configured to produce one or more peptides that is displayed by an HLA class I molecule. In some embodiments, the one or more peptides is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, the one or more peptides is a modified or unmodified fragment of a protein with a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53

R273H, TP53 R282W, and TP53 Y220C. In some embodiments, the nucleic acid sequences are administered in an effective amount to a subject to prevent cancer. In some embodiments, the nucleic acid sequences are administered in an effective amount to a subject to treat cancer. In some embodiments, the cancer is pancreatic cancer.

In another aspect, the invention provides for a method of treating or preventing pancreatic cancer by administering to a subject an immunogenic composition comprising nucleic acid sequences encoding one or more amino acid sequences selected from the group consisting of SEQ ID NOs: 168 to 169, SEQ ID NO: 171, SEQ ID NOs: 179 to 180, SEQ ID NOs: 182 to 183, SEQ ID NOs: 203 to 204, and SEQ ID NO: 207.

In some embodiments, the immunogenic composition comprises nucleic acid sequences encoding two or more amino acid sequences selected from the group consisting of SEQ ID NOs: 168 to 169, SEQ ID NO: 171, SEQ ID NOs: 179 to 180, SEQ ID NOs: 182 to 183, SEQ ID NOs: 203 to 204, and SEQ ID NO: 207.

In another aspect, the invention provides for an immunogenic peptide composition comprising one or more peptides selected from the group consisting of SEQ ID NOs: 168 to 169, SEQ ID NO: 171, SEQ ID NOs: 179 to 180, SEQ ID NOs: 182 to 183, SEQ ID NOs: 203 to 204, and SEQ ID NO: 207.

In some embodiments, the immunogenic peptide composition comprises two or more peptides selected from the group consisting of SEQ ID NOs: 168 to 169, SEQ ID NO: 171, SEQ ID NOs: 179 to 180, SEQ ID NOs: 182 to 183, SEQ ID NOs: 203 to 204, and SEQ ID NO: 207. In some embodiments, a peptide in the immunogenic peptide composition is displayed by an HLA class I molecule. In some embodiments, a peptide in the immunogenic peptide composition is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, a peptide in the immunogenic peptide composition is a modified or unmodified fragment of a protein, wherein the protein comprises a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the immunogenic peptide composition is administered in an effective amount to a subject to prevent cancer. In some embodiments, the immunogenic peptide composition is administered in an effective amount to a subject to treat cancer. In some embodiments, the cancer is pancreatic cancer.

In another aspect, the invention provides for a method of treating or preventing pancreatic cancer in a subject comprising administering to the subject an immunogenic peptide composition comprising one or more peptides selected from the group consisting of SEQ ID NOs: 168 to 169, SEQ ID NO: 171, SEQ ID NOs: 179 to 180, SEQ ID NOs: 182 to 183, SEQ ID NOs: 203 to 204, and SEQ ID NO: 207.

In some embodiments, the immunogenic peptide composition comprises two or more peptides selected from the group consisting of SEQ ID NOs: 168 to 169, SEQ ID NO: 171, SEQ ID NOs: 179 to 180, SEQ ID NOs: 182 to 183, SEQ ID NOs: 203 to 204, and SEQ ID NO: 207.

In another aspect, the invention provides for an immunogenic composition comprising nucleic acid sequences encoding one or more amino acid sequences selected from the group consisting of SEQ ID NOs: 19 to 23, SEQ ID NOs: 34 to 40, SEQ ID NOs: 230 to 231, SEQ ID NO: 239, SEQ ID NOs: 241 to 242, and SEQ ID NOs: 260 to 262.

In some embodiments, the immunogenic composition comprises nucleic acid sequences encoding two or more amino acid sequences selected from the group consisting of SEQ ID NOs: 19 to 23, SEQ ID NOs: 34 to 40, SEQ ID NOs: 230 to 231, SEQ ID NO: 239, SEQ ID NOs: 241 to 242, and SEQ ID NOs: 260 to 262. In some embodiments, the nucleic acid sequences are administered in a construct for expression in vivo. In some embodiments, the in vivo administration of the nucleic acid sequences is configured to produce one or more peptides that is displayed by an HLA class I molecule. In some embodiments, the one or more peptides is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, the one or more peptides is a modified or unmodified fragment of a protein with a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the nucleic acid sequences are administered in an effective amount to a subject to prevent cancer. In some embodiments, the nucleic acid sequences are administered in an effective amount to a subject to treat cancer. In some embodiments, the cancer is skin cancer.

In another aspect, the invention provides for a method of treating or preventing skin cancer by administering to a subject an immunogenic composition comprising nucleic acid sequences encoding one or more amino acid sequences selected from the group consisting of SEQ ID NOs: 19 to 23, SEQ ID NOs: 34 to 40, SEQ ID NOs: 230 to 231, SEQ ID NO: 239, SEQ ID NOs: 241 to 242, and SEQ ID NOs: 260 to 262.

In some embodiments, the immunogenic composition comprises nucleic acid sequences encoding two or more amino acid sequences selected from the group consisting of SEQ ID NOs: 19 to 23, SEQ ID NOs: 34 to 40, SEQ ID NOs: 230 to 231, SEQ ID NO: 239, SEQ ID NOs: 241 to 242, and SEQ ID NOs: 260 to 262.

In another aspect, the invention provides for an immunogenic peptide composition comprising one or more peptides selected from the group consisting of SEQ ID NOs: 19 to 23, SEQ ID NOs: 34 to 40, SEQ ID NOs: 230 to 231, SEQ ID NO: 239, SEQ ID NOs: 241 to 242, and SEQ ID NOs: 260 to 262.

In some embodiments, the immunogenic peptide composition comprises two or more peptides selected from the group consisting of SEQ ID NOs: 19 to 23, SEQ ID NOs: 34 to 40, SEQ ID NOs: 230 to 231, SEQ ID NO: 239, SEQ ID NOs: 241 to 242, and SEQ ID NOs: 260 to 262. In some embodiments, a peptide in the immunogenic peptide composition is displayed by an HLA class I molecule. In some embodiments, a peptide in the immunogenic peptide composition is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, a peptide in the immunogenic peptide composition is a modified or unmodified fragment of a protein, wherein the protein comprises a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the immunogenic peptide composition is administered in an effective amount to a subject to prevent cancer. In some embodiments, the immunogenic peptide composition is administered in an effective amount to a subject to treat cancer. In some embodiments, the cancer is skin cancer.

In another aspect, the invention provides for a method of treating or preventing skin cancer in a subject comprising administering to the subject an immunogenic peptide composition comprising one or more peptides selected from the group consisting of SEQ ID NOs: 19 to 23, SEQ ID NOs: 34 to 40, SEQ ID NOs: 230 to 231, SEQ ID NO: 239, SEQ ID NOs: 241 to 242, and SEQ ID NOs: 260 to 262.

In some embodiments, the immunogenic peptide composition comprises two or more peptides selected from the group consisting of SEQ ID NOs: 19 to 23, SEQ ID NOs: 34 to 40, SEQ ID NOs: 230 to 231, SEQ ID NO: 239, SEQ ID NOs: 241 to 242, and SEQ ID NOs: 260 to 262.

In another aspect, the invention provides for an immunogenic composition comprising nucleic acid sequences encoding one or more amino acid sequences selected from the group consisting of SEQ ID NOs: 19 to 23, SEQ ID NOs: 230 to 231, and SEQ ID NOs: 260 to 262.

In some embodiments, the immunogenic composition comprises nucleic acid sequences encoding two or more amino acid sequences selected from the group consisting of SEQ ID NOs: 19 to 23, SEQ ID NOs: 230 to 231, and SEQ ID NOs: 260 to 262. In some embodiments, the nucleic acid sequences are administered in a construct for expression in vivo. In some embodiments, the in vivo administration of the nucleic acid sequences is configured to produce one or more peptides that is displayed by an HLA class I molecule. In some embodiments, the one or more peptides is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, the one or more peptides is a modified or unmodified fragment of a protein with a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the nucleic acid sequences are administered in an effective amount to a subject to prevent cancer. In some embodiments, the nucleic acid sequences are administered in an effective amount to a subject to treat cancer. In some embodiments, the cancer is thyroid cancer.

In another aspect, the invention provides for a method of treating or preventing thyroid cancer by administering to a subject an immunogenic composition comprising nucleic acid sequences encoding one or more amino acid sequences selected from the group consisting of SEQ ID NOs: 19 to 23, SEQ ID NOs: 230 to 231, and SEQ ID NOs: 260 to 262.

In some embodiments, the immunogenic composition comprises nucleic acid sequences encoding two or more amino acid sequences selected from the group consisting of SEQ ID NOs: 19 to 23, SEQ ID NOs: 230 to 231, and SEQ ID NOs: 260 to 262.

In another aspect, the invention provides for an immunogenic peptide composition comprising one or more peptides selected from the group consisting of SEQ ID NOs: 19 to 23, SEQ ID NOs: 230 to 231, and SEQ ID NOs: 260 to 262.

In some embodiments, the immunogenic peptide composition comprises two or more peptides selected from the group consisting of SEQ ID NOs: 19 to 23, SEQ ID NOs: 230 to 231, and SEQ ID NOs: 260 to 262. In some embodiments, a peptide in the immunogenic peptide composition is displayed by an HLA class I molecule. In some embodiments, a peptide in the immunogenic peptide composition is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, a peptide in the immunogenic peptide composition is a modified or unmodified fragment of a protein, wherein the protein comprises a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the immunogenic peptide composition is administered in an effective amount to a subject to prevent cancer. In some embodiments, the immunogenic peptide composition is administered in an effective amount to a subject to treat cancer. In some embodiments, the cancer is thyroid cancer.

In another aspect, the invention provides for a method of treating or preventing thyroid cancer in a subject comprising administering to the subject an immunogenic peptide composition comprising one or more peptides selected from the group consisting of SEQ ID NOs: 19 to 23, SEQ ID NOs: 230 to 231, and SEQ ID NOs: 260 to 262.

In some embodiments, the immunogenic peptide composition comprises two or more peptides selected from the group consisting of SEQ ID NOs: 19 to 23, SEQ ID NOs: 230 to 231, and SEQ ID NOs: 260 to 262.

In another aspect, the invention provides for an immunogenic composition comprising nucleic acid sequences encoding one or more amino acid sequences selected from the group consisting of SEQ ID NOs: 51 to 55, SEQ ID NOs: 67 to 70, SEQ ID NOs: 72 to 73, SEQ ID NOs: 119 to 120, SEQ ID NOs: 125 to 130, SEQ ID NO: 375, SEQ ID NO: 423, and SEQ ID NO: 425.

In some embodiments, the immunogenic composition comprises nucleic acid sequences encoding two or more amino acid sequences selected from the group consisting of SEQ ID NOs: 51 to 55, SEQ ID NOs: 67 to 70, SEQ ID NOs: 72 to 73, SEQ ID NOs: 119 to 120, SEQ ID NOs: 125 to 130, SEQ ID NO: 375, SEQ ID NO: 423, and SEQ ID NO: 425. In some embodiments, the nucleic acid sequences are administered in a construct for expression in vivo. In some embodiments, the in vivo administration of the nucleic acid sequences is configured to produce one or more peptides that is displayed by an HLA class I molecule. In some embodiments, the one or more peptides is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, the one or more peptides is a modified or unmodified fragment of a protein with a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the nucleic acid sequences are administered in an effective amount to a subject to prevent cancer. In some embodiments, the nucleic acid sequences are administered in an effective amount to a subject to treat cancer. In some embodiments, the cancer is brain cancer.

In another aspect, the invention provides for a method of treating or preventing brain cancer by administering to a subject an immunogenic composition comprising nucleic acid sequences encoding one or more amino acid sequences selected from the group consisting of SEQ ID NOs: 51 to 55, SEQ ID NOs: 67 to 70, SEQ ID NOs: 72 to 73, SEQ ID NOs: 119 to 120, SEQ ID NOs: 125 to 130, SEQ ID NO: 375, SEQ ID NO: 423, and SEQ ID NO: 425.

In some embodiments, the immunogenic composition comprises nucleic acid sequences encoding two or more amino acid sequences selected from the group consisting of SEQ ID NOs: 51 to 55, SEQ ID NOs: 67 to 70, SEQ ID NOs: 72 to 73, SEQ ID NOs: 119 to 120, SEQ ID NOs: 125 to 130, SEQ ID NO: 375, SEQ ID NO: 423, and SEQ ID NO: 425.

In another aspect, the invention provides for an immunogenic peptide composition comprising one or more peptides selected from the group consisting of SEQ ID NOs: 51 to 55, SEQ ID NOs: 67 to 70, SEQ ID NOs: 72 to 73, SEQ ID NOs: 119 to 120, SEQ ID NOs: 125 to 130, SEQ ID NO: 375, SEQ ID NO: 423, and SEQ ID NO: 425.

In some embodiments, the immunogenic peptide composition comprises two or more peptides selected from the group consisting of SEQ ID NOs: 51 to 55, SEQ ID NOs: 67 to 70, SEQ ID NOs: 72 to 73, SEQ ID NOs: 119 to 120, SEQ ID NOs: 125 to 130, SEQ ID NO: 375, SEQ ID NO: 423, and SEQ ID NO: 425. In some embodiments, a peptide in the immunogenic peptide composition is displayed by an HLA class I molecule. In some embodiments, a peptide in the immunogenic peptide composition is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, a peptide in the immunogenic peptide composition is a modified or unmodified fragment of a protein, wherein the protein comprises a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the immunogenic peptide composition is administered in an effective amount to a subject to prevent cancer. In some embodiments, the immunogenic peptide composition is administered in an effective amount to a subject to treat cancer. In some embodiments, the cancer is brain cancer.

In another aspect, the invention provides for a method of treating or preventing brain cancer in a subject comprising administering to the subject an immunogenic peptide composition comprising one or more peptides selected from the group consisting of SEQ ID NOs: 51 to 55, SEQ ID NOs: 67 to 70, SEQ ID NOs: 72 to 73, SEQ ID NOs: 119 to 120, SEQ ID NOs: 125 to 130, SEQ ID NO: 375, SEQ ID NO: 423, and SEQ ID NO: 425.

In some embodiments, the immunogenic peptide composition comprises two or more peptides selected from the group consisting of SEQ ID NOs: 51 to 55, SEQ ID NOs: 67 to 70, SEQ ID NOs: 72 to 73, SEQ ID NOs: 119 to 120, SEQ ID NOs: 125 to 130, SEQ ID NO: 375, SEQ ID NO: 423, and SEQ ID NO: 425.

In another aspect, the invention provides for an immunogenic composition comprising nucleic acid sequences encoding one or more amino acid sequences selected from the group consisting of SEQ ID NOs: 20 to 23, SEQ ID NOs: 167 to 169, SEQ ID NO: 171, SEQ ID NOs: 203 to 207, SEQ ID NOs: 215 to 217, and SEQ ID NO: 288.

In some embodiments, the immunogenic composition comprises nucleic acid sequences encoding two or more amino acid sequences selected from the group consisting of SEQ ID NOs: 20 to 23, SEQ ID NOs: 167 to 169, SEQ ID NO: 171, SEQ ID NOs: 203 to 207, SEQ ID NOs: 215 to 217, and SEQ ID NO: 288. In some embodiments, the nucleic acid sequences are administered in a construct for expression in vivo. In some embodiments, the in vivo administration of the nucleic acid sequences is configured to produce one or more peptides that is displayed by an HLA class I molecule. In some embodiments, the one or more peptides is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, the one or more peptides is a modified or unmodified fragment of a protein with a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the nucleic acid sequences are administered in an effective amount to a subject to prevent cancer. In some embodiments, the nucleic acid sequences are administered in an effective amount to a subject to treat cancer. In some embodiments, the cancer is colorectal cancer.

In another aspect, the invention provides for a method of treating or preventing colorectal cancer by administering to a subject an immunogenic composition comprising nucleic acid sequences encoding one or more amino acid sequences selected from the group consisting of SEQ ID NOs: 20 to 23, SEQ ID NOs: 167 to 169, SEQ ID NO: 171, SEQ ID NOs: 203 to 207, SEQ ID NOs: 215 to 217, and SEQ ID NO: 288.

In some embodiments, the immunogenic composition comprises nucleic acid sequences encoding two or more amino acid sequences selected from the group consisting of SEQ ID NOs: 20 to 23, SEQ ID NOs: 167 to 169, SEQ ID NO: 171, SEQ ID NOs: 203 to 207, SEQ ID NOs: 215 to 217, and SEQ ID NO: 288.

In another aspect, the invention provides for an immunogenic peptide composition comprising one or more peptides selected from the group consisting of SEQ ID NOs: 20 to 23, SEQ ID NOs: 167 to 169, SEQ ID NO: 171, SEQ ID NOs: 203 to 207, SEQ ID NOs: 215 to 217, and SEQ ID NO: 288.

In some embodiments, the immunogenic peptide composition comprises two or more peptides selected from the group consisting of SEQ ID NOs: 20 to 23, SEQ ID NOs: 167 to 169, SEQ ID NO: 171, SEQ ID NOs: 203 to 207, SEQ ID NOs: 215 to 217, and SEQ ID NO: 288. In some embodiments, a peptide in the immunogenic peptide composition is displayed by an HLA class I molecule. In some embodiments, a peptide in the immunogenic peptide composition is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, a peptide in the immunogenic peptide composition is a modified or unmodified fragment of a protein, wherein the protein comprises a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the immunogenic peptide composition is administered in an effective amount to a subject to prevent cancer. In some embodiments, the immunogenic peptide composition is administered in an effective amount to a subject to treat cancer. In some embodiments, the cancer is colorectal cancer.

In another aspect, the invention provides for a method of treating or preventing colorectal cancer in a subject comprising administering to the subject an immunogenic peptide composition comprising one or more peptides selected from the group consisting of SEQ ID NOs: 20 to 23, SEQ ID NOs: 167 to 169, SEQ ID NO: 171, SEQ ID NOs: 203 to 207, SEQ ID NOs: 215 to 217, and SEQ ID NO: 288.

In some embodiments, the immunogenic peptide composition comprises two or more peptides selected from the group consisting of SEQ ID NOs: 20 to 23, SEQ ID NOs: 167 to 169, SEQ ID NO: 171, SEQ ID NOs: 203 to 207, SEQ ID NOs: 215 to 217, and SEQ ID NO: 288.

In another aspect, the invention provides for an immunogenic composition comprising nucleic acid sequences encoding one or more amino acid sequences selected from the group consisting of SEQ ID NOs: 82 to 86, SEQ ID NOs: 141 to 144, SEQ ID NOs: 154 to 159, SEQ ID NOs: 168 to 169, SEQ ID NO: 171, SEQ ID NOs: 203 to 204, SEQ ID NO: 207, SEQ ID NOs: 274 to 276, SEQ ID NO: 288, SEQ ID NO: 359, and SEQ ID NOs: 362 to 364.

In some embodiments, the immunogenic composition comprises nucleic acid sequences encoding two or more amino acid sequences selected from the group consisting of SEQ ID NOs: 82 to 86, SEQ ID NOs: 141 to 144, SEQ ID NOs: 154 to 159, SEQ ID NOs: 168 to 169, SEQ ID NO: 171, SEQ ID NOs: 203 to 204, SEQ ID NO: 207, SEQ ID NOs: 274 to 276, SEQ ID NO: 288, SEQ ID NO: 359, and SEQ ID NOs: 362 to 364. In some embodiments, the nucleic acid sequences are administered in a construct for expression in vivo. In some embodiments, the in vivo administration of the nucleic acid sequences is configured to produce one or more peptides that is displayed by an HLA class I molecule. In some embodiments, the one or more peptides is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, the one or more peptides is a modified or unmodified fragment of a protein with a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the nucleic acid sequences are administered in an effective amount to a subject to prevent cancer. In some embodiments, the nucleic acid sequences are administered in an effective amount to a subject to treat cancer. In some embodiments, the cancer is bronchus and lung cancer.

In another aspect, the invention provides for a method of treating or preventing bronchus and lung cancer by administering to a subject an immunogenic composition comprising nucleic acid sequences encoding one or more amino acid sequences selected from the group consisting of SEQ ID NOs: 82 to 86, SEQ ID NOs: 141 to 144, SEQ ID NOs: 154 to 159, SEQ ID NOs: 168 to 169, SEQ ID NO: 171, SEQ ID NOs: 203 to 204, SEQ ID NO: 207, SEQ ID NOs: 274 to 276, SEQ ID NO: 288, SEQ ID NO: 359, and SEQ ID NOs: 362 to 364.

In some embodiments, the immunogenic composition comprises nucleic acid sequences encoding two or more amino acid sequences selected from the group consisting of SEQ ID NOs: 82 to 86, SEQ ID NOs: 141 to 144, SEQ ID NOs: 154 to 159, SEQ ID NOs: 168 to 169, SEQ ID NO: 171, SEQ ID NOs: 203 to 204, SEQ ID NO: 207, SEQ ID NOs: 274 to 276, SEQ ID NO: 288, SEQ ID NO: 359, and SEQ ID NOs: 362 to 364.

In another aspect, the invention provides for an immunogenic peptide composition comprising one or more peptides selected from the group consisting of SEQ ID NOs: 82 to 86, SEQ ID NOs: 141 to 144, SEQ ID NOs: 154 to 159, SEQ ID NOs: 168 to 169, SEQ ID NO: 171, SEQ ID NOs: 203 to 204, SEQ ID NO: 207, SEQ ID NOs: 274 to 276, SEQ ID NO: 288, SEQ ID NO: 359, and SEQ ID NOs: 362 to 364.

In some embodiments, the immunogenic peptide composition comprises two or more peptides selected from the group consisting of SEQ ID NOs: 82 to 86, SEQ ID NOs: 141 to 144, SEQ ID NOs: 154 to 159, SEQ ID NOs: 168 to 169, SEQ ID NO: 171, SEQ ID NOs: 203 to 204, SEQ ID NO: 207, SEQ ID NOs: 274 to 276, SEQ ID NO: 288, SEQ ID NO: 359, and SEQ ID NOs: 362 to 364. In some embodiments, a peptide in the immunogenic peptide composition is displayed by an HLA class I molecule. In some embodiments, a peptide in the immunogenic peptide composition is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, a peptide in the immunogenic peptide composition is a modified or unmodified fragment of a protein, wherein the protein comprises a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the immunogenic peptide composition is administered in an effective amount to a subject to prevent cancer. In some embodiments, the immunogenic peptide composition is administered in an effective amount to a subject to treat cancer. In some embodiments, the cancer is bronchus and lung cancer.

In another aspect, the invention provides for a method of treating or preventing bronchus and lung cancer in a subject comprising administering to the subject an immunogenic peptide composition comprising one or more peptides selected from the group consisting of SEQ ID NOs: 82 to 86, SEQ ID NOs: 141 to 144, SEQ ID NOs: 154 to 159, SEQ ID NOs: 168 to 169, SEQ ID NO: 171, SEQ ID NOs: 203 to 204, SEQ ID NO: 207, SEQ ID NOs: 274 to 276, SEQ ID NO: 288, SEQ ID NO: 359, and SEQ ID NOs: 362 to 364.

In some embodiments, the immunogenic peptide composition comprises two or more peptides selected from the group consisting of SEQ ID NOs: 82 to 86, SEQ ID NOs: 141 to 144, SEQ ID NOs: 154 to 159, SEQ ID NOs: 168 to 169, SEQ ID NO: 171, SEQ ID NOs: 203 to 204, SEQ ID NO: 207, SEQ ID NOs: 274 to 276, SEQ ID NO: 288, SEQ ID NO: 359, and SEQ ID NOs: 362 to 364.

In another aspect, the invention provides for an immunogenic composition comprising nucleic acid sequences encoding one or more amino acid sequences selected from the group consisting of SEQ ID NOs: 273 to 309, SEQ ID NOs: 375 to 386, and SEQ ID NOs: 422 to 446.

In some embodiments, the immunogenic composition comprises nucleic acid sequences encoding two or more amino acid sequences selected from the group consisting of SEQ ID NOs: 273 to 309, SEQ ID NOs: 375 to 386, and SEQ ID NOs: 422 to 446. In some embodiments, the nucleic acid sequences are administered in a construct for expression in vivo. In some embodiments, the in vivo administration of the nucleic acid sequences is configured to produce one or more peptides that is displayed by an HLA class I molecule. In some embodiments, the one or more peptides is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, the one or more peptides is a modified or unmodified fragment of a protein with a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the nucleic acid sequences are administered in an effective amount to a subject to prevent cancer. In some embodiments, the nucleic acid sequences are administered in an effective amount to a subject to treat cancer. In some embodiments, the cancer is breast cancer.

In another aspect, the invention provides for a method of treating or preventing breast cancer by administering to a subject an immunogenic composition comprising nucleic acid sequences encoding one or more amino acid sequences selected from the group consisting of SEQ ID NOs: 273 to 309, SEQ ID NOs: 375 to 386, and SEQ ID NOs: 422 to 446.

In some embodiments, the immunogenic composition comprises nucleic acid sequences encoding two or more amino acid sequences selected from the group consisting of SEQ ID NOs: 273 to 309, SEQ ID NOs: 375 to 386, and SEQ ID NOs: 422 to 446.

In another aspect, the invention provides for an immunogenic peptide composition comprising one or more peptides selected from the group consisting of SEQ ID NOs: 273 to 309, SEQ ID NOs: 375 to 386, and SEQ ID NOs: 422 to 446.

In some embodiments, the immunogenic peptide composition comprises two or more peptides selected from the group consisting of SEQ ID NOs: 273 to 309, SEQ ID NOs: 375 to 386, and SEQ ID NOs: 422 to 446. In some embodiments, a peptide in the immunogenic peptide composition is displayed by an HLA class I molecule. In some embodiments, a peptide in the immunogenic peptide composition is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, a peptide in the immunogenic peptide composition is a modified or unmodified fragment of a protein, wherein the protein comprises a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the immunogenic peptide composition is administered in an effective amount to a subject to prevent cancer. In some embodiments, the immunogenic peptide composition is administered in an effective amount to a subject to treat cancer. In some embodiments, the cancer is breast cancer.

In another aspect, the invention provides for a method of treating or preventing breast cancer in a subject comprising administering to the subject an immunogenic peptide composition comprising one or more peptides selected from the group consisting of SEQ ID NOs: 273 to 309, SEQ ID NOs: 375 to 386, and SEQ ID NOs: 422 to 446.

In some embodiments, the immunogenic peptide composition comprises two or more peptides selected from the group consisting of SEQ ID NOs: 273 to 309, SEQ ID NOs: 375 to 386, and SEQ ID NOs: 422 to 446.

In another aspect, the invention provides for an immunogenic composition comprising nucleic acid sequences encoding one or more amino acid sequences selected from the group consisting of SEQ ID NOs: 273 to 309, SEQ ID NOs: 375 to 386, and SEQ ID NOs: 422 to 446.

In some embodiments, the immunogenic composition comprises nucleic acid sequences encoding two or more amino acid sequences selected from the group consisting of SEQ ID NOs: 273 to 309, SEQ ID NOs: 375 to 386, and SEQ ID NOs: 422 to 446. In some embodiments, the nucleic acid sequences are administered in a construct for expression in vivo. In some embodiments, the in vivo administration of the nucleic acid sequences is configured to produce one or more peptides that is displayed by an HLA class I molecule. In some embodiments, the one or more peptides is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, the one or more peptides is a modified or unmodified fragment of a protein with a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the nucleic acid sequences are administered in an effective amount to a subject to prevent cancer. In some embodiments, the nucleic acid sequences are administered in an effective amount to a subject to treat cancer. In some embodiments, the cancer is ovarian cancer.

In another aspect, the invention provides for a method of treating or preventing ovarian cancer by administering to a subject an immunogenic composition comprising nucleic acid sequences encoding one or more amino acid sequences selected from the group consisting of SEQ ID NOs: 273 to 309, SEQ ID NOs: 375 to 386, and SEQ ID NOs: 422 to 446.

In some embodiments, the immunogenic composition comprises nucleic acid sequences encoding two or more amino acid sequences selected from the group consisting of SEQ ID NOs: 273 to 309, SEQ ID NOs: 375 to 386, and SEQ ID NOs: 422 to 446.

In another aspect, the invention provides for an immunogenic peptide composition comprising one or more peptides selected from the group consisting of SEQ ID NOs: 273 to 309, SEQ ID NOs: 375 to 386, and SEQ ID NOs: 422 to 446.

In some embodiments, the immunogenic peptide composition comprises two or more peptides selected from the group consisting of SEQ ID NOs: 273 to 309, SEQ ID NOs: 375 to 386, and SEQ ID NOs: 422 to 446. In some embodiments, a peptide in the immunogenic peptide composition is displayed by an HLA class I molecule. In some embodiments, a peptide in the immunogenic peptide composition is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, a peptide in the immunogenic peptide composition is a modified or unmodified fragment of a protein, wherein the protein comprises a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the immunogenic peptide composition is administered in an effective amount to a subject to prevent cancer. In some embodiments, the immunogenic peptide composition is administered in an effective amount to a subject to treat cancer. In some embodiments, the cancer is ovarian cancer.

In another aspect, the invention provides for a method of treating or preventing ovarian cancer in a subject comprising administering to the subject an immunogenic peptide composition comprising one or more peptides selected from the group consisting of SEQ ID NOs: 273 to 309, SEQ ID NOs: 375 to 386, and SEQ ID NOs: 422 to 446.

In some embodiments, the immunogenic peptide composition comprises two or more peptides selected from the group consisting of SEQ ID NOs: 273 to 309, SEQ ID NOs: 375 to 386, and SEQ ID NOs: 422 to 446.

In one aspect, the invention provides for nucleic acid sequences encoding one or more amino acid sequences selected from the group consisting of SEQ ID NOs: 475 to 759.

In some embodiments, the nucleic acid sequences encode two or more amino acid sequences selected from the group consisting of SEQ ID NOs: 475 to 759.

In another aspect, the invention provides for an immunogenic composition comprising nucleic acid sequences encoding one or more amino acid sequences selected from the group consisting of SEQ ID NOs: 475 to 759.

In some embodiments, the immunogenic composition is administered to a subject. In some embodiments, the immunogenic composition comprises nucleic acid sequences encoding two or more amino acid sequences selected from the group consisting of SEQ ID NOs: 475 to 759. In some embodiments, the nucleic acid sequences are administered in a construct for expression in vivo. In some embodiments, the in vivo administration of the nucleic acid sequences is configured to produce one or more peptides that is displayed by an HLA class II molecule. In some embodiments, the one or more peptides is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, the one or more peptides is a modified or unmodified fragment of a protein, wherein the protein comprises a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the immunogenic composition is administered in an effective amount to a subject to prevent cancer. In some embodiments, the immunogenic composition is administered in an effective amount to a subject to treat cancer. In some embodiments, the cancer is selected from the group consisting of pancreatic cancer, skin cancer, thyroid cancer, brain cancer, colorectal cancer, bronchus and lung cancer, breast cancer, and ovarian cancer. In some embodiments, the immunogenic composition comprises nucleic acid sequences encoding at least three amino acid sequences selected from the group consisting of SEQ ID NOs: 475 to 759.

In another aspect, the invention provides for an immunogenic peptide composition comprising one or more peptides selected from the group consisting of SEQ ID NOs: 475 to 759.

In some embodiments, the immunogenic peptide composition comprises two or more peptides selected from the group consisting of SEQ ID NOs: 475 to 759.

In another aspect, the invention provides for an immunogenic composition comprising nucleic acid sequences encoding one or more amino acid sequences selected from the group consisting of SEQ ID NOs: 475 to 483.

In some embodiments, the immunogenic composition comprises nucleic acid sequences encoding one or more amino acid sequences derived from a AKT1 protein mutation. In some embodiments, the immunogenic composition comprises nucleic acid sequences encoding two or more amino acid sequences selected from the group consisting of SEQ ID NOs: 475 to 483.

In another aspect, the invention provides for an immunogenic peptide composition comprising one or more peptides selected from the group consisting of SEQ ID NOs: 475 to 483.

In some embodiments, the immunogenic peptide composition comprises two or more peptides selected from the group consisting of SEQ ID NOs: 475 to 483. In some embodiments, the one or more peptides is a modified or unmodified fragment of a mutated AKT1 protein.

In another aspect, the invention provides for an immunogenic composition comprising nucleic acid sequences encoding one or more amino acid sequences selected from the group consisting of SEQ ID NOs: 484 to 502.

In some embodiments, the immunogenic composition comprises nucleic acid sequences encoding one or more amino acid sequences derived from a BRAF protein mutation. In some embodiments, the immunogenic composition comprises nucleic acid sequences encoding two or more amino acid sequences selected from the group consisting of SEQ ID NOs: 484 to 502.

In another aspect, the invention provides for an immunogenic peptide composition comprising one or more peptides selected from the group consisting of SEQ ID NOs: 484 to 502.

In some embodiments, the immunogenic peptide composition comprises two or more peptides selected from the group consisting of SEQ ID NOs: 484 to 502. In some embodiments, the one or more peptides is a modified or unmodified fragment of a mutated BRAF protein.

In another aspect, the invention provides for an immunogenic composition comprising nucleic acid sequences encoding one or more amino acid sequences selected from the group consisting of SEQ ID NOs: 503 to 527.

In some embodiments, the immunogenic composition comprises nucleic acid sequences encoding one or more amino acid sequences derived from a EGFR protein mutation. In some embodiments, the immunogenic composition comprises nucleic acid sequences encoding two or more amino acid sequences selected from the group consisting of SEQ ID NOs: 503 to 527.

In another aspect, the invention provides for an immunogenic peptide composition comprising one or more peptides selected from the group consisting of SEQ ID NOs: 503 to 527.

In some embodiments, the immunogenic peptide composition comprises two or more peptides selected from the group consisting of SEQ ID NOs: 503 to 527. In some embodiments, the one or more peptides is a modified or unmodified fragment of a mutated EGFR protein.

In another aspect, the invention provides for an immunogenic composition comprising nucleic acid sequences encoding one or more amino acid sequences selected from the group consisting of SEQ ID NOs: 528 to 534.

In some embodiments, the immunogenic composition comprises nucleic acid sequences encoding one or more amino acid sequences derived from a GTF2I protein mutation. In some embodiments, the immunogenic composition comprises nucleic acid sequences encoding two or more amino acid sequences selected from the group consisting of SEQ ID NOs: 528 to 534.

In another aspect, the invention provides for an immunogenic peptide composition comprising one or more peptides selected from the group consisting of SEQ ID NOs: 528 to 534.

In some embodiments, the immunogenic peptide composition comprises two or more peptides selected from the group consisting of SEQ ID NOs: 528 to 534. In some embodiments, the one or more peptides is a modified or unmodified fragment of a mutated GTF2I protein.

In another aspect, the invention provides for an immunogenic composition comprising nucleic acid sequences encoding one or more amino acid sequences selected from the group consisting of SEQ ID NOs: 535 to 553.

In some embodiments, the immunogenic composition comprises nucleic acid sequences encoding one or more amino acid sequences derived from a IDH1 protein mutation. In some embodiments, the immunogenic composition comprises nucleic acid sequences encoding two or more amino acid sequences selected from the group consisting of SEQ ID NOs: 535 to 553.

In another aspect, the invention provides for an immunogenic peptide composition comprising one or more peptides selected from the group consisting of SEQ ID NOs: 535 to 553.

In some embodiments, the immunogenic peptide composition comprises two or more peptides selected from the group consisting of SEQ ID NOs: 535 to 553. In some embodiments, the one or more peptides is a modified or unmodified fragment of a mutated IDH1 protein.

In another aspect, the invention provides for an immunogenic composition comprising nucleic acid sequences encoding one or more amino acid sequences selected from the group consisting of SEQ ID NOs: 554 to 615.

In some embodiments, the immunogenic composition comprises nucleic acid sequences encoding one or more amino acid sequences derived from a KRAS protein mutation. In some embodiments, the immunogenic composition comprises nucleic acid sequences encoding two or more amino acid sequences selected from the group consisting of SEQ ID NOs:
554 to 615.

In another aspect, the invention provides for an immunogenic peptide composition comprising one or more peptides selected from the group consisting of SEQ ID NOs: 554 to 615.

In some embodiments, the immunogenic peptide composition comprises two or more peptides selected from the group consisting of SEQ ID NOs: 554 to 615. In some embodiments, the one or more peptides is a modified or unmodified fragment of a mutated KRAS protein.

In another aspect, the invention provides for an immunogenic composition comprising nucleic acid sequences encoding one or more amino acid sequences selected from the group consisting of SEQ ID NOs: 616 to 645.

In some embodiments, the immunogenic composition comprises nucleic acid sequences encoding one or more amino acid sequences derived from a NRAS protein mutation. In some embodiments, the immunogenic composition comprises nucleic acid sequences encoding two or more amino acid sequences selected from the group consisting of SEQ ID NOs: 616 to 645.

In another aspect, the invention provides for an immunogenic peptide composition comprising one or more peptides selected from the group consisting of SEQ ID NOs: 616 to 645.

In some embodiments, the immunogenic peptide composition comprises two or more peptides selected from the group consisting of SEQ ID NOs: 616 to 645. In some embodiments, the one or more peptides is a modified or unmodified fragment of a mutated NRAS protein.

In another aspect, the invention provides for an immunogenic composition comprising nucleic acid sequences encoding one or more amino acid sequences selected from the group consisting of SEQ ID NOs: 646 to 675.

In some embodiments, the immunogenic composition comprises nucleic acid sequences encoding one or more amino acid sequences derived from a PIK3CA protein mutation. In some embodiments, the immunogenic composition comprises nucleic acid sequences encoding two or more amino acid sequences selected from the group consisting of SEQ ID NOs: 646 to 675.

In another aspect, the invention provides for an immunogenic peptide composition comprising one or more peptides selected from the group consisting of SEQ ID NOs: 646 to 675.

In some embodiments, the immunogenic peptide composition comprises two or more peptides selected from the group consisting of SEQ ID NOs: 646 to 675. In some embodiments, the one or more peptides is a modified or unmodified fragment of a mutated PIK3CA protein.

In another aspect, the invention provides for an immunogenic composition comprising nucleic acid sequences encoding one or more amino acid sequences selected from the group consisting of SEQ ID NOs: 676 to 690.

In some embodiments, the immunogenic composition comprises nucleic acid sequences encoding one or more amino acid sequences derived from a PTEN protein mutation. In some embodiments, the immunogenic composition comprises nucleic acid sequences encoding two or more amino acid sequences selected from the group consisting of SEQ ID NOs: 676 to 690.

In another aspect, the invention provides for an immunogenic peptide composition comprising one or more peptides selected from the group consisting of SEQ ID NOs: 676 to 690.

In some embodiments, the immunogenic peptide composition comprises two or more peptides selected from the group consisting of SEQ ID NOs: 676 to 690. In some embodiments, the one or more peptides is a modified or unmodified fragment of a mutated PTEN protein.

In another aspect, the invention provides for an immunogenic composition comprising nucleic acid sequences encoding one or more amino acid sequences selected from the group consisting of SEQ ID NOs: 691 to 758.

In some embodiments, the immunogenic composition comprises nucleic acid sequences encoding one or more amino acid sequences derived from a TP53 protein mutation. In some embodiments, the immunogenic composition comprises nucleic acid sequences encoding two or more amino acid sequences selected from the group consisting of SEQ ID NOs: 691 to 758.

In another aspect, the invention provides for an immunogenic peptide composition comprising one or more peptides selected from the group consisting of SEQ ID NOs: 691 to 758.

In some embodiments, the immunogenic peptide composition comprises two or more peptides selected from the group consisting of SEQ ID NOs: 691 to 758. In some embodiments, the one or more peptides is a modified or unmodified fragment of a mutated TP53 protein.

In another aspect, the invention provides for an immunogenic composition comprising nucleic acid sequences encoding one or more amino acid sequences selected from the group consisting of SEQ ID NOs: 554 to 645.

In some embodiments, the immunogenic composition comprises nucleic acid sequences encoding one or more amino acid sequences derived from a RAS protein mutation. In some embodiments, the immunogenic composition comprises nucleic acid sequences encoding two or more amino acid sequences selected from the group consisting of SEQ ID NOs: 554 to 645.

In another aspect, the invention provides for an immunogenic peptide composition comprising one or more peptides selected from the group consisting of SEQ ID NOs: 554 to 645.

In some embodiments, the immunogenic peptide composition comprises two or more peptides selected from the group consisting of SEQ ID NOs: 554 to 645. In some embodiments, the one or more peptides is a modified or unmodified fragment of a mutated RAS protein.

In another aspect, the invention provides for an immunogenic composition comprising nucleic acid sequences encoding one or more amino acid sequences selected from the group consisting of SEQ ID NOs: 484 to 494.

In some embodiments, the immunogenic composition comprises nucleic acid sequences encoding one or more amino acid sequences derived from a BRAF V600E protein mutation. In some embodiments, the immunogenic composition comprises nucleic acid sequences encoding two or more amino acid sequences selected from the group consisting of SEQ ID NOs: 484 to 494.

In another aspect, the invention provides for an immunogenic peptide composition comprising one or more peptides selected from the group consisting of SEQ ID NOs: 484 to 494.

In some embodiments, the immunogenic peptide composition comprises two or more peptides selected from the group consisting of SEQ ID NOs: 484 to 494. In some embodiments, the immunogenic peptide composition comprises a peptide derived from a BRAF V600E protein mutation.

In another aspect, the invention provides for an immunogenic composition comprising nucleic acid sequences encoding one or more amino acid sequences selected from the group consisting of SEQ ID NOs: 495 to 502.

In some embodiments, the immunogenic composition comprises nucleic acid sequences encoding one or more amino acid sequences derived from a BRAF V600M protein mutation. In some embodiments, the immunogenic composition comprises nucleic acid sequences encoding two or more amino acid sequences selected from the group consisting of SEQ ID NOs: 495 to 502.

In another aspect, the invention provides for an immunogenic peptide composition comprising one or more peptides selected from the group consisting of SEQ ID NOs: 495 to 502.

In some embodiments, the immunogenic peptide composition comprises two or more peptides selected from the group consisting of SEQ ID NOs: 495 to 502. In some embodiments, the immunogenic peptide composition comprises a peptide derived from a BRAF V600M protein mutation.

In another aspect, the invention provides for an immunogenic composition comprising nucleic acid sequences encoding one or more amino acid sequences selected from the group consisting of SEQ ID NOs: 503 to 509.

In some embodiments, the immunogenic composition comprises nucleic acid sequences encoding one or more amino acid sequences derived from a EGFR A289V protein mutation. In some embodiments, the immunogenic composition comprises nucleic acid sequences encoding two or more amino acid sequences selected from the group consisting of SEQ ID NOs: 503 to 509.

In another aspect, the invention provides for an immunogenic peptide composition comprising one or more peptides selected from the group consisting of SEQ ID NOs: 503 to 509.

In some embodiments, the immunogenic peptide composition comprises two or more peptides selected from the group consisting of SEQ ID NOs: 503 to 509. In some embodiments, the immunogenic peptide composition comprises a peptide derived from a EGFR A289V protein mutation.

In another aspect, the invention provides for an immunogenic composition comprising nucleic acid sequences encoding one or more amino acid sequences selected from the group consisting of SEQ ID NOs: 510 to 519.

In some embodiments, the immunogenic composition comprises nucleic acid sequences encoding one or more amino acid sequences derived from a EGFR G598V protein mutation. In some embodiments, the immunogenic composition comprises nucleic acid sequences encoding two or more amino acid sequences selected from the group consisting of SEQ ID NOs: 510 to 519.

In another aspect, the invention provides for an immunogenic peptide composition comprising one or more peptides selected from the group consisting of SEQ ID NOs: 510 to 519.

In some embodiments, the immunogenic peptide composition comprises two or more peptides selected from the group consisting of SEQ ID NOs: 510 to 519. In some embodiments, the immunogenic peptide composition comprises a peptide derived from a EGFR G598V protein mutation.

In another aspect, the invention provides for an immunogenic composition comprising nucleic acid sequences encoding one or more amino acid sequences selected from the group consisting of SEQ ID NOs: 520 to 527.

In some embodiments, the immunogenic composition comprises nucleic acid sequences encoding one or more amino acid sequences derived from a EGFR L858R protein mutation. In some embodiments, the immunogenic composition comprises nucleic acid sequences encoding two or more amino acid sequences selected from the group consisting of SEQ ID NOs: 520 to 527.

In another aspect, the invention provides for an immunogenic peptide composition comprising one or more peptides selected from the group consisting of SEQ ID NOs: 520 to 527.

In some embodiments, the immunogenic peptide composition comprises two or more peptides selected from the group consisting of SEQ ID NOs: 520 to 527. In some embodiments, the immunogenic peptide composition comprises a peptide derived from a EGFR L858R protein mutation.

In another aspect, the invention provides for an immunogenic composition comprising nucleic acid sequences encoding one or more amino acid sequences selected from the group consisting of SEQ ID NOs: 543 to 553.

In some embodiments, the immunogenic composition comprises nucleic acid sequences encoding one or more amino acid sequences derived from a IDH1 R132H protein mutation. In some embodiments, the immunogenic composition comprises nucleic acid sequences encoding two or more amino acid sequences selected from the group consisting of SEQ ID NOs: 543 to 553.

In another aspect, the invention provides for an immunogenic peptide composition comprising one or more peptides selected from the group consisting of SEQ ID NOs: 543 to 553.

In some embodiments, the immunogenic peptide composition comprises two or more peptides selected from the group consisting of SEQ ID NOs: 543 to 553. In some embodiments, the immunogenic peptide composition comprises a peptide derived from a IDH1 R132H protein mutation.

In another aspect, the invention provides for an immunogenic composition comprising nucleic acid sequences encoding one or more amino acid sequences selected from the group consisting of SEQ ID NOs: 535 to 542.

In some embodiments, the immunogenic composition comprises nucleic acid sequences encoding one or more amino acid sequences derived from a IDH1 R132C protein mutation. In some embodiments, the immunogenic composition comprises nucleic acid sequences encoding two or more amino acid sequences selected from the group consisting of SEQ ID NOs: 535 to 542.

In another aspect, the invention provides for an immunogenic peptide composition comprising one or more peptides selected from the group consisting of SEQ ID NOs: 535 to 542.

In some embodiments, the immunogenic peptide composition comprises two or more peptides selected from the group consisting of SEQ ID NOs: 535 to 542. In some embodiments, the immunogenic peptide composition comprises a peptide derived from a IDH1 R132C protein mutation.

In another aspect, the invention provides for an immunogenic composition comprising nucleic acid sequences encoding one or more amino acid sequences selected from the group consisting of SEQ ID NOs: 569 to 577.

In some embodiments, the immunogenic composition comprises nucleic acid sequences encoding one or more amino acid sequences derived from a KRAS G12D protein mutation. In some embodiments, the immunogenic composition comprises nucleic acid sequences encoding two or more amino acid sequences selected from the group consisting of SEQ ID NOs: 569 to 577.

In another aspect, the invention provides for an immunogenic peptide composition comprising one or more peptides selected from the group consisting of SEQ ID NOs: 569 to 577.

In some embodiments, the immunogenic peptide composition comprises two or more peptides selected from the group consisting of SEQ ID NOs: 569 to 577. In some embodiments, the immunogenic peptide composition comprises a peptide derived from a KRAS G12D protein mutation.

In another aspect, the invention provides for an immunogenic composition comprising nucleic acid sequences encoding one or more amino acid sequences selected from the group consisting of SEQ ID NOs: 596 to 605.

In some embodiments, the immunogenic composition comprises nucleic acid sequences encoding one or more amino acid sequences derived from a KRAS G12V protein mutation. In some embodiments, the immunogenic composition comprises nucleic acid sequences encoding two or more amino acid sequences selected from the group consisting of SEQ ID NOs: 596 to 605.

In another aspect, the invention provides for an immunogenic peptide composition comprising one or more peptides selected from the group consisting of SEQ ID NOs: 596 to 605.

In some embodiments, the immunogenic peptide composition comprises two or more peptides selected from the group consisting of SEQ ID NOs: 596 to 605. In some embodiments, the immunogenic peptide composition comprises a peptide derived from a KRAS G12V protein mutation.

In another aspect, the invention provides for an immunogenic composition comprising nucleic acid sequences encoding one or more amino acid sequences selected from the group consisting of SEQ ID NOs: 578 to 587.

In some embodiments, the immunogenic composition comprises nucleic acid sequences encoding one or more amino acid sequences derived from a KRAS G12R protein mutation. In some embodiments, the immunogenic composition comprises nucleic acid sequences encoding two or more amino acid sequences selected from the group consisting of SEQ ID NOs: 578 to 587.

In another aspect, the invention provides for an immunogenic peptide composition comprising one or more peptides selected from the group consisting of SEQ ID NOs: 578 to 587.

In some embodiments, the immunogenic peptide composition comprises two or more peptides selected from the group consisting of SEQ ID NOs: 578 to 587. In some embodiments, the immunogenic peptide composition comprises a peptide derived from a KRAS G12R protein mutation.

In another aspect, the invention provides for an immunogenic composition comprising nucleic acid sequences encoding one or more amino acid sequences selected from the group consisting of SEQ ID NOs: 561 to 568.

In some embodiments, the immunogenic composition comprises nucleic acid sequences encoding one or more amino acid sequences derived from a KRAS G12C protein mutation. In some embodiments, the immunogenic composition comprises nucleic acid sequences encoding two or more amino acid sequences selected from the group consisting of SEQ ID NOs: 561 to 568.

In another aspect, the invention provides for an immunogenic peptide composition comprising one or more peptides selected from the group consisting of SEQ ID NOs: 561 to 568.

In some embodiments, the immunogenic peptide composition comprises two or more peptides selected from the group consisting of SEQ ID NOs: 561 to 568. In some embodiments, the immunogenic peptide composition comprises a peptide derived from a KRAS G12C protein mutation.

In another aspect, the invention provides for an immunogenic composition comprising nucleic acid sequences encoding one or more amino acid sequences selected from the group consisting of SEQ ID NOs: 606 to 615.

In some embodiments, the immunogenic composition comprises nucleic acid sequences encoding one or more amino acid sequences derived from a KRAS G13D protein mutation. In some embodiments, the immunogenic composition comprises nucleic acid sequences encoding two or more amino acid sequences selected from the group consisting of SEQ ID NOs: 606 to 615.

In another aspect, the invention provides for an immunogenic peptide composition comprising one or more peptides selected from the group consisting of SEQ ID NOs: 606 to 615.

In some embodiments, the immunogenic peptide composition comprises two or more peptides selected from the group consisting of SEQ ID NOs: 606 to 615. In some embodiments, the immunogenic peptide composition comprises a peptide derived from a KRAS G13D protein mutation.

In another aspect, the invention provides for an immunogenic composition comprising nucleic acid sequences encoding one or more amino acid sequences selected from the group consisting of SEQ ID NOs: 554 to 560.

In some embodiments, the immunogenic composition comprises nucleic acid sequences encoding one or more amino acid sequences derived from a KRAS G12A protein mutation. In some embodiments, the immunogenic composition comprises nucleic acid sequences encoding two or more amino acid sequences selected from the group consisting of SEQ ID NOs: 554 to 560.

In another aspect, the invention provides for an immunogenic peptide composition comprising one or more peptides selected from the group consisting of SEQ ID NOs: 554 to 560.

In some embodiments, the immunogenic peptide composition comprises two or more peptides selected from the group consisting of SEQ ID NOs: 554 to 560. In some embodiments, the immunogenic peptide composition comprises a peptide derived from a KRAS G12A protein mutation.

In another aspect, the invention provides for an immunogenic composition comprising nucleic acid sequences encoding one or more amino acid sequences selected from the group consisting of SEQ ID NOs: 588 to 595.

In some embodiments, the immunogenic composition comprises nucleic acid sequences encoding one or more amino acid sequences derived from a KRAS G12S protein mutation. In some embodiments, the immunogenic composition comprises nucleic acid sequences encoding two or more amino acid sequences selected from the group consisting of SEQ ID NOs: 588 to 595.

In another aspect, the invention provides for an immunogenic peptide composition comprising one or more peptides selected from the group consisting of SEQ ID NOs: 588 to 595.

In some embodiments, the immunogenic peptide composition comprises two or more peptides selected from the group consisting of SEQ ID NOs: 588 to 595. In some embodiments, the immunogenic peptide composition comprises a peptide derived from a KRAS G12S protein mutation.

In another aspect, the invention provides for an immunogenic composition comprising nucleic acid sequences encoding one or more amino acid sequences selected from the group consisting of SEQ ID NOs: 634 to 645.

In some embodiments, the immunogenic composition comprises nucleic acid sequences encoding one or more amino acid sequences derived from a NRAS Q61R protein mutation. In some embodiments, the immunogenic composition comprises nucleic acid sequences encoding two or more amino acid sequences selected from the group consisting of SEQ ID NOs: 634 to 645.

In another aspect, the invention provides for an immunogenic peptide composition comprising one or more peptides selected from the group consisting of SEQ ID NOs: 634 to 645.

In some embodiments, the immunogenic peptide composition comprises two or more peptides selected from the group consisting of SEQ ID NOs: 634 to 645. In some embodiments, the immunogenic peptide composition comprises a peptide derived from a NRAS Q61R protein mutation.

In another aspect, the invention provides for an immunogenic composition comprising nucleic acid sequences encoding one or more amino acid sequences selected from the group consisting of SEQ ID NOs: 616 to 624.

In some embodiments, the immunogenic composition comprises nucleic acid sequences encoding one or more amino acid sequences derived from a NRAS Q61K protein mutation. In some embodiments, the immunogenic composition comprises nucleic acid sequences encoding two or more amino acid sequences selected from the group consisting of SEQ ID NOs: 616 to 624.

In another aspect, the invention provides for an immunogenic peptide composition comprising one or more peptides selected from the group consisting of SEQ ID NOs: 616 to 624.

In some embodiments, the immunogenic peptide composition comprises two or more peptides selected from the group consisting of SEQ ID NOs: 616 to 624. In some embodiments, the immunogenic peptide composition comprises a peptide derived from a NRAS Q61K protein mutation.

In another aspect, the invention provides for an immunogenic composition comprising nucleic acid sequences encoding one or more amino acid sequences selected from the group consisting of SEQ ID NOs: 625 to 633.

In some embodiments, the immunogenic composition comprises nucleic acid sequences encoding one or more amino acid sequences derived from a NRAS Q61L protein mutation. In some embodiments, the immunogenic composition comprises nucleic acid sequences encoding two or more amino acid sequences selected from the group consisting of SEQ ID NOs: 625 to 633.

In another aspect, the invention provides for an immunogenic peptide composition comprising one or more peptides selected from the group consisting of SEQ ID NOs: 625 to 633.

In some embodiments, the immunogenic peptide composition comprises two or more peptides selected from the group consisting of SEQ ID NOs: 625 to 633. In some embodiments, the immunogenic peptide composition comprises a peptide derived from a NRAS Q61L protein mutation.

In another aspect, the invention provides for an immunogenic composition comprising nucleic acid sequences encoding one or more amino acid sequences selected from the group consisting of SEQ ID NOs: 646 to 650.

In some embodiments, the immunogenic composition comprises nucleic acid sequences encoding one or more amino acid sequences derived from a PIK3CA E542K protein mutation. In some embodiments, the immunogenic composition comprises nucleic acid sequences encoding two or more amino acid sequences selected from the group consisting of SEQ ID NOs: 646 to 650.

In another aspect, the invention provides for an immunogenic peptide composition comprising one or more peptides selected from the group consisting of SEQ ID NOs: 646 to 650.

In some embodiments, the immunogenic peptide composition comprises two or more peptides selected from the group consisting of SEQ ID NOs: 646 to 650. In some embodiments, the immunogenic peptide composition comprises a peptide derived from a PIK3CA E542K protein mutation.

In another aspect, the invention provides for an immunogenic composition comprising nucleic acid sequences encoding one or more amino acid sequences selected from the group consisting of SEQ ID NOs: 651 to 657.

In some embodiments, the immunogenic composition comprises nucleic acid sequences encoding one or more amino acid sequences derived from a PIK3CA E545K protein mutation. In some embodiments, the immunogenic composition comprises nucleic acid sequences encoding two or more amino acid sequences selected from the group consisting of SEQ ID NOs: 651 to 657.

In another aspect, the invention provides for an immunogenic peptide composition comprising one or more peptides selected from the group consisting of SEQ ID NOs: 651 to 657.

In some embodiments, the immunogenic peptide composition comprises two or more peptides selected from the group consisting of SEQ ID NOs: 651 to 657. In some embodiments, the immunogenic peptide composition comprises a peptide derived from a PIK3CA E545K protein mutation.

In another aspect, the invention provides for an immunogenic composition comprising nucleic acid sequences encoding one or more amino acid sequences selected from the group consisting of SEQ ID NOs: 658 to 667.

In some embodiments, the immunogenic composition comprises nucleic acid sequences encoding one or more amino acid sequences derived from a PIK3CA H1047R protein mutation. In some embodiments, the immunogenic composition comprises nucleic acid sequences encoding two or more amino acid sequences selected from the group consisting of SEQ ID NOs: 658 to 667.

In another aspect, the invention provides for an immunogenic peptide composition comprising one or more peptides selected from the group consisting of SEQ ID NOs: 658 to 667.

In some embodiments, the immunogenic peptide composition comprises two or more peptides selected from the group consisting of SEQ ID NOs: 658 to 667. In some embodiments, the immunogenic peptide composition comprises a peptide derived from a PIK3CA H1047R protein mutation.

In another aspect, the invention provides for an immunogenic composition comprising nucleic acid sequences encoding one or more amino acid sequences selected from the group consisting of SEQ ID NOs: 700 to 707.

In some embodiments, the immunogenic composition comprises nucleic acid sequences encoding one or more amino acid sequences derived from a TP53 R158L protein mutation. In some embodiments, the immunogenic composition comprises nucleic acid sequences encoding two or more amino acid sequences selected from the group consisting of SEQ ID NOs: 700 to 707.

In another aspect, the invention provides for an immunogenic peptide composition comprising one or more peptides selected from the group consisting of SEQ ID NOs: 700 to 707.

In some embodiments, the immunogenic peptide composition comprises two or more peptides selected from the group consisting of SEQ ID NOs: 700 to 707. In some embodiments, the immunogenic peptide composition comprises a peptide derived from a TP53 R158L protein mutation.

In another aspect, the invention provides for an immunogenic composition comprising nucleic acid sequences encoding one or more amino acid sequences selected from the group consisting of SEQ ID NOs: 708 to 717.

In some embodiments, the immunogenic composition comprises nucleic acid sequences encoding one or more amino acid sequences derived from a TP53 R175H protein mutation. In some embodiments, the immunogenic composition comprises nucleic acid sequences encoding two or more amino acid sequences selected from the group consisting of SEQ ID NOs: 708 to 717.

In another aspect, the invention provides for an immunogenic peptide composition comprising one or more peptides selected from the group consisting of SEQ ID NOs: 708 to 717.

In some embodiments, the immunogenic peptide composition comprises two or more peptides selected from the group consisting of SEQ ID NOs: 708 to 717. In some embodiments, the immunogenic peptide composition comprises a peptide derived from a TP53 R175H protein mutation.

In another aspect, the invention provides for an immunogenic composition comprising nucleic acid sequences encoding one or more amino acid sequences selected from the group consisting of SEQ ID NOs: 718 to 723.

In some embodiments, the immunogenic composition comprises nucleic acid sequences encoding one or more amino acid sequences derived from a TP53 R248Q protein mutation. In some embodiments, the immunogenic composition comprises nucleic acid sequences encoding two or more amino acid sequences selected from the group consisting of SEQ ID NOs: 718 to 723.

In another aspect, the invention provides for an immunogenic peptide composition comprising one or more peptides selected from the group consisting of SEQ ID NOs: 718 to 723.

In some embodiments, the immunogenic peptide composition comprises two or more peptides selected from the group consisting of SEQ ID NOs: 718 to 723. In some embodiments, the immunogenic peptide composition comprises a peptide derived from a TP53 R248Q protein mutation.

In another aspect, the invention provides for an immunogenic composition comprising nucleic acid sequences encoding one or more amino acid sequences selected from the group consisting of SEQ ID NOs: 733 to 739.

In some embodiments, the immunogenic composition comprises nucleic acid sequences encoding one or more amino acid sequences derived from a TP53 R273C protein mutation. In some embodiments, the immunogenic composition comprises nucleic acid sequences encoding two or more amino acid sequences selected from the group consisting of SEQ ID NOs: 733 to 739.

In another aspect, the invention provides for an immunogenic peptide composition comprising one or more peptides selected from the group consisting of SEQ ID NOs: 733 to 739.

In some embodiments, the immunogenic peptide composition comprises two or more peptides selected from the group consisting of SEQ ID NOs: 733 to 739. In some embodiments, the immunogenic peptide composition comprises a peptide derived from a TP53 R273C protein mutation.

In another aspect, the invention provides for an immunogenic composition comprising nucleic acid sequences encoding one or more amino acid sequences selected from the group consisting of SEQ ID NOs: 740 to 748.

In some embodiments, the immunogenic composition comprises nucleic acid sequences encoding one or more amino acid sequences derived from a TP53 R273H protein mutation. In some embodiments, the immunogenic composition comprises nucleic acid sequences encoding two or more amino acid sequences selected from the group consisting of SEQ ID NOs: 740 to 748.

In another aspect, the invention provides for an immunogenic peptide composition comprising one or more peptides selected from the group consisting of SEQ ID NOs: 740 to 748.

In some embodiments, the immunogenic peptide composition comprises two or more peptides selected from the group consisting of SEQ ID NOs: 740 to 748. In some embodiments, the immunogenic peptide composition comprises a peptide derived from a TP53 R273H protein mutation.

In another aspect, the invention provides for an immunogenic composition comprising nucleic acid sequences encoding one or more amino acid sequences selected from the group consisting of SEQ ID NOs: 724 to 732.

In some embodiments, the immunogenic composition comprises nucleic acid sequences encoding one or more amino acid sequences derived from a TP53 R248W protein mutation. In some embodiments, the immunogenic composition comprises nucleic acid sequences encoding two or more amino acid sequences selected from the group consisting of SEQ ID NOs: 724 to 732.

In another aspect, the invention provides for an immunogenic peptide composition comprising one or more peptides selected from the group consisting of SEQ ID NOs: 724 to 732.

In some embodiments, the immunogenic peptide composition comprises two or more peptides selected from the group consisting of SEQ ID NOs: 724 to 732. In some embodiments, the immunogenic peptide composition comprises a peptide derived from a TP53 R248W protein mutation.

In another aspect, the invention provides for an immunogenic composition comprising nucleic acid sequences encoding one or more amino acid sequences selected from the group consisting of SEQ ID NOs: 749 to 750.

In some embodiments, the immunogenic composition comprises nucleic acid sequences encoding one or more amino acid sequences derived from a TP53 R282W protein mutation. In some embodiments, the immunogenic composition comprises nucleic acid sequences encoding two or more amino acid sequences selected from the group consisting of SEQ ID NOs: 749 to 750.

In another aspect, the invention provides for an immunogenic peptide composition comprising one or more peptides selected from the group consisting of SEQ ID NOs: 749 to 750.

In some embodiments, the immunogenic peptide composition comprises two or more peptides selected from the group consisting of SEQ ID NOs: 749 to 750. In some embodiments, the immunogenic peptide composition comprises a peptide derived from a TP53 R282W protein mutation.

In another aspect, the invention provides for an immunogenic composition comprising nucleic acid sequences encoding one or more amino acid sequences selected from the group consisting of SEQ ID NOs: 751 to 758.

In some embodiments, the immunogenic composition comprises nucleic acid sequences encoding one or more amino acid sequences derived from a TP53 Y220C protein mutation. In some embodiments, the immunogenic composition comprises nucleic acid sequences encoding two or more amino acid sequences selected from the group consisting of SEQ ID NOs: 751 to 758.

In another aspect, the invention provides for an immunogenic peptide composition comprising one or more peptides selected from the group consisting of SEQ ID NOs: 751 to 758.

In some embodiments, the immunogenic peptide composition comprises two or more peptides selected from the group consisting of SEQ ID NOs: 751 to 758. In some embodiments, the immunogenic peptide composition comprises a peptide derived from a TP53 Y220C protein mutation.

In another aspect, the invention provides for an immunogenic composition comprising nucleic acid sequences encoding one or more amino acid sequences selected from the group consisting of SEQ ID NOs: 668 to 675.

In some embodiments, the immunogenic composition comprises nucleic acid sequences encoding one or more amino acid sequences derived from a PIK3CA R88Q protein mutation. In some embodiments, the immunogenic composition comprises nucleic acid sequences encoding two or more amino acid sequences selected from the group consisting of SEQ ID NOs: 668 to 675.

In another aspect, the invention provides for an immunogenic peptide composition comprising one or more peptides selected from the group consisting of SEQ ID NOs: 668 to 675.

In some embodiments, the immunogenic peptide composition comprises two or more peptides selected from the group consisting of SEQ ID NOs: 668 to 675. In some embodiments, the immunogenic peptide composition comprises a peptide derived from a PIK3CA R88Q protein mutation.

In another aspect, the invention provides for an immunogenic composition comprising nucleic acid sequences encoding one or more amino acid sequences selected from the group consisting of SEQ ID NOs: 528 to 534.

In some embodiments, the immunogenic composition comprises nucleic acid sequences encoding one or more amino acid sequences derived from a GTF2I L424H protein mutation. In some embodiments, the immunogenic composition comprises nucleic acid sequences encoding two or more amino acid sequences selected from the group consisting of SEQ ID NOs: 528 to 534.

In another aspect, the invention provides for an immunogenic peptide composition comprising one or more peptides selected from the group consisting of SEQ ID NOs: 528 to 534.

In some embodiments, the immunogenic peptide composition comprises two or more peptides selected from the group consisting of SEQ ID NOs: 528 to 534. In some embodiments, the immunogenic peptide composition comprises a peptide derived from a GTF2I L424H protein mutation.

In another aspect, the invention provides for an immunogenic composition comprising nucleic acid sequences encoding one or more amino acid sequences selected from the group consisting of SEQ ID NOs: 681 to 690.

In some embodiments, the immunogenic composition comprises nucleic acid sequences encoding one or more amino acid sequences derived from a PTEN R130Q protein mutation. In some embodiments, the immunogenic composition comprises nucleic acid sequences encoding two or more amino acid sequences selected from the group consisting of SEQ ID NOs: 681 to 690.

In another aspect, the invention provides for an immunogenic peptide composition comprising one or more peptides selected from the group consisting of SEQ ID NOs: 681 to 690.

In some embodiments, the immunogenic peptide composition comprises two or more peptides selected from the group consisting of SEQ ID NOs: 681 to 690. In some embodiments, the immunogenic peptide composition comprises a peptide derived from a PTEN R130Q protein mutation.

In another aspect, the invention provides for an immunogenic composition comprising nucleic acid sequences encoding one or more amino acid sequences selected from the group consisting of SEQ ID NOs: 475 to 483.

In some embodiments, the immunogenic composition comprises nucleic acid sequences encoding one or more amino acid sequences derived from a AKT1 E17K protein mutation. In some embodiments, the immunogenic composition comprises nucleic acid sequences encoding two or more amino acid sequences selected from the group consisting of SEQ ID NOs: 475 to 483.

In another aspect, the invention provides for an immunogenic peptide composition comprising one or more peptides selected from the group consisting of SEQ ID NOs: 475 to 483.

In some embodiments, the immunogenic peptide composition comprises two or more peptides selected from the group consisting of SEQ ID NOs: 475 to 483. In some embodiments, the immunogenic peptide composition comprises a peptide derived from a AKT1 E17K protein mutation.

In another aspect, the invention provides for an immunogenic composition comprising nucleic acid sequences encoding one or more amino acid sequences selected from the group consisting of SEQ ID NOs: 676 to 680.

In some embodiments, the immunogenic composition comprises nucleic acid sequences encoding one or more amino acid sequences derived from a PTEN R130G protein mutation. In some embodiments, the immunogenic composition comprises nucleic acid sequences encoding two or more amino acid sequences selected from the group consisting of SEQ ID NOs: 676 to 680.

In another aspect, the invention provides for an immunogenic peptide composition comprising one or more peptides selected from the group consisting of SEQ ID NOs: 676 to 680.

In some embodiments, the immunogenic peptide composition comprises two or more peptides selected from the group consisting of SEQ ID NOs: 676 to 680. In some embodiments, the immunogenic peptide composition comprises a peptide derived from a PTEN R130G protein mutation.

In another aspect, the invention provides for an immunogenic composition comprising nucleic acid sequences encoding one or more amino acid sequences selected from the group consisting of SEQ ID NOs: 691 to 699.

In some embodiments, the immunogenic composition comprises nucleic acid sequences encoding one or more amino acid sequences derived from a TP53 H179R protein mutation. In some embodiments, the immunogenic composition comprises nucleic acid sequences encoding two or more amino acid sequences selected from the group consisting of SEQ ID NOs: 691 to 699.

In another aspect, the invention provides for an immunogenic peptide composition comprising one or more peptides selected from the group consisting of SEQ ID NOs: 691 to 699.

In some embodiments, the immunogenic peptide composition comprises two or more peptides selected from the group consisting of SEQ ID NOs: 691 to 699. In some embodiments, the immunogenic peptide composition comprises a peptide derived from a TP53 H179R protein mutation.

In another aspect, the invention provides for an immunogenic composition comprising nucleic acid sequences encoding one or more amino acid sequences selected from the group consisting of SEQ ID NOs: 569 to 574, SEQ ID NOs: 578 to 584, SEQ ID NOs: 596 to 599, and SEQ ID NOs: 601 to 603.

In some embodiments, the immunogenic composition comprises nucleic acid sequences encoding two or more amino acid sequences selected from the group consisting of SEQ ID NOs: 569 to 574, SEQ ID NOs: 578 to 584, SEQ ID NOs: 596 to 599, and SEQ ID NOs: 601 to 603. In some embodiments, the nucleic acid sequences are administered in a construct for expression in vivo. In some embodiments, the in vivo administration of the nucleic acid sequences is configured to produce one or more peptides that is displayed by an HLA class II molecule. In some embodiments, the one or more peptides is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, the one or more peptides is a modified or unmodified fragment of a protein with a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the nucleic acid sequences are administered in an effective amount to a subject to prevent cancer. In some embodiments, the nucleic acid sequences are administered in an effective amount to a subject to treat cancer. In some embodiments, the cancer is pancreatic cancer.

In another aspect, the invention provides for a method of treating or preventing pancreatic cancer by administering to a subject an immunogenic composition comprising nucleic acid sequences encoding one or more amino acid sequences selected from the group consisting of SEQ ID NOs: 569 to 574, SEQ ID NOs: 578 to 584, SEQ ID NOs: 596 to 599, and SEQ ID NOs: 601 to 603.

In some embodiments, the immunogenic composition comprises nucleic acid sequences encoding two or more amino acid sequences selected from the group consisting of SEQ ID NOs: 569 to 574, SEQ ID NOs: 578 to 584, SEQ ID NOs: 596 to 599, and SEQ ID NOs: 601 to 603.

In another aspect, the invention provides for an immunogenic peptide composition comprising one or more peptides selected from the group consisting of SEQ ID NOs: 569 to 574, SEQ ID NOs: 578 to 584, SEQ ID NOs: 596 to 599, and SEQ ID NOs: 601 to 603.

In some embodiments, the immunogenic peptide composition comprises two or more peptides selected from the group consisting of SEQ ID NOs: 569 to 574, SEQ ID NOs: 578 to 584, SEQ ID NOs: 596 to 599, and SEQ ID NOs: 601 to 603. In some embodiments, a peptide in the immunogenic peptide composition is displayed by an HLA class II molecule. In some embodiments, a peptide in the immunogenic peptide composition is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, a peptide in the immunogenic peptide composition is a modified or unmodified fragment of a protein, wherein the protein comprises a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the immunogenic peptide composition is administered in an effective amount to a subject to prevent cancer. In some embodiments, the immunogenic peptide composition is administered in an effective amount to a subject to treat cancer. In some embodiments, the cancer is pancreatic cancer.

In another aspect, the invention provides for a method of treating or preventing pancreatic cancer in a subject comprising administering to the subject an immunogenic peptide composition comprising one or more peptides selected from the group consisting of SEQ ID NOs: 569 to 574, SEQ ID NOs: 578 to 584, SEQ ID NOs: 596 to 599, and SEQ ID NOs: 601 to 603.

In some embodiments, the immunogenic peptide composition comprises two or more peptides selected from the group consisting of SEQ ID NOs: 569 to 574, SEQ ID NOs: 578 to 584, SEQ ID NOs: 596 to 599, and SEQ ID NOs: 601 to 603.

In another aspect, the invention provides for an immunogenic composition comprising nucleic acid sequences encoding one or more amino acid sequences selected from the group consisting of SEQ ID NOs: 484 to 485, SEQ ID NOs: 488 to 489, SEQ ID NOs: 495 to 499, SEQ ID NO: 616, SEQ ID NOs: 619 to 620, SEQ ID NOs: 625 to 628, SEQ ID NO: 634, SEQ ID NO: 637, and SEQ ID NOs: 639 to 640.

In some embodiments, the immunogenic composition comprises nucleic acid sequences encoding two or more amino acid sequences selected from the group consisting of SEQ ID NOs: 484 to 485, SEQ ID NOs: 488 to 489, SEQ ID NOs: 495 to 499, SEQ ID NO: 616, SEQ ID NOs: 619 to 620, SEQ ID NOs: 625 to 628, SEQ ID NO: 634, SEQ ID NO: 637, and SEQ ID NOs: 639 to 640. In some embodiments, the nucleic acid sequences are administered in a construct for expression in vivo. In some embodiments, the in vivo administration of the nucleic acid sequences is configured to produce one or more peptides that is displayed by an HLA class II molecule. In some embodiments, the one or more peptides is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, the one or more peptides is a modified or unmodified fragment of a protein with a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the nucleic acid sequences are administered in an effective amount to a subject to prevent cancer. In some embodiments, the nucleic acid sequences are administered in an effective amount to a subject to treat cancer. In some embodiments, the cancer is skin cancer.

In another aspect, the invention provides for a method of treating or preventing skin cancer by administering to a subject an immunogenic composition comprising nucleic acid sequences encoding one or more amino acid sequences selected from the group consisting of SEQ ID NOs: 484 to 485, SEQ ID NOs: 488 to 489, SEQ ID NOs: 495 to 499, SEQ ID NO: 616, SEQ ID NOs: 619 to 620, SEQ ID NOs: 625 to 628, SEQ ID NO: 634, SEQ ID NO: 637, and SEQ ID NOs: 639 to 640.

In some embodiments, the immunogenic composition comprises nucleic acid sequences encoding two or more amino acid sequences selected from the group consisting of SEQ ID NOs: 484 to 485, SEQ ID NOs: 488 to 489, SEQ ID NOs: 495 to 499, SEQ ID NO: 616, SEQ ID NOs: 619 to 620, SEQ ID NOs: 625 to 628, SEQ ID NO: 634, SEQ ID NO: 637, and SEQ ID NOs: 639 to 640.

In another aspect, the invention provides for an immunogenic peptide composition comprising one or more peptides selected from the group consisting of SEQ ID NOs: 484 to 485, SEQ ID NOs: 488 to 489, SEQ ID NOs: 495 to 499, SEQ ID NO: 616, SEQ ID NOs: 619 to 620, SEQ ID NOs: 625 to 628, SEQ ID NO: 634, SEQ ID NO: 637, and SEQ ID NOs:
639 to 640.

In some embodiments, the immunogenic peptide composition comprises two or more peptides selected from the group consisting of SEQ ID NOs: 484 to 485, SEQ ID NOs: 488 to 489, SEQ ID NOs: 495 to 499, SEQ ID NO: 616, SEQ ID NOs: 619 to 620, SEQ ID NOs: 625 to 628, SEQ ID NO: 634, SEQ ID NO: 637, and SEQ ID NOs: 639 to 640. In some embodiments, a peptide in the immunogenic peptide composition is displayed by an HLA class II molecule. In some embodiments, a peptide in the immunogenic peptide composition is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, a peptide in the immunogenic peptide composition is a modified or unmodified fragment of a protein, wherein the protein comprises a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the immunogenic peptide composition is administered in an effective amount to a subject to prevent cancer. In some embodiments, the immunogenic peptide composition is administered in an effective amount to a subject to treat cancer. In some embodiments, the cancer is skin cancer.

In another aspect, the invention provides for a method of treating or preventing skin cancer in a subject comprising administering to the subject an immunogenic peptide composition comprising one or more peptides selected from the group consisting of SEQ ID NOs: 484 to 485, SEQ ID NOs: 488 to 489, SEQ ID NOs: 495 to 499, SEQ ID NO: 616, SEQ ID NOs: 619 to 620, SEQ ID NOs: 625 to 628, SEQ ID NO: 634, SEQ ID NO: 637, and SEQ ID NOs: 639 to 640.

In some embodiments, the immunogenic peptide composition comprises two or more peptides selected from the group consisting of SEQ ID NOs: 484 to 485, SEQ ID NOs: 488 to 489, SEQ ID NOs: 495 to 499, SEQ ID NO: 616, SEQ ID NOs: 619 to 620, SEQ ID NOs: 625 to 628, SEQ ID NO: 634, SEQ ID NO: 637, and SEQ ID NOs: 639 to 640.

In another aspect, the invention provides for an immunogenic composition comprising nucleic acid sequences encoding one or more amino acid sequences selected from the group consisting of SEQ ID NOs: 484 to 485, SEQ ID NOs: 488 to 489, SEQ ID NO: 616, SEQ ID NOs: 619 to 620, SEQ ID NO: 634, SEQ ID NO: 637, and SEQ ID NO: 640.

In some embodiments, the immunogenic composition comprises nucleic acid sequences encoding two or more amino acid sequences selected from the group consisting of SEQ ID NOs: 484 to 485, SEQ ID NOs: 488 to 489, SEQ ID NO: 616, SEQ ID NOs: 619 to 620, SEQ ID NO: 634, SEQ ID NO: 637, and SEQ ID NO: 640. In some embodiments, the nucleic acid sequences are administered in a construct for expression in vivo. In some embodiments, the in vivo administration of the nucleic acid sequences is configured to produce one or more peptides that is displayed by an HLA class II molecule. In some embodiments, the one or more peptides is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, the one or more peptides is a modified or unmodified fragment of a protein with a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the nucleic acid sequences are administered in an effective amount to a subject to prevent cancer. In some embodiments, the nucleic acid sequences are administered in an effective amount to a subject to treat cancer. In some embodiments, the cancer is thyroid cancer.

In another aspect, the invention provides for a method of treating or preventing thyroid cancer by administering to a subject an immunogenic composition comprising nucleic acid sequences encoding one or more amino acid sequences selected from the group consisting of SEQ ID NOs: 484 to 485, SEQ ID NOs: 488 to 489, SEQ ID NO: 616, SEQ ID NOs: 619 to 620, SEQ ID NO: 634, SEQ ID NO: 637, and SEQ ID NO: 640.

In some embodiments, the immunogenic composition comprises nucleic acid sequences encoding two or more amino acid sequences selected from the group consisting of SEQ ID NOs: 484 to 485, SEQ ID NOs: 488 to 489, SEQ ID NO: 616, SEQ ID NOs: 619 to 620, SEQ ID NO: 634, SEQ ID NO: 637, and SEQ ID NO: 640.

In another aspect, the invention provides for an immunogenic peptide composition comprising one or more peptides selected from the group consisting of SEQ ID NOs: 484 to 485, SEQ ID NOs: 488 to 489, SEQ ID NO: 616, SEQ ID NOs: 619 to 620, SEQ ID NO: 634, SEQ ID NO: 637, and SEQ ID NO: 640.

In some embodiments, the immunogenic peptide composition comprises two or more peptides selected from the group consisting of SEQ ID NOs: 484 to 485, SEQ ID NOs: 488 to 489, SEQ ID NO: 616, SEQ ID NOs: 619 to 620, SEQ ID NO: 634, SEQ ID NO: 637, and SEQ ID NO: 640. In some embodiments, a peptide in the immunogenic peptide composition is displayed by an HLA class II molecule. In some embodiments, a peptide in the immunogenic peptide composition is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, a peptide in the immunogenic peptide composition is a modified or unmodified fragment of a protein, wherein the protein comprises a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the immunogenic peptide composition is administered in an effective amount to a subject to prevent cancer. In some embodiments, the immunogenic peptide composition is administered in an effective amount to a subject to treat cancer. In some embodiments, the cancer is thyroid cancer.

In another aspect, the invention provides for a method of treating or preventing thyroid cancer in a subject comprising administering to the subject an immunogenic peptide composition comprising one or more peptides selected from the group consisting of SEQ ID NOs: 484 to 485, SEQ ID NOs: 488 to 489, SEQ ID NO: 616, SEQ ID NOs: 619 to 620, SEQ ID NO: 634, SEQ ID NO: 637, and SEQ ID NO: 640.

In some embodiments, the immunogenic peptide composition comprises two or more peptides selected from the group consisting of SEQ ID NOs: 484 to 485, SEQ ID NOs: 488 to 489, SEQ ID NO: 616, SEQ ID NOs: 619 to 620, SEQ ID NO: 634, SEQ ID NO: 637, and SEQ ID NO: 640.

In another aspect, the invention provides for an immunogenic composition comprising nucleic acid sequences encoding one or more amino acid sequences selected from the group consisting of SEQ ID NO: 508, SEQ ID NO: 510, SEQ ID NO: 512, SEQ ID NO: 514, SEQ ID NOs: 535 to 537, SEQ ID NO: 539, SEQ ID NOs: 543 to 551, SEQ ID NO: 708, SEQ ID NO: 712, and SEQ ID NO: 738.

In some embodiments, the immunogenic composition comprises nucleic acid sequences encoding two or more amino acid sequences selected from the group consisting of SEQ ID NO: 508, SEQ ID NO: 510, SEQ ID NO: 512, SEQ ID NO: 514, SEQ ID NOs: 535 to 537, SEQ ID NO: 539, SEQ ID NOs: 543 to 551, SEQ ID NO: 708, SEQ ID NO: 712, and SEQ ID NO: 738. In some embodiments, the nucleic acid sequences are administered in a construct for expression in vivo. In some embodiments, the in vivo administration of the nucleic acid sequences is configured to produce one or more peptides that is displayed by an HLA class II molecule. In some embodiments, the one or more peptides is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, the one or more peptides is a modified or unmodified fragment of a protein with a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the nucleic acid sequences are administered in an effective amount to a subject to prevent cancer. In some embodiments, the nucleic acid sequences are administered in an effective amount to a subject to treat cancer. In some embodiments, the cancer is brain cancer.

In another aspect, the invention provides for a method of treating or preventing brain cancer by administering to a subject an immunogenic composition comprising nucleic acid sequences encoding one or more amino acid sequences selected from the group consisting of SEQ ID NO: 508, SEQ ID NO: 510, SEQ ID NO: 512, SEQ ID NO: 514, SEQ ID NOs: 535 to 537, SEQ ID NO: 539, SEQ ID NOs: 543 to 551, SEQ ID NO: 708, SEQ ID NO: 712, and SEQ ID NO: 738.

In some embodiments, the immunogenic composition comprises nucleic acid sequences encoding two or more amino acid sequences selected from the group consisting of SEQ ID NO: 508, SEQ ID NO: 510, SEQ ID NO: 512, SEQ ID NO: 514, SEQ ID NOs: 535 to 537, SEQ ID NO: 539, SEQ ID NOs: 543 to 551, SEQ ID NO: 708, SEQ ID NO: 712, and SEQ ID NO: 738.

In another aspect, the invention provides for an immunogenic peptide composition comprising one or more peptides selected from the group consisting of SEQ ID NO: 508, SEQ ID NO: 510, SEQ ID NO: 512, SEQ ID NO: 514, SEQ ID NOs: 535 to 537, SEQ ID NO: 539, SEQ ID NOs: 543 to 551, SEQ ID NO: 708, SEQ ID NO: 712, and SEQ ID NO: 738.

In some embodiments, the immunogenic peptide composition comprises two or more peptides selected from the group consisting of SEQ ID NO: 508, SEQ ID NO: 510, SEQ ID NO: 512, SEQ ID NO: 514, SEQ ID NOs: 535 to 537, SEQ ID NO: 539, SEQ ID NOs: 543 to 551, SEQ ID NO: 708, SEQ ID NO: 712, and SEQ ID NO: 738. In some embodiments, a peptide in the immunogenic peptide composition is displayed by an HLA class II molecule. In some embodiments, a peptide in the immunogenic peptide composition is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, a peptide in the immunogenic peptide composition is a modified or unmodified fragment of a protein, wherein the protein comprises a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the immunogenic peptide composition is administered in an effective amount to a subject to prevent cancer. In some embodiments, the immunogenic peptide composition is administered in an effective amount to a subject to treat cancer. In some embodiments, the cancer is brain cancer.

In another aspect, the invention provides for a method of treating or preventing brain cancer in a subject comprising administering to the subject an immunogenic peptide composition comprising one or more peptides selected from the group consisting of SEQ ID NO: 508, SEQ ID NO: 510, SEQ ID NO: 512, SEQ ID NO: 514, SEQ ID NOs: 535 to 537, SEQ ID NO: 539, SEQ ID NOs: 543 to 551, SEQ ID NO: 708, SEQ ID NO: 712, and SEQ ID NO: 738.

In some embodiments, the immunogenic peptide composition comprises two or more peptides selected from the group consisting of SEQ ID NO: 508, SEQ ID NO: 510, SEQ ID NO: 512, SEQ ID NO: 514, SEQ ID NOs: 535 to 537, SEQ ID NO: 539, SEQ ID NOs: 543 to 551, SEQ ID NO: 708, SEQ ID NO: 712, and SEQ ID NO: 738.

In another aspect, the invention provides for an immunogenic composition comprising nucleic acid sequences encoding one or more amino acid sequences selected from the group consisting of SEQ ID NOs: 484 to 485, SEQ ID NOs: 488 to 489, SEQ ID NOs: 569 to 575, SEQ ID NOs: 596 to 599, SEQ ID NOs: 601 to 604, SEQ ID NOs: 606 to 612, SEQ ID NO: 656, SEQ ID NO: 708, and SEQ ID NO: 712.

In some embodiments, the immunogenic composition comprises nucleic acid sequences encoding two or more amino acid sequences selected from the group consisting of SEQ ID NOs: 484 to 485, SEQ ID NOs: 488 to 489, SEQ ID NOs: 569 to 575, SEQ ID NOs: 596 to 599, SEQ ID NOs: 601 to 604, SEQ ID NOs: 606 to 612, SEQ ID NO: 656, SEQ ID NO: 708, and SEQ ID NO: 712. In some embodiments, the nucleic acid sequences are administered in a construct for expression in vivo. In some embodiments, the in vivo administration of the nucleic acid sequences is configured to produce one or more peptides that is displayed by an HLA class II molecule. In some embodiments, the one or more peptides is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, the one or more peptides is a modified or unmodified fragment of a protein with a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the nucleic acid sequences are administered in an effective amount to a subject to prevent cancer. In some embodiments, the nucleic acid sequences are administered in an effective amount to a subject to treat cancer. In some embodiments, the cancer is colorectal cancer.

In another aspect, the invention provides for a method of treating or preventing colorectal cancer by administering to a subject an immunogenic composition comprising nucleic acid sequences encoding one or more amino acid sequences selected from the group consisting of SEQ ID NOs: 484 to 485, SEQ ID NOs: 488 to 489, SEQ ID NOs: 569 to 575, SEQ ID NOs: 596 to 599, SEQ ID NOs: 601 to 604, SEQ ID NOs: 606 to 612, SEQ ID NO: 656, SEQ ID NO: 708, and SEQ ID NO: 712.

In some embodiments, the immunogenic composition comprises nucleic acid sequences encoding two or more amino acid sequences selected from the group consisting of SEQ ID NOs: 484 to 485, SEQ ID NOs: 488 to 489, SEQ ID NOs: 569 to 575, SEQ ID NOs: 596 to 599, SEQ ID NOs: 601 to 604, SEQ ID NOs: 606 to 612, SEQ ID NO: 656, SEQ ID NO: 708, and SEQ ID NO: 712.

In another aspect, the invention provides for an immunogenic peptide composition comprising one or more peptides selected from the group consisting of SEQ ID NOs: 484 to 485, SEQ ID NOs: 488 to 489, SEQ ID NOs: 569 to 575, SEQ ID NOs: 596 to 599, SEQ ID NOs: 601 to 604, SEQ ID NOs: 606 to 612, SEQ ID NO: 656, SEQ ID NO: 708, and SEQ ID NO: 712.

In some embodiments, the immunogenic peptide composition comprises two or more peptides selected from the group consisting of SEQ ID NOs: 484 to 485, SEQ ID NOs: 488 to 489, SEQ ID NOs: 569 to 575, SEQ ID NOs: 596 to 599, SEQ ID NOs: 601 to 604, SEQ ID NOs: 606 to 612, SEQ ID NO: 656, SEQ ID NO: 708, and SEQ ID NO: 712. In some embodiments, a peptide in the immunogenic peptide composition is displayed by an HLA class II molecule. In some embodiments, a peptide in the immunogenic peptide composition is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, a peptide in the immunogenic peptide composition is a modified or unmodified fragment of a protein, wherein the protein comprises a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the immunogenic peptide composition is administered in an effective amount to a subject to prevent cancer. In some embodiments, the immunogenic peptide composition is administered in an effective amount to a subject to treat cancer. In some embodiments, the cancer is colorectal cancer.

In another aspect, the invention provides for a method of treating or preventing colorectal cancer in a subject comprising administering to the subject an immunogenic peptide composition comprising one or more peptides selected from the group consisting of SEQ ID NOs: 484 to 485, SEQ ID NOs: 488 to 489, SEQ ID NOs: 569 to 575, SEQ ID NOs: 596 to 599, SEQ ID NOs: 601 to 604, SEQ ID NOs: 606 to 612, SEQ ID NO: 656, SEQ ID NO: 708, and SEQ ID NO: 712.

In some embodiments, the immunogenic peptide composition comprises two or more peptides selected from the group consisting of SEQ ID NOs: 484 to 485, SEQ ID NOs: 488 to 489, SEQ ID NOs: 569 to 575, SEQ ID NOs: 596 to 599, SEQ ID NOs: 601 to 604, SEQ ID NOs: 606 to 612, SEQ ID NO: 656, SEQ ID NO: 708, and SEQ ID NO: 712.

In another aspect, the invention provides for an immunogenic composition comprising nucleic acid sequences encoding one or more amino acid sequences selected from the group consisting of SEQ ID NOs: 520 to 521, SEQ ID NOs: 523 to 524, SEQ ID NOs: 554 to 556, SEQ ID NO: 558, SEQ ID NO: 561, SEQ ID NOs: 563 to 565, SEQ ID NOs: 569 to 573, SEQ ID NOs: 596 to 600, SEQ ID NO: 650, SEQ ID NO: 656, and SEQ ID NOs: 700 to 705.

In some embodiments, the immunogenic composition comprises nucleic acid sequences encoding two or more amino acid sequences selected from the group consisting of SEQ ID NOs: 520 to 521, SEQ ID NOs: 523 to 524, SEQ ID NOs: 554 to 556, SEQ ID NO: 558, SEQ ID NO: 561, SEQ ID NOs: 563 to 565, SEQ ID NOs: 569 to 573, SEQ ID NOs: 596 to 600, SEQ ID NO: 650, SEQ ID NO: 656, and SEQ ID NOs: 700 to 705. In some embodiments, the nucleic acid sequences are administered in a construct for expression in vivo. In some embodiments, the in vivo administration of the nucleic acid sequences is configured to produce one or more peptides that is displayed by an HLA class II molecule. In some embodiments, the one or more peptides is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, the one or more peptides is a modified or unmodified fragment of a protein with a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the nucleic acid sequences are administered in an effective amount to a subject to prevent cancer. In some embodiments, the nucleic acid sequences are administered in an effective amount to a subject to treat cancer. In some embodiments, the cancer is bronchus and lung cancer.

In another aspect, the invention provides for a method of treating or preventing bronchus and lung cancer by administering to a subject an immunogenic composition comprising nucleic acid sequences encoding one or more amino acid sequences selected from the group consisting of SEQ ID NOs: 520 to 521, SEQ ID NOs: 523 to 524, SEQ ID NOs: 554 to 556, SEQ ID NO: 558, SEQ ID NO: 561, SEQ ID NOs: 563 to 565, SEQ ID NOs: 569 to 573, SEQ ID NOs: 596 to 600, SEQ ID NO: 650, SEQ ID NO: 656, and SEQ ID NOs: 700 to 705.

In some embodiments, the immunogenic composition comprises nucleic acid sequences encoding two or more amino acid sequences selected from the group consisting of SEQ ID NOs: 520 to 521, SEQ ID NOs: 523 to 524, SEQ ID NOs: 554 to 556, SEQ ID NO: 558, SEQ ID NO: 561, SEQ ID NOs: 563 to 565, SEQ ID NOs: 569 to 573, SEQ ID NOs: 596 to 600, SEQ ID NO: 650, SEQ ID NO: 656, and SEQ ID NOs: 700 to 705.

In another aspect, the invention provides for an immunogenic peptide composition comprising one or more peptides selected from the group consisting of SEQ ID NOs: 520 to 521, SEQ ID NOs: 523 to 524, SEQ ID NOs: 554 to 556, SEQ ID NO: 558, SEQ ID NO: 561, SEQ ID NOs: 563 to 565, SEQ ID NOs: 569 to 573, SEQ ID NOs: 596 to 600, SEQ ID NO: 650, SEQ ID NO: 656, and SEQ ID NOs: 700 to 705.

In some embodiments, the immunogenic peptide composition comprises two or more peptides selected from the group consisting of SEQ ID NOs: 520 to 521, SEQ ID NOs: 523 to 524, SEQ ID NOs: 554 to 556, SEQ ID NO: 558, SEQ ID NO: 561, SEQ ID NOs: 563 to 565, SEQ ID NOs: 569 to 573, SEQ ID NOs: 596 to 600, SEQ ID NO: 650, SEQ ID NO: 656, and SEQ ID NOs: 700 to 705. In some embodiments, a peptide in the immunogenic peptide composition is displayed by an HLA class II molecule. In some embodiments, a peptide in the immunogenic peptide composition is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, a peptide in the immunogenic peptide composition is a modified or unmodified fragment of a protein, wherein the protein comprises a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the immunogenic peptide composition is administered in an effective amount to a subject to prevent cancer. In some embodiments, the immunogenic peptide composition is administered in an effective amount to a subject to treat cancer. In some embodiments, the cancer is bronchus and lung cancer.

In another aspect, the invention provides for a method of treating or preventing bronchus and lung cancer in a subject comprising administering to the subject an immunogenic peptide composition comprising one or more peptides selected from the group consisting of SEQ ID NOs: 520 to 521, SEQ ID NOs: 523 to 524, SEQ ID NOs: 554 to 556, SEQ ID NO: 558, SEQ ID NO: 561, SEQ ID NOs: 563 to 565, SEQ ID NOs: 569 to 573, SEQ ID NOs: 596 to 600, SEQ ID NO: 650, SEQ ID NO: 656, and SEQ ID NOs: 700 to 705.

In some embodiments, the immunogenic peptide composition comprises two or more peptides selected from the group consisting of SEQ ID NOs: 520 to 521, SEQ ID NOs: 523 to 524, SEQ ID NOs: 554 to 556, SEQ ID NO: 558, SEQ ID NO: 561, SEQ ID NOs: 563 to 565, SEQ ID NOs: 569 to 573, SEQ ID NOs: 596 to 600, SEQ ID NO: 650, SEQ ID NO: 656, and SEQ ID NOs: 700 to 705.

In another aspect, the invention provides for an immunogenic composition comprising nucleic acid sequences encoding one or more amino acid sequences selected from the group consisting of SEQ ID NOs: 646 to 667, SEQ ID NOs: 708 to 717, and SEQ ID NOs: 733 to 748.

In some embodiments, the immunogenic composition comprises nucleic acid sequences encoding two or more amino acid sequences selected from the group consisting of SEQ ID NOs: 646 to 667, SEQ ID NOs: 708 to 717, and SEQ ID NOs: 733 to 748. In some embodiments, the nucleic acid sequences are administered in a construct for expression in vivo. In some embodiments, the in vivo administration of the nucleic acid sequences is configured to produce one or more peptides that is displayed by an HLA class II molecule. In some embodiments, the one or more peptides is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, the one or more peptides is a modified or unmodified fragment of a protein with a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the nucleic acid sequences are administered in an effective amount to a subject to prevent cancer. In some embodiments, the nucleic acid sequences are administered in an effective amount to a subject to treat cancer. In some embodiments, the cancer is breast cancer.

In another aspect, the invention provides for a method of treating or preventing breast cancer by administering to a subject an immunogenic composition comprising nucleic acid sequences encoding one or more amino acid sequences selected from the group consisting of SEQ ID NOs: 646 to 667, SEQ ID NOs: 708 to 717, and SEQ ID NOs: 733 to 748.

In some embodiments, the immunogenic composition comprises nucleic acid sequences encoding two or more amino acid sequences selected from the group consisting of SEQ ID NOs: 646 to 667, SEQ ID NOs: 708 to 717, and SEQ ID NOs: 733 to 748.

In another aspect, the invention provides for an immunogenic peptide composition comprising one or more peptides selected from the group consisting of SEQ ID NOs: 646 to 667, SEQ ID NOs: 708 to 717, and SEQ ID NOs: 733 to 748.

In some embodiments, the immunogenic peptide composition comprises two or more peptides selected from the group consisting of SEQ ID NOs: 646 to 667, SEQ ID NOs: 708 to 717, and SEQ ID NOs: 733 to 748. In some embodiments, a peptide in the immunogenic peptide composition is displayed by an HLA class II molecule. In some embodiments, a peptide in the immunogenic peptide composition is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, a peptide in the immunogenic peptide composition is a modified or unmodified fragment of a protein, wherein the protein comprises a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the immunogenic peptide composition is administered in an effective amount to a subject to prevent cancer. In some embodiments, the immunogenic peptide composition is administered in an effective amount to a subject to treat cancer. In some embodiments, the cancer is breast cancer.

In another aspect, the invention provides for a method of treating or preventing breast cancer in a subject comprising administering to the subject an immunogenic peptide composition comprising one or more peptides selected from the group consisting of SEQ ID NOs: 646 to 667, SEQ ID NOs: 708 to 717, and SEQ ID NOs: 733 to 748.

In some embodiments, the immunogenic peptide composition comprises two or more peptides selected from the group consisting of SEQ ID NOs: 646 to 667, SEQ ID NOs: 708 to 717, and SEQ ID NOs: 733 to 748.

In another aspect, the invention provides for an immunogenic composition comprising nucleic acid sequences encoding one or more amino acid sequences selected from the group consisting of SEQ ID NOs: 646 to 667, SEQ ID NOs: 708 to 717, and SEQ ID NOs: 733 to 748.

In some embodiments, the immunogenic composition comprises nucleic acid sequences encoding two or more amino acid sequences selected from the group consisting of SEQ ID NOs: 646 to 667, SEQ ID NOs: 708 to 717, and SEQ ID NOs: 733 to 748. In some embodiments, the nucleic acid sequences are administered in a construct for expression in vivo. In some embodiments, the in vivo administration of the nucleic acid sequences is configured to produce one or more peptides that is displayed by an HLA class II molecule. In some embodiments, the one or more peptides is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, the one or more peptides is a modified or unmodified fragment of a protein with a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the nucleic acid sequences are administered in an effective amount to a subject to prevent cancer. In some embodiments, the nucleic acid sequences are administered in an effective amount to a subject to treat cancer. In some embodiments, the cancer is ovarian cancer.

In another aspect, the invention provides for a method of treating or preventing ovarian cancer by administering to a subject an immunogenic composition comprising nucleic acid sequences encoding one or more amino acid sequences selected from the group consisting of SEQ ID NOs: 646 to 667, SEQ ID NOs: 708 to 717, and SEQ ID NOs: 733 to 748.

In some embodiments, the immunogenic composition comprises nucleic acid sequences encoding two or more amino acid sequences selected from the group consisting of SEQ ID NOs: 646 to 667, SEQ ID NOs: 708 to 717, and SEQ ID NOs: 733 to 748.

In another aspect, the invention provides for an immunogenic peptide composition comprising one or more peptides selected from the group consisting of SEQ ID NOs: 646 to 667, SEQ ID NOs: 708 to 717, and SEQ ID NOs: 733 to 748.

In some embodiments, the immunogenic peptide composition comprises two or more peptides selected from the group consisting of SEQ ID NOs: 646 to 667, SEQ ID NOs: 708 to 717, and SEQ ID NOs: 733 to 748. In some embodiments, a peptide in the immunogenic peptide composition is displayed by an HLA class II molecule. In some embodiments, a peptide in the immunogenic peptide composition is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, a peptide in the immunogenic peptide composition is a modified or unmodified fragment of a protein, wherein the protein comprises a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the immunogenic peptide composition is administered in an effective amount to a subject to prevent cancer. In some embodiments, the immunogenic peptide composition is administered in an effective amount to a subject to treat cancer. In some embodiments, the cancer is ovarian cancer.

In another aspect, the invention provides for a method of treating or preventing ovarian cancer in a subject comprising administering to the subject an immunogenic peptide composition comprising one or more peptides selected from the group consisting of SEQ ID NOs: 646 to 667, SEQ ID NOs: 708 to 717, and SEQ ID NOs: 733 to 748.

In some embodiments, the immunogenic peptide composition comprises two or more peptides selected from the group consisting of SEQ ID NOs: 646 to 667, SEQ ID NOs: 708 to 717, and SEQ ID NOs: 733 to 748.

Vaccines for CT Antigens

In one aspect, the invention provides for nucleic acid sequences encoding one or more amino acid sequences selected from the group consisting of SEQ ID NOs: 28796 to 28864, SEQ ID NOs: 37110 to 37174, SEQ ID NOs: 41321 to 41397, SEQ ID NO: 41770, SEQ ID NO: 49004, SEQ ID NO: 49071, SEQ ID NO: 49395, SEQ ID NO: 50632, SEQ ID NO: 50729, SEQ ID NOs: 51434 to 51510, SEQ ID NO: 55758, SEQ ID NOs: 60456 to 60527, SEQ ID NOs: 68238 to 68321, SEQ ID NO: 77091, SEQ ID NO: 77210, SEQ ID NO: 84188, SEQ ID NO: 87951, SEQ ID NO: 88144, SEQ ID NOs: 95593 to 95664, SEQ ID NOs: 113808 to 113869, SEQ ID NOs: 125134 to 125218, SEQ ID NOs: 144109 to 144188, SEQ ID NOs: 162383 to 162453, SEQ ID NOs: 166444 to 166531, SEQ ID NO: 167118, SEQ ID NO: 169740, SEQ ID NO: 173412, SEQ ID NO: 179404, and SEQ ID NOs: 182574 to 182654.

In some embodiments, the nucleic acid sequences encode two or more amino acid sequences selected from the group consisting of SEQ ID NOs: 28796 to 28864, SEQ ID NOs: 37110 to 37174, SEQ ID NOs: 41321 to 41397, SEQ ID NO: 41770, SEQ ID NO: 49004, SEQ ID NO: 49071, SEQ ID NO: 49395, SEQ ID NO: 50632, SEQ ID NO: 50729, SEQ ID NOs: 51434 to 51510, SEQ ID NO: 55758, SEQ ID NOs: 60456 to 60527, SEQ ID NOs: 68238 to 68321, SEQ ID NO: 77091, SEQ ID NO: 77210, SEQ ID NO: 84188, SEQ ID NO: 87951, SEQ ID NO: 88144, SEQ ID NOs: 95593 to 95664, SEQ ID NOs: 113808 to 113869, SEQ ID NOs: 125134 to 125218, SEQ ID NOs: 144109 to 144188, SEQ ID NOs: 162383 to 162453, SEQ ID NOs: 166444 to 166531, SEQ ID NO: 167118, SEQ ID NO: 169740, SEQ ID NO: 173412, SEQ ID NO: 179404, and SEQ ID NOs: 182574 to 182654.

In another aspect, the invention provides for an immunogenic composition comprising nucleic acid sequences encoding one or more amino acid sequences selected from the group consisting of SEQ ID NOs: 28796 to 28864, SEQ ID NOs: 37110 to 37174, SEQ ID NOs: 41321 to 41397, SEQ ID NO: 41770, SEQ ID NO: 49004, SEQ ID NO: 49071, SEQ ID NO: 49395, SEQ ID NO: 50632, SEQ ID NO: 50729, SEQ ID NOs: 51434 to 51510, SEQ ID NO: 55758, SEQ ID NOs: 60456 to 60527, SEQ ID NOs: 68238 to 68321, SEQ ID NO: 77091, SEQ ID NO: 77210, SEQ ID NO: 84188, SEQ ID NO: 87951, SEQ ID NO: 88144, SEQ ID NOs: 95593 to 95664, SEQ ID NOs: 113808 to 113869, SEQ ID NOs: 125134 to 125218, SEQ ID NOs: 144109 to 144188, SEQ ID NOs: 162383 to 162453, SEQ ID NOs: 166444 to 166531, SEQ ID NO: 167118, SEQ ID NO: 169740, SEQ ID NO: 173412, SEQ ID NO: 179404, and SEQ ID NOs: 182574 to 182654.

In some embodiments, the immunogenic composition is administered to a subject. In some embodiments, the immunogenic composition comprises nucleic acid sequences encoding two or more amino acid sequences selected from the group consisting of SEQ ID NOs: 28796 to 28864, SEQ ID NOs: 37110 to 37174, SEQ ID NOs: 41321 to 41397, SEQ ID NO: 41770, SEQ ID NO: 49004, SEQ ID NO: 49071, SEQ ID NO: 49395, SEQ ID NO: 50632, SEQ ID NO: 50729, SEQ ID NOs: 51434 to 51510, SEQ ID NO: 55758, SEQ ID NOs: 60456 to 60527, SEQ ID NOs: 68238 to 68321, SEQ ID NO: 77091, SEQ ID NO: 77210, SEQ ID NO: 84188, SEQ ID NO: 87951, SEQ ID NO: 88144, SEQ ID NOs: 95593 to 95664, SEQ ID NOs: 113808 to 113869, SEQ ID NOs: 125134 to 125218, SEQ ID NOs: 144109 to 144188, SEQ ID NOs: 162383 to 162453, SEQ ID NOs: 166444 to 166531, SEQ ID NO: 167118, SEQ ID NO: 169740, SEQ ID NO: 173412, SEQ ID NO: 179404, and SEQ ID NOs: 182574 to 182654. In some embodiments, the nucleic acid sequences are administered in a construct for expression in vivo. In some embodiments, the in vivo administration of the nucleic acid sequences is configured to produce one or more peptides that is displayed by an HLA class I molecule. In some embodiments, the one or more peptides is a modified or unmodified fragment of a protein selected from the group consisting of CTG1B, KKLC1, MAGA1, MAGA3, MAGA4, MAGC1, MAGC3, MAR1, PMEL, PRAME, SSX2, TYRP1, and TYRP2. In some embodiments, the immunogenic composition is administered in an effective amount to a subject to prevent cancer. In some embodiments, the immunogenic composition is administered in an effective amount to a subject to treat cancer. In some embodiments, the cancer is selected from the group consisting of pancreatic cancer, skin cancer, thyroid cancer, brain cancer, colorectal cancer, bronchus and lung cancer, breast cancer, and ovarian cancer. In some embodiments, the immunogenic composition comprises nucleic acid sequences encoding at least three amino acid sequences selected from the group consisting of SEQ ID NOs: 28796 to 28864, SEQ ID NOs: 37110 to 37174, SEQ ID NOs: 41321 to 41397, SEQ ID NO: 41770, SEQ ID NO: 49004, SEQ ID NO: 49071, SEQ ID NO: 49395, SEQ ID NO: 50632, SEQ ID NO: 50729, SEQ ID NOs: 51434 to 51510, SEQ ID NO: 55758, SEQ ID NOs: 60456 to 60527, SEQ ID NOs: 68238 to 68321, SEQ ID NO: 77091, SEQ ID NO: 77210, SEQ ID NO: 84188, SEQ ID NO: 87951, SEQ ID NO: 88144, SEQ ID NOs: 95593 to 95664, SEQ ID NOs: 113808 to 113869, SEQ ID NOs: 125134 to 125218, SEQ ID NOs: 144109 to 144188, SEQ ID NOs: 162383 to 162453, SEQ ID NOs: 166444 to 166531, SEQ ID NO: 167118, SEQ ID NO: 169740, SEQ ID NO: 173412, SEQ ID NO: 179404, and SEQ ID NOs: 182574 to 182654.

In another aspect, the invention provides for an immunogenic peptide composition comprising one or more peptides selected from the group consisting of SEQ ID NOs: 28796 to 28864, SEQ ID NOs: 37110 to 37174, SEQ ID NOs: 41321 to 41397, SEQ ID NO: 41770, SEQ ID NO: 49004, SEQ ID NO: 49071, SEQ ID NO: 49395, SEQ ID NO: 50632, SEQ ID NO: 50729, SEQ ID NOs: 51434 to 51510, SEQ ID NO: 55758, SEQ ID NOs: 60456 to 60527, SEQ ID NOs: 68238 to 68321, SEQ ID NO: 77091, SEQ ID NO: 77210, SEQ ID NO: 84188, SEQ ID NO: 87951, SEQ ID NO: 88144, SEQ ID NOs: 95593 to 95664, SEQ ID NOs:

113808 to 113869, SEQ ID NOs: 125134 to 125218, SEQ ID NOs: 144109 to 144188, SEQ ID NOs: 162383 to 162453, SEQ ID NOs: 166444 to 166531, SEQ ID NO: 167118, SEQ ID NO: 169740, SEQ ID NO: 173412, SEQ ID NO: 179404, and SEQ ID NOs: 182574 to 182654.

In some embodiments, the immunogenic peptide composition comprises two or more peptides selected from the group consisting of SEQ ID NOs: 28796 to 28864, SEQ ID NOs: 37110 to 37174, SEQ ID NOs: 41321 to 41397, SEQ ID NO: 41770, SEQ ID NO: 49004, SEQ ID NO: 49071, SEQ ID NO: 49395, SEQ ID NO: 50632, SEQ ID NO: 50729, SEQ ID NOs: 51434 to 51510, SEQ ID NO: 55758, SEQ ID NOs: 60456 to 60527, SEQ ID NOs: 68238 to 68321, SEQ ID NO: 77091, SEQ ID NO: 77210, SEQ ID NO: 84188, SEQ ID NO: 87951, SEQ ID NO: 88144, SEQ ID NOs: 95593 to 95664, SEQ ID NOs: 113808 to 113869, SEQ ID NOs: 125134 to 125218, SEQ ID NOs: 144109 to 144188, SEQ ID NOs: 162383 to 162453, SEQ ID NOs: 166444 to 166531, SEQ ID NO: 167118, SEQ ID NO: 169740, SEQ ID NO: 173412, SEQ ID NO: 179404, and SEQ ID NOs: 182574 to 182654.

In another aspect, the invention provides for an immunogenic composition comprising nucleic acid sequences encoding one or more amino acid sequences selected from the group consisting of SEQ ID NOs: 28796 to 28830.

In some embodiments, the immunogenic composition comprises nucleic acid sequences encoding one or more amino acid sequences derived from a CTG1B protein. In some embodiments, the immunogenic composition comprises nucleic acid sequences encoding two or more amino acid sequences selected from the group consisting of SEQ ID NOs: 28796 to 28830.

In another aspect, the invention provides for an immunogenic peptide composition comprising one or more peptides selected from the group consisting of SEQ ID NOs: 28796 to 28830.

In some embodiments, the immunogenic peptide composition comprises two or more peptides selected from the group consisting of SEQ ID NOs: 28796 to 28830. In some embodiments, the one or more peptides is a modified or unmodified fragment of a CTG1B protein.

In another aspect, the invention provides for an immunogenic composition comprising nucleic acid sequences encoding one or more amino acid sequences selected from the group consisting of SEQ ID NOs: 41321 to 41354.

In some embodiments, the immunogenic composition comprises nucleic acid sequences encoding one or more amino acid sequences derived from a MAGA1 protein. In some embodiments, the immunogenic composition comprises nucleic acid sequences encoding two or more amino acid sequences selected from the group consisting of SEQ ID NOs: 41321 to 41354.

In another aspect, the invention provides for an immunogenic peptide composition comprising one or more peptides selected from the group consisting of SEQ ID NOs: 41321 to 41354.

In some embodiments, the immunogenic peptide composition comprises two or more peptides selected from the group consisting of SEQ ID NOs: 41321 to 41354. In some embodiments, the one or more peptides is a modified or unmodified fragment of a MAGA1 protein.

In another aspect, the invention provides for an immunogenic composition comprising nucleic acid sequences encoding one or more amino acid sequences selected from the group consisting of SEQ ID NO: 41770, SEQ ID NO: 49004, and SEQ ID NOs: 51434 to 51468.

In some embodiments, the immunogenic composition comprises nucleic acid sequences encoding one or more amino acid sequences derived from a MAGA3 protein. In some embodiments, the immunogenic composition comprises nucleic acid sequences encoding two or more amino acid sequences selected from the group consisting of SEQ ID NO: 41770, SEQ ID NO: 49004, and SEQ ID NOs: 51434 to 51468.

In another aspect, the invention provides for an immunogenic peptide composition comprising one or more peptides selected from the group consisting of SEQ ID NO: 41770, SEQ ID NO: 49004, and SEQ ID NOs: 51434 to 51468.

In some embodiments, the immunogenic peptide composition comprises two or more peptides selected from the group consisting of SEQ ID NO: 41770, SEQ ID NO: 49004, and SEQ ID NOs: 51434 to 51468. In some embodiments, the one or more peptides is a modified or unmodified fragment of a MAGA3 protein.

In another aspect, the invention provides for an immunogenic composition comprising nucleic acid sequences encoding one or more amino acid sequences selected from the group consisting of SEQ ID NO: 41352, SEQ ID NO: 41770, and SEQ ID NOs: 60456 to 60487.

In some embodiments, the immunogenic composition comprises nucleic acid sequences encoding one or more amino acid sequences derived from a MAGA4 protein. In some embodiments, the immunogenic composition comprises nucleic acid sequences encoding two or more amino acid sequences selected from the group consisting of SEQ ID NO: 41352, SEQ ID NO: 41770, and SEQ ID NOs: 60456 to 60487.

In another aspect, the invention provides for an immunogenic peptide composition comprising one or more peptides selected from the group consisting of SEQ ID NO: 41352, SEQ ID NO: 41770, and SEQ ID NOs: 60456 to 60487.

In some embodiments, the immunogenic peptide composition comprises two or more peptides selected from the group consisting of SEQ ID NO: 41352, SEQ ID NO: 41770, and SEQ ID NOs: 60456 to 60487. In some embodiments, the one or more peptides is a modified or unmodified fragment of a MAGA4 protein.

In another aspect, the invention provides for an immunogenic composition comprising nucleic acid sequences encoding one or more amino acid sequences selected from the group consisting of SEQ ID NO: 49395 and SEQ ID NOs: 68238 to 68272.

In some embodiments, the immunogenic composition comprises nucleic acid sequences encoding one or more amino acid sequences derived from a MAGC1 protein. In some embodiments, the immunogenic composition comprises nucleic acid sequences encoding two or more amino acid sequences selected from the group consisting of SEQ ID NO: 49395 and SEQ ID NOs: 68238 to 68272.

In another aspect, the invention provides for an immunogenic peptide composition comprising one or more peptides selected from the group consisting of SEQ ID NO: 49395 and SEQ ID NOs: 68238 to 68272.

In some embodiments, the immunogenic peptide composition comprises two or more peptides selected from the group consisting of SEQ ID NO: 49395 and SEQ ID NOs: 68238 to 68272. In some embodiments, the one or more peptides is a modified or unmodified fragment of a MAGC1 protein.

In another aspect, the invention provides for an immunogenic composition comprising nucleic acid sequences encoding one or more amino acid sequences selected from the group consisting of SEQ ID NO: 77091, SEQ ID NO: 77210, SEQ ID NO: 84188, SEQ ID NO: 88144, and SEQ ID NOs: 95593 to 95624.

In some embodiments, the immunogenic composition comprises nucleic acid sequences encoding one or more amino acid sequences derived from a MAGC3 protein. In some embodiments, the immunogenic composition comprises nucleic acid sequences encoding two or more amino acid sequences selected from the group consisting of SEQ ID NO: 77091, SEQ ID NO: 77210, SEQ ID NO: 84188, SEQ ID NO: 88144, and SEQ ID NOs: 95593 to 95624.

In another aspect, the invention provides for an immunogenic peptide composition comprising one or more peptides selected from the group consisting of SEQ ID NO: 77091, SEQ ID NO: 77210, SEQ ID NO: 84188, SEQ ID NO: 88144, and SEQ ID NOs: 95593 to 95624.

In some embodiments, the immunogenic peptide composition comprises two or more peptides selected from the group consisting of SEQ ID NO: 77091, SEQ ID NO: 77210, SEQ ID NO: 84188, SEQ ID NO: 88144, and SEQ ID NOs: 95593 to 95624. In some embodiments, the one or more peptides is a modified or unmodified fragment of a MAGC3 protein.

In another aspect, the invention provides for an immunogenic composition comprising nucleic acid sequences encoding one or more amino acid sequences selected from the group consisting of SEQ ID NOs: 162383 to 162420.

In some embodiments, the immunogenic composition comprises nucleic acid sequences encoding one or more amino acid sequences derived from a SSX2 protein. In some embodiments, the immunogenic composition comprises nucleic acid sequences encoding two or more amino acid sequences selected from the group consisting of SEQ ID NOs: 162383 to 162420.

In another aspect, the invention provides for an immunogenic peptide composition comprising one or more peptides selected from the group consisting of SEQ ID NOs: 162383 to 162420.

In some embodiments, the immunogenic peptide composition comprises two or more peptides selected from the group consisting of SEQ ID NOs: 162383 to 162420. In some embodiments, the one or more peptides is a modified or unmodified fragment of a SSX2 protein.

In another aspect, the invention provides for an immunogenic composition comprising nucleic acid sequences encoding one or more amino acid sequences selected from the group consisting of SEQ ID NOs: 144109 to 144142.

In some embodiments, the immunogenic composition comprises nucleic acid sequences encoding one or more amino acid sequences derived from a PRAME protein. In some embodiments, the immunogenic composition comprises nucleic acid sequences encoding two or more amino acid sequences selected from the group consisting of SEQ ID NOs: 144109 to 144142.

In another aspect, the invention provides for an immunogenic peptide composition comprising one or more peptides selected from the group consisting of SEQ ID NOs: 144109 to 144142.

In some embodiments, the immunogenic peptide composition comprises two or more peptides selected from the group consisting of SEQ ID NOs: 144109 to 144142. In some embodiments, the one or more peptides is a modified or unmodified fragment of a PRAME protein.

In another aspect, the invention provides for an immunogenic composition comprising nucleic acid sequences encoding one or more amino acid sequences selected from the group consisting of SEQ ID NOs: 37110 to 37145.

In some embodiments, the immunogenic composition comprises nucleic acid sequences encoding one or more amino acid sequences derived from a KKLC1 protein. In some embodiments, the immunogenic composition comprises nucleic acid sequences encoding two or more amino acid sequences selected from the group consisting of SEQ ID NOs: 37110 to 37145.

In another aspect, the invention provides for an immunogenic peptide composition comprising one or more peptides selected from the group consisting of SEQ ID NOs: 37110 to 37145.

In some embodiments, the immunogenic peptide composition comprises two or more peptides selected from the group consisting of SEQ ID NOs: 37110 to 37145. In some embodiments, the one or more peptides is a modified or unmodified fragment of a KKLC1 protein.

In another aspect, the invention provides for an immunogenic composition comprising nucleic acid sequences encoding one or more amino acid sequences selected from the group consisting of SEQ ID NOs: 125134 to 125167.

In some embodiments, the immunogenic composition comprises nucleic acid sequences encoding one or more amino acid sequences derived from a PMEL protein. In some embodiments, the immunogenic composition comprises nucleic acid sequences encoding two or more amino acid sequences selected from the group consisting of SEQ ID NOs: 125134 to 125167.

In another aspect, the invention provides for an immunogenic peptide composition comprising one or more peptides selected from the group consisting of SEQ ID NOs: 125134 to 125167.

In some embodiments, the immunogenic peptide composition comprises two or more peptides selected from the group consisting of SEQ ID NOs: 125134 to 125167. In some embodiments, the one or more peptides is a modified or unmodified fragment of a PMEL protein.

In another aspect, the invention provides for an immunogenic composition comprising nucleic acid sequences encoding one or more amino acid sequences selected from the group consisting of SEQ ID NOs: 166444 to 166480.

In some embodiments, the immunogenic composition comprises nucleic acid sequences encoding one or more amino acid sequences derived from a TYRP1 protein. In some embodiments, the immunogenic composition comprises nucleic acid sequences encoding two or more amino acid sequences selected from the group consisting of SEQ ID NOs: 166444 to 166480.

In another aspect, the invention provides for an immunogenic peptide composition comprising one or more peptides selected from the group consisting of SEQ ID NOs: 166444 to 166480.

In some embodiments, the immunogenic peptide composition comprises two or more peptides selected from the group consisting of SEQ ID NOs: 166444 to 166480. In some embodiments, the one or more peptides is a modified or unmodified fragment of a TYRP1 protein.

In another aspect, the invention provides for an immunogenic composition comprising nucleic acid sequences encoding one or more amino acid sequences selected from the group consisting of SEQ ID NO: 169740, SEQ ID NO: 173412, SEQ ID NO: 179404, and SEQ ID NOs: 182574 to 182606.

In some embodiments, the immunogenic composition comprises nucleic acid sequences encoding one or more amino acid sequences derived from a TYRP2 protein. In some embodiments, the immunogenic composition comprises nucleic acid sequences encoding two or more amino acid sequences selected from the group consisting of SEQ ID NO: 169740, SEQ ID NO: 173412, SEQ ID NO: 179404, and SEQ ID NOs: 182574 to 182606.

In another aspect, the invention provides for an immunogenic peptide composition comprising one or more peptides selected from the group consisting of SEQ ID NO: 169740, SEQ ID NO: 173412, SEQ ID NO: 179404, and SEQ ID NOs: 182574 to 182606.

In some embodiments, the immunogenic peptide composition comprises two or more peptides selected from the group consisting of SEQ ID NO: 169740, SEQ ID NO: 173412, SEQ ID NO: 179404, and SEQ ID NOs: 182574 to 182606. In some embodiments, the one or more peptides is a modified or unmodified fragment of a TYRP2 protein.

In another aspect, the invention provides for an immunogenic composition comprising nucleic acid sequences encoding one or more amino acid sequences selected from the group consisting of SEQ ID NOs: 113808 to 113843.

In some embodiments, the immunogenic composition comprises nucleic acid sequences encoding one or more amino acid sequences derived from a MAR1 protein. In some embodiments, the immunogenic composition comprises nucleic acid sequences encoding two or more amino acid sequences selected from the group consisting of SEQ ID NOs: 113808 to 113843.

In another aspect, the invention provides for an immunogenic peptide composition comprising one or more peptides selected from the group consisting of SEQ ID NOs: 113808 to 113843.

In some embodiments, the immunogenic peptide composition comprises two or more peptides selected from the group consisting of SEQ ID NOs: 113808 to 113843. In some embodiments, the one or more peptides is a modified or unmodified fragment of a MAR1 protein.

In one aspect, the invention provides for nucleic acid sequences encoding one or more amino acid sequences selected from the group consisting of SEQ ID NOs: 28796 to 28864, SEQ ID NOs: 37110 to 37174, SEQ ID NOs: 41321 to 41397, SEQ ID NO: 41770, SEQ ID NO: 49004, SEQ ID NO: 49071, SEQ ID NO: 49395, SEQ ID NO: 50632, SEQ ID NO: 50729, SEQ ID NOs: 51434 to 51510, SEQ ID NO: 55758, SEQ ID NOs: 60456 to 60527, SEQ ID NOs: 68238 to 68321, SEQ ID NO: 77091, SEQ ID NO: 77210, SEQ ID NO: 84188, SEQ ID NO: 87951, SEQ ID NO: 88144, SEQ ID NOs: 95593 to 95664, SEQ ID NOs: 113808 to 113869, SEQ ID NOs: 125134 to 125218, SEQ ID NOs: 144109 to 144188, SEQ ID NOs: 162383 to 162453, SEQ ID NOs: 166444 to 166531, SEQ ID NO: 167118, SEQ ID NO: 169740, SEQ ID NO: 173412, SEQ ID NO: 179404, and SEQ ID NOs: 182574 to 182654.

In some embodiments, the nucleic acid sequences encode two or more amino acid sequences selected from the group consisting of SEQ ID NOs: 28796 to 28864, SEQ ID NOs: 37110 to 37174, SEQ ID NOs: 41321 to 41397, SEQ ID NO: 41770, SEQ ID NO: 49004, SEQ ID NO: 49071, SEQ ID NO: 49395, SEQ ID NO: 50632, SEQ ID NO: 50729, SEQ ID NOs: 51434 to 51510, SEQ ID NO: 55758, SEQ ID NOs: 60456 to 60527, SEQ ID NOs: 68238 to 68321, SEQ ID NO: 77091, SEQ ID NO: 77210, SEQ ID NO: 84188, SEQ ID NO: 87951, SEQ ID NO: 88144, SEQ ID NOs: 95593 to 95664, SEQ ID NOs: 113808 to 113869, SEQ ID NOs: 125134 to 125218, SEQ ID NOs: 144109 to 144188, SEQ ID NOs: 162383 to 162453, SEQ ID NOs: 166444 to 166531, SEQ ID NO: 167118, SEQ ID NO: 169740, SEQ ID NO: 173412, SEQ ID NO: 179404, and SEQ ID NOs: 182574 to 182654.

In another aspect, the invention provides for an immunogenic composition comprising nucleic acid sequences encoding one or more amino acid sequences selected from the group consisting of SEQ ID NOs: 28796 to 28864, SEQ ID NOs: 37110 to 37174, SEQ ID NOs: 41321 to 41397, SEQ ID NO: 41770, SEQ ID NO: 49004, SEQ ID NO: 49071, SEQ ID NO: 49395, SEQ ID NO: 50632, SEQ ID NO: 50729, SEQ ID NOs: 51434 to 51510, SEQ ID NO: 55758, SEQ ID NOs: 60456 to 60527, SEQ ID NOs: 68238 to 68321, SEQ ID NO: 77091, SEQ ID NO: 77210, SEQ ID NO: 84188, SEQ ID NO: 87951, SEQ ID NO: 88144, SEQ ID NOs: 95593 to 95664, SEQ ID NOs: 113808 to 113869, SEQ ID NOs: 125134 to 125218, SEQ ID NOs: 144109 to 144188, SEQ ID NOs: 162383 to 162453, SEQ ID NOs: 166444 to 166531, SEQ ID NO: 167118, SEQ ID NO: 169740, SEQ ID NO: 173412, SEQ ID NO: 179404, and SEQ ID NOs: 182574 to 182654.

In some embodiments, the immunogenic composition is administered to a subject. In some embodiments, the immunogenic composition comprises nucleic acid sequences encoding two or more amino acid sequences selected from the group consisting of SEQ ID NOs: 28796 to 28864, SEQ ID NOs: 37110 to 37174, SEQ ID NOs: 41321 to 41397, SEQ ID NO: 41770, SEQ ID NO: 49004, SEQ ID NO: 49071, SEQ ID NO: 49395, SEQ ID NO: 50632, SEQ ID NO: 50729, SEQ ID NOs: 51434 to 51510, SEQ ID NO: 55758, SEQ ID NOs: 60456 to 60527, SEQ ID NOs: 68238 to 68321, SEQ ID NO: 77091, SEQ ID NO: 77210, SEQ ID NO: 84188, SEQ ID NO: 87951, SEQ ID NO: 88144, SEQ ID NOs: 95593 to 95664, SEQ ID NOs: 113808 to 113869, SEQ ID NOs: 125134 to 125218, SEQ ID NOs: 144109 to 144188, SEQ ID NOs: 162383 to 162453, SEQ ID NOs: 166444 to 166531, SEQ ID NO: 167118, SEQ ID NO: 169740, SEQ ID NO: 173412, SEQ ID NO: 179404, and SEQ ID NOs: 182574 to 182654. In some embodiments, the nucleic acid sequences are administered in a construct for expression in vivo. In some embodiments, the in vivo administration of the nucleic acid sequences is configured to produce one or more peptides that is displayed by an HLA class II molecule. In some embodiments, the one or more peptides is a modified or unmodified fragment of a protein selected from the group consisting of CTG1B, KKLC1, MAGA1, MAGA3, MAGA4, MAGC1, MAGC3, MAR1, PMEL, PRAME, SSX2, TYRP1, and TYRP2. In some embodiments, the immunogenic composition is administered in an effective amount to a subject to prevent cancer. In some embodiments, the immunogenic composition is administered in an effective amount to a subject to treat cancer. In some embodiments, the cancer is selected from the group consisting of pancreatic cancer, skin cancer, thyroid cancer, brain cancer, colorectal cancer, bronchus and lung cancer, breast cancer, and ovarian cancer. In some embodiments, the immunogenic composition comprises nucleic acid sequences encoding at least three amino acid sequences selected from the group consisting of SEQ ID NOs: 28796 to 28864, SEQ ID NOs: 37110 to 37174, SEQ ID NOs: 41321 to 41397, SEQ ID NO: 41770, SEQ ID NO: 49004, SEQ ID NO: 49071, SEQ ID NO: 49395, SEQ ID NO: 50632, SEQ ID NO: 50729, SEQ ID NOs: 51434 to 51510, SEQ ID NO: 55758, SEQ ID NOs: 60456 to 60527, SEQ ID NOs: 68238 to 68321, SEQ ID NO: 77091, SEQ ID NO: 77210, SEQ ID NO: 84188, SEQ ID NO: 87951, SEQ ID NO: 88144, SEQ ID NOs: 95593 to 95664, SEQ ID NOs: 113808 to 113869, SEQ ID NOs: 125134 to 125218, SEQ ID NOs: 144109 to 144188, SEQ ID NOs: 162383 to 162453, SEQ ID NOs: 166444 to 166531, SEQ ID NO: 167118, SEQ ID NO: 169740, SEQ ID NO: 173412, SEQ ID NO: 179404, and SEQ ID NOs: 182574 to 182654.

In another aspect, the invention provides for an immunogenic peptide composition comprising one or more peptides selected from the group consisting of SEQ ID NOs: 28796 to 28864, SEQ ID NOs: 37110 to 37174, SEQ ID NOs: 41321 to 41397, SEQ ID NO: 41770, SEQ ID NO: 49004, SEQ ID NO: 49071, SEQ ID NO: 49395, SEQ ID NO: 50632, SEQ ID NO: 50729, SEQ ID NOs: 51434 to 51510, SEQ ID NO: 55758, SEQ ID NOs: 60456 to 60527, SEQ ID NOs: 68238 to 68321, SEQ ID NO: 77091, SEQ ID NO: 77210, SEQ ID NO: 84188, SEQ ID NO: 87951, SEQ ID NO: 88144, SEQ ID NOs: 95593 to 95664, SEQ ID NOs: 113808 to 113869, SEQ ID NOs: 125134 to 125218, SEQ ID NOs: 144109 to 144188, SEQ ID NOs: 162383 to 162453, SEQ ID NOs: 166444 to 166531, SEQ ID NO: 167118, SEQ ID NO: 169740, SEQ ID NO: 173412, SEQ ID NO: 179404, and SEQ ID NOs: 182574 to 182654.

In some embodiments, the immunogenic peptide composition comprises two or more peptides selected from the group consisting of SEQ ID NOs: 28796 to 28864, SEQ ID NOs: 37110 to 37174, SEQ ID NOs: 41321 to 41397, SEQ ID NO: 41770, SEQ ID NO: 49004, SEQ ID NO: 49071, SEQ ID NO: 49395, SEQ ID NO: 50632, SEQ ID NO: 50729, SEQ ID NOs: 51434 to 51510, SEQ ID NO: 55758, SEQ ID NOs: 60456 to 60527, SEQ ID NOs: 68238 to 68321, SEQ ID NO: 77091, SEQ ID NO: 77210, SEQ ID NO: 84188, SEQ ID NO: 87951, SEQ ID NO: 88144, SEQ ID NOs: 95593 to 95664, SEQ ID NOs: 113808 to 113869, SEQ ID NOs: 125134 to 125218, SEQ ID NOs: 144109 to 144188, SEQ ID NOs: 162383 to 162453, SEQ ID NOs: 166444 to 166531, SEQ ID NO: 167118, SEQ ID NO: 169740, SEQ ID NO: 173412, SEQ ID NO: 179404, and SEQ ID NOs: 182574 to 182654.

In another aspect, the invention provides for an immunogenic composition comprising nucleic acid sequences encoding one or more amino acid sequences selected from the group consisting of SEQ ID NOs: 197897 to 197901.

In some embodiments, the immunogenic composition comprises nucleic acid sequences encoding one or more amino acid sequences derived from a CTG1B protein. In some embodiments, the immunogenic composition comprises nucleic acid sequences encoding two or more amino acid sequences selected from the group consisting of SEQ ID NOs: 197897 to 197901.

In another aspect, the invention provides for an immunogenic peptide composition comprising one or more peptides selected from the group consisting of SEQ ID NOs: 197897 to 197901.

In some embodiments, the immunogenic peptide composition comprises two or more peptides selected from the group consisting of SEQ ID NOs: 197897 to 197901. In some embodiments, the one or more peptides is a modified or unmodified fragment of a CTG1B protein.

In another aspect, the invention provides for an immunogenic composition comprising nucleic acid sequences encoding one or more amino acid sequences selected from the group consisting of SEQ ID NOs: 211901 to 211904.

In some embodiments, the immunogenic composition comprises nucleic acid sequences encoding one or more amino acid sequences derived from a MAGA1 protein. In some embodiments, the immunogenic composition comprises nucleic acid sequences encoding two or more amino acid sequences selected from the group consisting of SEQ ID NOs: 211901 to 211904.

In another aspect, the invention provides for an immunogenic peptide composition comprising one or more peptides selected from the group consisting of SEQ ID NOs: 211901 to 211904.

In some embodiments, the immunogenic peptide composition comprises two or more peptides selected from the group consisting of SEQ ID NOs: 211901 to 211904. In some embodiments, the one or more peptides is a modified or unmodified fragment of a MAGA1 protein.

In another aspect, the invention provides for an immunogenic composition comprising nucleic acid sequences encoding one or more amino acid sequences selected from the group consisting of SEQ ID NOs: 223623 to 223627.

In some embodiments, the immunogenic composition comprises nucleic acid sequences encoding one or more amino acid sequences derived from a MAGA3 protein. In some embodiments, the immunogenic composition comprises nucleic acid sequences encoding two or more amino acid sequences selected from the group consisting of SEQ ID NOs: 223623 to 223627.

In another aspect, the invention provides for an immunogenic peptide composition comprising one or more peptides selected from the group consisting of SEQ ID NOs: 223623 to 223627.

In some embodiments, the immunogenic peptide composition comprises two or more peptides selected from the group consisting of SEQ ID NOs: 223623 to 223627. In some embodiments, the one or more peptides is a modified or unmodified fragment of a MAGA3 protein.

In another aspect, the invention provides for an immunogenic composition comprising nucleic acid sequences encoding one or more amino acid sequences selected from the group consisting of SEQ ID NOs: 236016 to 236020.

In some embodiments, the immunogenic composition comprises nucleic acid sequences encoding one or more amino acid sequences derived from a MAGA4 protein. In some embodiments, the immunogenic composition comprises nucleic acid sequences encoding two or more amino acid sequences selected from the group consisting of SEQ ID NOs: 236016 to 236020.

In another aspect, the invention provides for an immunogenic peptide composition comprising one or more peptides selected from the group consisting of SEQ ID NOs: 236016 to 236020.

In some embodiments, the immunogenic peptide composition comprises two or more peptides selected from the group consisting of SEQ ID NOs: 236016 to 236020. In some embodiments, the one or more peptides is a modified or unmodified fragment of a MAGA4 protein.

In another aspect, the invention provides for an immunogenic composition comprising nucleic acid sequences encoding one or more amino acid sequences selected from the group consisting of SEQ ID NOs: 247059 to 247063.

In some embodiments, the immunogenic composition comprises nucleic acid sequences encoding one or more amino acid sequences derived from a MAGC1 protein. In some embodiments, the immunogenic composition comprises nucleic acid sequences encoding two or more amino acid sequences selected from the group consisting of SEQ ID NOs: 247059 to 247063.

In another aspect, the invention provides for an immunogenic peptide composition comprising one or more peptides selected from the group consisting of SEQ ID NOs: 247059 to 247063.

In some embodiments, the immunogenic peptide composition comprises two or more peptides selected from the group consisting of SEQ ID NOs: 247059 to 247063. In some embodiments, the one or more peptides is a modified or unmodified fragment of a MAGC1 protein.

In another aspect, the invention provides for an immunogenic composition comprising nucleic acid sequences encoding one or more amino acid sequences selected from the group consisting of SEQ ID NOs: 281350 to 281353.

In some embodiments, the immunogenic composition comprises nucleic acid sequences encoding one or more amino acid sequences derived from a MAGC3 protein. In some embodiments, the immunogenic composition comprises nucleic acid sequences encoding two or more amino acid sequences selected from the group consisting of SEQ ID NOs: 281350 to 281353.

In another aspect, the invention provides for an immunogenic peptide composition comprising one or more peptides selected from the group consisting of SEQ ID NOs: 281350 to 281353.

In some embodiments, the immunogenic peptide composition comprises two or more peptides selected from the group consisting of SEQ ID NOs: 281350 to 281353. In some embodiments, the one or more peptides is a modified or unmodified fragment of a MAGC3 protein.

In another aspect, the invention provides for an immunogenic composition comprising nucleic acid sequences encoding one or more amino acid sequences selected from the group consisting of SEQ ID NOs: 369027 to 369031.

In some embodiments, the immunogenic composition comprises nucleic acid sequences encoding one or more amino acid sequences derived from a SSX2 protein. In some embodiments, the immunogenic composition comprises nucleic acid sequences encoding two or more amino acid sequences selected from the group consisting of SEQ ID NOs: 369027 to 369031.

In another aspect, the invention provides for an immunogenic peptide composition comprising one or more peptides selected from the group consisting of SEQ ID NOs: 369027 to 369031.

In some embodiments, the immunogenic peptide composition comprises two or more peptides selected from the group consisting of SEQ ID NOs: 369027 to 369031. In some embodiments, the one or more peptides is a modified or unmodified fragment of a SSX2 protein.

In another aspect, the invention provides for an immunogenic composition comprising nucleic acid sequences encoding one or more amino acid sequences selected from the group consisting of SEQ ID NOs: 342521 to 342525.

In some embodiments, the immunogenic composition comprises nucleic acid sequences encoding one or more amino acid sequences derived from a PRAME protein. In some embodiments, the immunogenic composition comprises nucleic acid sequences encoding two or more amino acid sequences selected from the group consisting of SEQ ID NOs: 342521 to 342525.

In another aspect, the invention provides for an immunogenic peptide composition comprising one or more peptides selected from the group consisting of SEQ ID NOs: 342521 to 342525.

In some embodiments, the immunogenic peptide composition comprises two or more peptides selected from the group consisting of SEQ ID NOs: 342521 to 342525. In some embodiments, the one or more peptides is a modified or unmodified fragment of a PRAME protein.

In another aspect, the invention provides for an immunogenic composition comprising nucleic acid sequences encoding one or more amino acid sequences selected from the group consisting of SEQ ID NOs: 206663 to 206665.

In some embodiments, the immunogenic composition comprises nucleic acid sequences encoding one or more amino acid sequences derived from a KKLC1 protein. In some embodiments, the immunogenic composition comprises nucleic acid sequences encoding two or more amino acid sequences selected from the group consisting of SEQ ID NOs: 206663 to 206665.

In another aspect, the invention provides for an immunogenic peptide composition comprising one or more peptides selected from the group consisting of SEQ ID NOs: 206663 to 206665.

In some embodiments, the immunogenic peptide composition comprises two or more peptides selected from the group consisting of SEQ ID NOs: 206663 to 206665. In some embodiments, the one or more peptides is a modified or unmodified fragment of a KKLC1 protein.

In another aspect, the invention provides for an immunogenic composition comprising nucleic acid sequences encoding one or more amino acid sequences selected from the group consisting of SEQ ID NOs: 317360 to 317363.

In some embodiments, the immunogenic composition comprises nucleic acid sequences encoding one or more amino acid sequences derived from a PMEL protein. In some embodiments, the immunogenic composition comprises nucleic acid sequences encoding two or more amino acid sequences selected from the group consisting of SEQ ID NOs: 317360 to 317363.

In another aspect, the invention provides for an immunogenic peptide composition comprising one or more peptides selected from the group consisting of SEQ ID NOs: 317360 to 317363.

In some embodiments, the immunogenic peptide composition comprises two or more peptides selected from the group consisting of SEQ ID NOs: 317360 to 317363. In some embodiments, the one or more peptides is a modified or unmodified fragment of a PMEL protein.

In another aspect, the invention provides for an immunogenic composition comprising nucleic acid sequences encoding one or more amino acid sequences selected from the group consisting of SEQ ID NOs: 373348 to 373350.

In some embodiments, the immunogenic composition comprises nucleic acid sequences encoding one or more amino acid sequences derived from a TYRP1 protein. In some embodiments, the immunogenic composition comprises nucleic acid sequences encoding two or more amino acid sequences selected from the group consisting of SEQ ID NOs: 373348 to 373350.

In another aspect, the invention provides for an immunogenic peptide composition comprising one or more peptides selected from the group consisting of SEQ ID NOs: 373348 to 373350.

In some embodiments, the immunogenic peptide composition comprises two or more peptides selected from the group consisting of SEQ ID NOs: 373348 to 373350. In some embodiments, the one or more peptides is a modified or unmodified fragment of a TYRP1 protein.

In another aspect, the invention provides for an immunogenic composition comprising nucleic acid sequences encoding one or more amino acid sequences selected from the group consisting of SEQ ID NOs: 392434 to 392437.

In some embodiments, the immunogenic composition comprises nucleic acid sequences encoding one or more amino acid sequences derived from a TYRP2 protein. In some embodiments, the immunogenic composition comprises nucleic acid sequences encoding two or more amino acid sequences selected from the group consisting of SEQ ID NOs: 392434 to 392437.

In another aspect, the invention provides for an immunogenic peptide composition comprising one or more peptides selected from the group consisting of SEQ ID NOs: 392434 to 392437.

In some embodiments, the immunogenic peptide composition comprises two or more peptides selected from the group consisting of SEQ ID NOs: 392434 to 392437. In some embodiments, the one or more peptides is a modified or unmodified fragment of a TYRP2 protein.

In another aspect, the invention provides for an immunogenic composition comprising nucleic acid sequences encoding one or more amino acid sequences selected from the group consisting of SEQ ID NOs: 305566 to 305570.

In some embodiments, the immunogenic composition comprises nucleic acid sequences encoding one or more amino acid sequences derived from a MAR1 protein. In some embodiments, the immunogenic composition comprises nucleic acid sequences encoding two or more amino acid sequences selected from the group consisting of SEQ ID NOs: 305566 to 305570.

In another aspect, the invention provides for an immunogenic peptide composition comprising one or more peptides selected from the group consisting of SEQ ID NOs: 305566 to 305570.

In some embodiments, the immunogenic peptide composition comprises two or more peptides selected from the group consisting of SEQ ID NOs: 305566 to 305570. In some embodiments, the one or more peptides is a modified or unmodified fragment of a MAR1 protein.

Vaccines for Autoimmune Diseases

In another aspect, the invention provides for an immunogenic composition comprising nucleic acid sequences encoding one or more amino acid sequences selected from the group consisting of SEQ ID NOs: 34169 to 34204.

In some embodiments, the immunogenic composition comprises nucleic acid sequences encoding one or more amino acid sequences derived from a INS protein. In some embodiments, the immunogenic composition comprises nucleic acid sequences encoding two or more amino acid sequences selected from the group consisting of SEQ ID NOs: 34169 to 34204.

In another aspect, the invention provides for an immunogenic peptide composition comprising one or more peptides selected from the group consisting of SEQ ID NOs: 34169 to 34204.

In some embodiments, the immunogenic peptide composition comprises two or more peptides selected from the group consisting of SEQ ID NOs: 34169 to 34204. In some embodiments, the one or more peptides is a modified or unmodified fragment of a INS protein.

In another aspect, the invention provides for an immunogenic composition comprising nucleic acid sequences encoding one or more amino acid sequences selected from the group consisting of SEQ ID NOs: 116478 to 116515.

In some embodiments, the immunogenic composition comprises nucleic acid sequences encoding one or more amino acid sequences derived from a MOG protein. In some embodiments, the immunogenic composition comprises nucleic acid sequences encoding two or more amino acid sequences selected from the group consisting of SEQ ID NOs: 116478 to 116515.

In another aspect, the invention provides for an immunogenic peptide composition comprising one or more peptides selected from the group consisting of SEQ ID NOs: 116478 to 116515.

In some embodiments, the immunogenic peptide composition comprises two or more peptides selected from the group consisting of SEQ ID NOs: 116478 to 116515. In some embodiments, the one or more peptides is a modified or unmodified fragment of a MOG protein.

In another aspect, the invention provides for an immunogenic composition comprising nucleic acid sequences encoding one or more amino acid sequences selected from the group consisting of SEQ ID NOs: 203517 to 203521.

In some embodiments, the immunogenic composition comprises nucleic acid sequences encoding one or more amino acid sequences derived from a INS protein. In some embodiments, the immunogenic composition comprises nucleic acid sequences encoding two or more amino acid sequences selected from the group consisting of SEQ ID NOs: 203517 to 203521.

In another aspect, the invention provides for an immunogenic peptide composition comprising one or more peptides selected from the group consisting of SEQ ID NOs: 203517 to 203521.

In some embodiments, the immunogenic peptide composition comprises two or more peptides selected from the group consisting of SEQ ID NOs: 203517 to 203521. In some embodiments, the one or more peptides is a modified or unmodified fragment of a INS protein.

In another aspect, the invention provides for an immunogenic composition comprising nucleic acid sequences encoding one or more amino acid sequences selected from the group consisting of SEQ ID NOs: 307670 to 307674.

In some embodiments, the immunogenic composition comprises nucleic acid sequences encoding one or more amino acid sequences derived from a MOG protein. In some embodiments, the immunogenic composition comprises nucleic acid sequences encoding two or more amino acid sequences selected from the group consisting of SEQ ID NOs: 307670 to 307674.

In another aspect, the invention provides for an immunogenic peptide composition comprising one or more peptides selected from the group consisting of SEQ ID NOs: 307670 to 307674.

In some embodiments, the immunogenic peptide composition comprises two or more peptides selected from the group consisting of SEQ ID NOs: 307670 to 307674. In some embodiments, the one or more peptides is a modified or unmodified fragment of a MOG protein.

BRIEF DESCRIPTION OF THE DRAWINGS

The following figures depict illustrative embodiments of the invention.

FIG. 7 is a table showing the respective probabilities of target presentations for various mutated protein targets across different cancers.

FIG. 13 shows an example Python implementation of the M$_{\text{ERGE}}$M$_{\text{ULTI}}$ function for combined vaccine design procedures.

DETAILED DESCRIPTION

Figure 1:
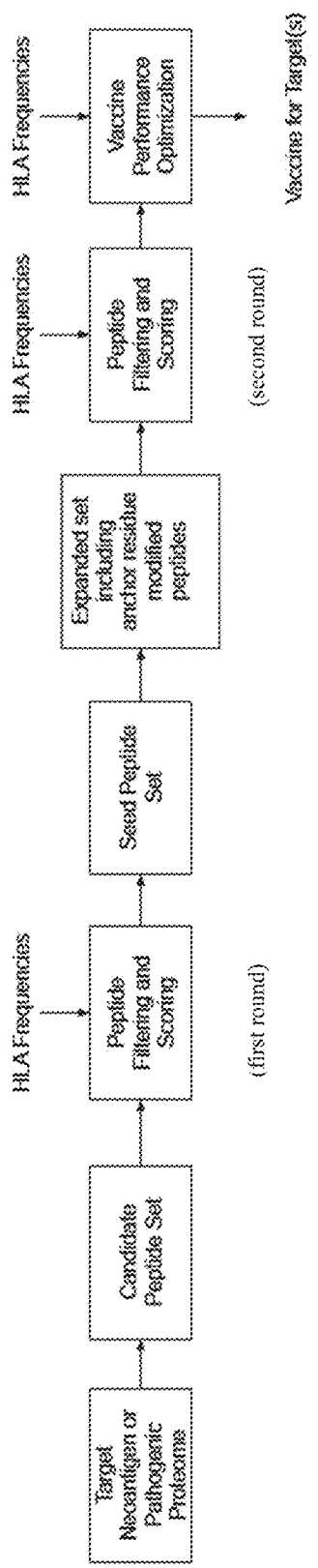
FIG. 1 is a flow chart of a vaccine optimization method.

In some embodiments, the disclosure provides for peptide vaccines that incorporate peptide sequences that will be displayed by Major Histocompatibility Complex (MHC) molecules on cells and train the immune system to recognize cancer or pathogen diseased cells. In some embodiments, the disclosure provides for peptide vaccines that that incorporate peptide sequences that will be displayed by Major Histocompatibility Complex (MHC) molecules on cells to induce therapeutic tolerance in antigen-specific immunotherapy for autoimmune diseases (Alhadj Ali et al., 2017, Gibson, et al., 2015). In some embodiments, a peptide vaccine is a composition that consists of one or more peptides. In some embodiments, a peptide vaccine is an mRNA or DNA construct administered for expression in vivo that encodes for one or more peptides.

Peptide display by an MHC molecule is necessary, but not sufficient, for a peptide to be immunogenic and cause the recognition of the resulting peptide-MHC complex by an individual's T cells to trigger T cell activation, expansion, and immune memory. In some embodiments, experimental data from assays such as the ELISPOT (Slota et al., 2011) or the Multiplex Identification of Antigen-Specific T Cell Receptors Using a Combination of Immune Assays and Immune Receptor Sequencing (MIRA) assay (Klinger et al., 2015) is used for scoring peptide display (e.g., peptide immunogenicity that requires peptide binding) by an MHC molecule (e.g., HLA allele) (e.g., measured as a peptide-HLA binding score). In some embodiments, experimental data from assays such as the ELISPOT (Slota et al., 2011) or the Multiplex Identification of Antigen-Specific T Cell Receptors Using a Combination of Immune Assays and Immune Receptor Sequencing (MIRA) assay (Klinger et al., 2015) can be used to score peptides for peptide-HLA immunogenicity. In some embodiments, experimental data from assays such as the ELISPOT (Slota et al., 2011) or the Multiplex Identification of Antigen-Specific T Cell Receptors Using a Combination of Immune Assays and Immune Receptor Sequencing (MIRA) assay (Klinger et al., 2015) can be combined with machine learning based predictions for scoring peptide display (e.g., binding affinity) by an MHC molecule (e.g., HLA allele) (e.g., measured as a peptide-HLA binding score) or for peptide-HLA immunogenicity. In some embodiments, the MHCflurry or NetMHCpan (Reynisson et al., 2020) computational methods (as known in the art) are used to predict MHC class I display of a peptide by an HLA allele (see Table 1). In some embodiments, the NetMHCIIpan computational method (Reynisson et al., 2020) is used to predict MHC class II display of a peptide by an HLA allele (see Table 2).

In some embodiments, computational methods such as MHCflurry (Odonnell et al., 2018, Odonnell et al., 2020, incorporated by reference in their entireties herein), NetMHCpan (Reynisson et al., 2020, incorporated by reference in its entirety herein), and NetMHCIIpan (Reynisson et al., 2020) are used to predict either MHC class I (MHCflurry, NetMHCpan) or class II (NetMHCIIpan) display of peptides by an HLA allele. In other embodiments, other methods of determining peptide-HLA binding are used as disclosed in International Publication No. WO 2005/042698, incorporated by reference in its entirety herein. NetMHCpan-4.1 and NetMHCIIpan-4.0 utilize the NNAlign_MA algorithm (Alvarez et al., 2019, incorporated by reference in its entirety herein) for predicting peptide-HLA binding. NNAlign_MA is in turn based upon the NNAlign (Nielsen et al., 2009, Nielsen et al., 2017, incorporated by reference in their entireties herein) neural network. NetMHCpan-4.1 (Reynisson et al., 2020) uses NNAlign_MA networks with at least 180 inputs that describe the peptide sequence (9×20=180 inputs). Networks with both 56 and 66 hidden neurons and two outputs are utilized (Alvarez et al., 2019). Each network architecture (56 or 66 hidden neurons) is trained with 5 different random parameter initializations and 5-fold cross-validation resulting in a total of 50 individual trained networks (2 architectures×5 initializations×5 cross-validation). These 50 trained networks are used as an ensemble with 25 networks having at least 10,800 parameters (180 inputs×56 neurons) and 25 networks consist of at least 11,880 parameters (180 inputs× 66 neurons). Thus, the ensemble of 50 networks in NetMHCpan-4.1 consists of at least 567,000 parameters that must be evaluated with at least 567,000 arithmetic operations for computing peptide-MHC binding. NetMHCIIpan-4.1 (Reynisson et al., 2020) uses NNAlign_MA networks with at least 180 inputs that describe the peptide sequence (9×20=180 inputs). Networks with 2, 10, 20, 40, and 60 hidden neurons and two outputs are utilized (Alvarez et al., 2019). Each network architecture (2, 10, 20, 40, or 60 hidden neurons) is trained with 10 different random parameter initializations and 5-fold cross-validation resulting in a total of 250 individual trained networks (5 architectures×10 initializations×5 cross-validation). These 250 trained networks are used as an ensemble with 50 networks having at least 360 parameters (180 inputs×2 neurons), 50 networks having at least 1800 parameters (180 inputs×10 neurons), 50 networks having at least 3600 parameters (180 inputs×20 neurons), 50 networks having at least 7200 parameters (180 inputs×40 neurons), and 50 networks having at least 10,800 parameters (180 inputs×60 neurons). Thus, the ensemble of 250 networks in NetMHCIIpan-4.0 consists of at least 1,188,000 parameters that must be evaluated with at least 1,188,000 arithmetic operations for computing peptide-MHC binding.

A peptide is displayed by an MHC molecule when it binds within the groove of the MHC molecule and is transported to the cell surface where it can be recognized by a T cell receptor. A target peptide refers to a foreign peptide or a self-peptide. In some embodiments, a peptide that is part of the normal proteome in a healthy individual is a self-peptide, and a peptide that is not part of the normal proteome is a foreign peptide. In some embodiments, target peptides can be part of the normal proteome that exhibit aberrant expression (e.g., cancer-testis antigens such as NY-ESO-1). Foreign peptides can be generated by mutations in normal self-proteins in tumor cells that create epitopes called neoantigens, or by pathogenic infections. In some embodiments, a neoantigen is any subsequence of a human protein, where the subsequence contains one or more altered amino acids or protein modifications that do not appear in a healthy individual. Therefore, in this disclosure, foreign peptide refers to an amino acid sequence encoding a fragment of a target protein/peptide (or a full-length protein/peptide), the target protein/peptide consisting of: a neoantigen protein, a pathogen proteome, or any other undesired protein that is non-self and is expected to be bound and displayed by an HLA allele.

Protein genes identified by their UniProt ID that are frequently mutated in cancer include AKT1_HUMAN, BRAF_HUMAN, EGFR_HUMAN, GTF2I_HUMAN, RASH_HUMAN (also called HRAS), IDHC_HUMAN (also called IDH1), RASK_HUMAN (also called KRAS), RASN_HUMAN (also called NRAS), PIK3CA_HUMAN, PTEN_HUMAN, and P53_HUMAN (also called TP53). We describe a missense mutation in a protein by the one letter amino acid code for the wild type amino acid, the amino acid position of the mutation, and the one letter amino acid code that is present in the mutated protein. For example, KRAS G12D is a mutation in the KRAS protein of position 12 from glycine to aspartic acid (G12D). Proteins may contain multiple mutations at different positions. Herein we may refer to a gene without the "_HUMAN" suffix for conciseness KRAS gene mutations are the most frequently mutated oncogenes in cancer, but they have been very difficult to treat with small molecule therapeutics. The KRAS protein is part of a signaling pathway that controls cellular growth, and point mutations in the protein can cause constitutive pathway activation and uncontrolled cell growth. Single amino acid KRAS mutations result in minor changes in protein structure, making it difficult to engineer small molecule drugs that recognize a mutant specific binding pocket and inactivate KRAS signaling. KRAS oncogenic mutations include the mutation of position 12 from glycine to aspartic acid (G12D), glycine to valine (G12V), glycine to arginine (G12R), or glycine to cystine (G12C); or the mutation of position 13 from glycine to aspartic acid (G13D). The corresponding foreign peptides contain these mutations. KRAS is a member of the RAS family of genes that also includes HRAS and NRAS. KRAS, HRAS, and NRAS have identical sequences from residue 1 to residue 86. Thus, all of the vaccines and peptide sequences described herein for a mutation in one RAS family member can be used for the identical mutation in any other RAS family member (e.g., a KRAS G12D vaccine is also a vaccine for HRAS G12D).

Certain self-proteins, such as cancer-testis antigens, are present in cancerous cells at aberrantly high levels and thus can be targets for vaccination to induce an intolerant T cell response against cells displaying peptides derived from these self-proteins on MHC molecules. Examples of these cancer related proteins by their UniProt IDs include CTG1B_HUMAN (also known as NY-ESO-1), MAGA1_HUMAN, MAGA3_HUMAN, MAGA4_HUMAN, MAGC1_HUMAN, MAGC3_HUMAN, SSX2_HUMAN, PRAME_HUMAN, KKLC1_HUMAN (also known as CT83), PMEL_HUMAN (as known as gp100), TYRP1_HUMAN (also known as gp75), TYRP2_HUMAN (also known as DCT), and MAR1_HUMAN.

Autoimmune disorders are caused by the loss of self-tolerance by the immune system to self-proteins and are involved in autoimmune disorders such as diabetes, multiple sclerosis, and autoimmune encephalomyelitis. Induction of tolerance for autoimmune related self-peptides can be accomplished by antigen-specific tolerization using the delivery of vaccine antigens with a tolerization protocol. An example of a protocol for the induction of tolerance with a lipid-nanoparticle (LNP) encapsulated (mRNA-LNP) vaccine is described by Krienke et al., 2021 and is incorporated by reference in its entirety herein. Examples of autoimmune disease related proteins include UniProt IDs INS HUMAN (also known as insulin), and MOG_HUMAN (also known as Myelin-oligodendrocyte glycoprotein). Individuals with diabetes can suffer from a lack of tolerance to INS HUMAN, and individuals with multiple sclerosis or autoimmune encephalomyelitis can suffer from a lack of tolerance to MOG_HUMAN.

A challenge for the design of peptide vaccines is the diversity of human MHC alleles (HLA alleles) that each have specific preferences for the peptide sequences they will display. The Human Leukocyte Antigen (HLA) loci, located within the MHC, encode the HLA class I and class II molecules. There are three classical class I loci (HLA-A, HLA-B, and HLA-C) and three loci that encode class II molecules (HLA-DR, HLA-DQ, and HLA-DP). An individual's HLA type describes the alleles they carry at each of these loci. Peptides of length of between about 8 and about 11 residues can bind to HLA class I (or MHC class I) molecules whereas those of length of between about 13 and about 25 bind to HLA class II (or MHC class II) molecules (Rist et al., 2013; Chicz et al., 1992). Human populations that originate from different geographies have differing frequencies of HLA alleles, and these populations exhibit linkage disequilibrium between HLA loci that result in population specific haplotype frequencies. In some embodiments, methods are disclosed for creating effective vaccines that includes consideration of the HLA allelic frequency in the target population, as well as linkage disequilibrium between HLA genes to achieve a set of peptides that is likely to be robustly displayed.

The present disclosure provides for compositions, systems, and methods of vaccine designs that produce immunity to single or multiple targets. In some embodiments, a target is a neoantigen protein sequence, a pathogen proteome, or any other undesired protein sequence that is non-self and is expected to be bound and displayed by an HLA molecule (also referred to herein as an HLA allele). When a target is present in an individual, it may result in multiple peptide sequences that are displayed by a variety of HLA alleles. In some embodiments, it may be desirable to create a vaccine that includes selected self-peptides, and thus these selected self-peptides are considered to be the target peptides for this purpose.

The term peptide-HLA binding is defined to be the binding of a peptide to an HLA allele, and can either be computationally predicted, experimentally observed, or computationally predicted using experimental observations. The metric of peptide-HLA binding can be expressed as affinity, percentile rank, binary at a predetermined threshold, probability, or other metrics as are known in the art. The term peptide-HLA immunogenicity is defined as the activation of T cells based upon their recognition of a peptide when bound by an HLA allele. Peptide-HLA immunogenicity can vary from individual to individual, and the metric for peptide-HLA immunogenicity can be expressed as a probability, a binary indicator, or other metric that relates to the likelihood that a peptide-HLA combination will be immunogenic. In some embodiments, peptide-HLA immunogenicity is defined as the induction of immune tolerance based upon the recognition of a peptide when bound by an HLA allele. Peptide-HLA immunogenicity can be computationally predicted, experimentally observed, or computationally predicted using experimental observations. In some embodiments, peptide-HLA immunogenicity is based only upon peptide-HLA binding, since peptide-HLA binding is necessary for peptide-HLA immunogenicity. In some embodiments, peptide-HLA immunogenicity data or computational predictions of peptide-HLA immunogenicity can be included and combined with scores for peptide display in the methods disclosed herein. One way of combining the scores is using immunogenicity data for peptides assayed for immunogenicity in diseased or vaccinated individuals, and assigning peptides to the HLA allele that displayed them in the individual by choosing the HLA allele that computational methods predict has the highest likelihood of display. For peptides that are not experimentally assayed, computational predictions of display can be used. In some embodiments, different computational methods of predicting peptide-HLA immunogenicity or peptide-HLA binding can be combined (Liu et al., 2020b). For a given set of peptides and a set of HLA alleles, the term peptide-HLA hits is the number of unique combinations of peptides and HLA alleles that exhibit peptide-HLA immunogenicity or binding at a predetermined threshold. For example, a peptide-HLA hit of 2 can mean that one peptide is predicted to be bound (or trigger T cell activation) by two different HLA alleles, two peptides are predicted to be bound (or trigger T cell activation) by two different HLA alleles, or two peptides are predicted to be bound (or trigger T cell activation) by the same HLA allele. For a given set of peptides and HLA frequencies, HLA haplotype frequencies, or HLA diplotype frequencies, the expected number of peptide-HLA hits is the average number of peptide-HLA hits in each set of HLAs that represent an individual, weighted by their frequency of occurrence.

Since immunogenicity may vary from individual to individual, one method to increase the probability of vaccine efficacy is to use a diverse set of target peptides (e.g., at least two peptides) to increase the chances that some subset of them will be immunogenic in a given individual. Prior research using mouse models has shown that most MHC displayed peptides are immunogenic, but immunogenicity varies from individual to individual as described in Croft et al., (2019). In some embodiments, experimental peptide-HLA immunogenicity data are used to determine which target peptides and their modifications will be effective immunogens in a vaccine.

Considerations for the design of peptide vaccines are outlined in Liu et al., Cell Systems 11, Issue 2, p. 131-146 (Liu et al., 2020) and (Liu et al., 2020b) which are incorporated by reference in their entireties herein.

Certain target peptides may not bind with high affinity to a wide range of HLA molecules. To increase the binding of target peptides to HLA molecules, their amino acid composition can be altered to change one or more anchor residues or other residues. Anchor residues are amino acids that interact with an HLA molecule and have the largest influence on the affinity of a peptide for an HLA molecule. Peptides with altered anchor residues are called heteroclitic peptides. In some embodiments, heteroclitic peptides include target peptides with residue modifications at non-anchor positions. In some embodiments, heteroclitic peptides include target peptides with residue modifications that include unnatural amino acids and amino acid derivatives. Modifications to create heteroclitic peptides can improve the binding of peptides to both MHC class I and MHC class II molecules, and the modifications required can be both peptide and MHC class specific. Since peptide anchor residues face the MHC molecule groove, they are less visible than other peptide residues to T cell receptors. Thus, heteroclitic peptides have been observed to induce a T cell response where the stimulated T cells also respond to unmodified peptides. It has been observed that the use of heteroclitic peptides in a vaccine can improve a vaccine's effectiveness (Zirlik et al., 2006). In some embodiments, the immunogenicity of heteroclitic peptides are experimentally determined and their ability to activate T cells that also recognize the corresponding base (also called seed) peptide of the heteroclitic peptide is determined, as is known in the art. In some embodiments, these assays of the immunogenicity and cross-reactivity of heteroclitic peptides are performed when the heteroclitic peptides are displayed by specific HLA alleles.

Peptide Vaccines to Induce Immunity to One or More Targets

In some embodiments, a method is provided for formulating peptide vaccines using a single vaccine design for one or more targets. In some embodiments, a single target is a foreign protein with a specific mutation (e.g., KRAS G12D). In some embodiments, a single target is a self-protein (e.g., a protein that is overexpressed in tumor cells such as cancer/testis antigens). In some embodiments, multiple targets can be used (e.g., both KRAS G12D and KRAS G13D).

In some embodiments, the method includes extracting peptides to construct a candidate set from all target proteome sequences (e.g., entire KRAS G12D protein) as described in Liu et al., (2020).

Figure 2:
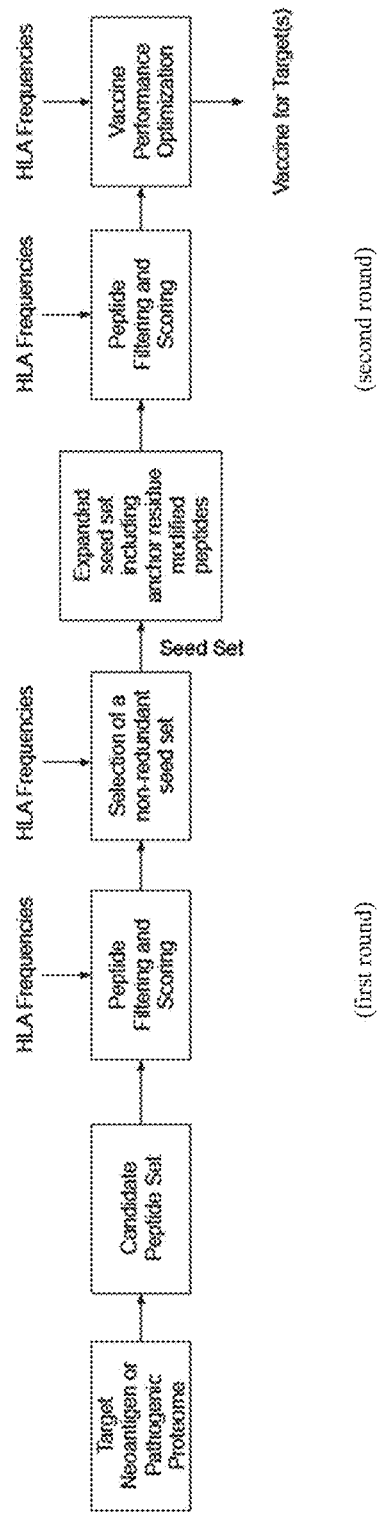
FIG. 2 is a flow chart of a vaccine optimization method with seed set compression.
Figure 3A:
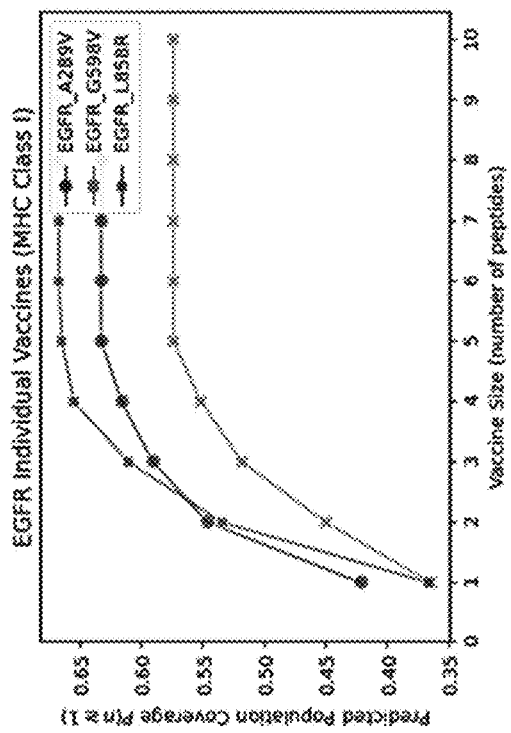
FIGS. 3A-D shows predicted population coverage for single target MHC class I vaccines by vaccine size for the mutations BRAF V600E and BRAF V600M (3A); EGFR A289V, EGRF G598V, and EGFR L858R (3B); KRAS G12D, KRAS G12V, KRAS G12R, KRAS G12C, KRAS G13D, KRAS G12A, and KRAS G12S (3C); and PIK3CA E542K, PIK3CA E545K, and PIK3CA H1047R (3D).
Figure 3C:
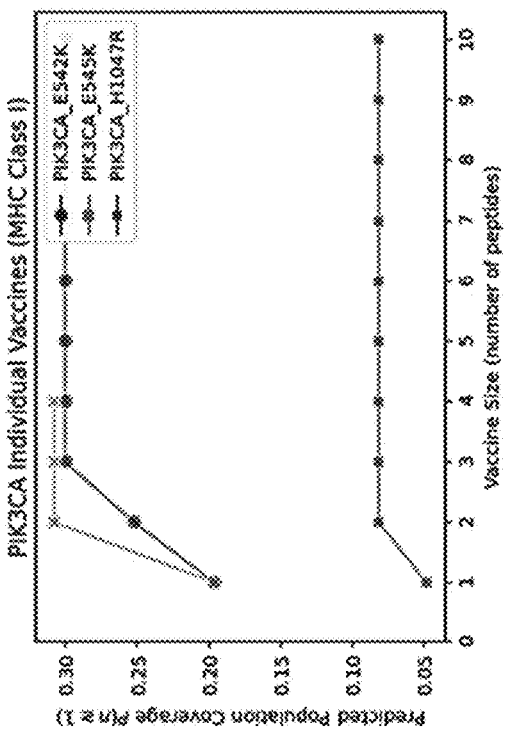
Figure 3B:
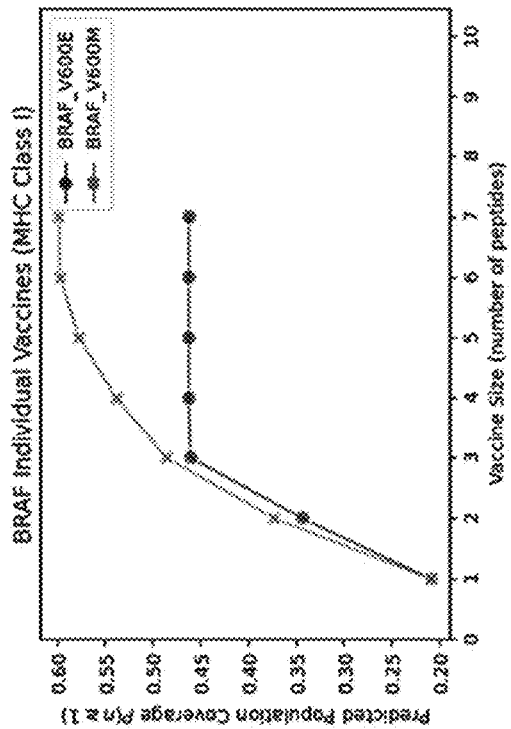
Figure 3D:
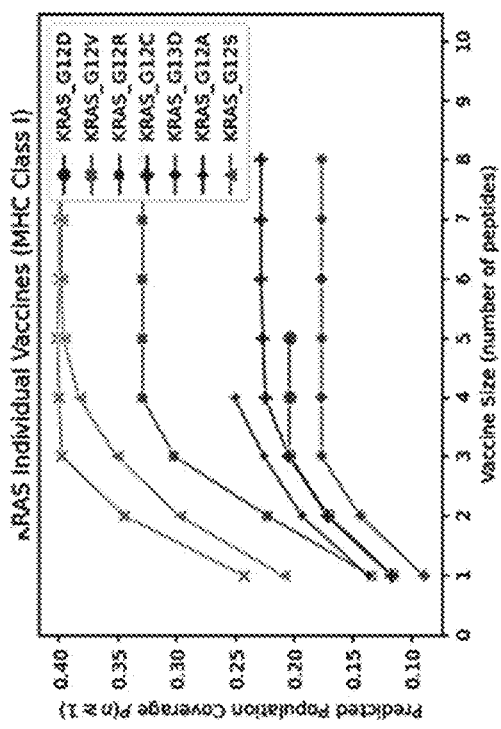

FIGS. 1 and 2 depict flow charts for example vaccine design methods that can be used for MHC class I or MHC class II vaccine design. In some embodiments, extracted target peptides are of amino acid length of between about 8 and about 10 (e.g., for MHC class I binding (Rist et al., 2013)). In some embodiments, the extracted target peptides presented by MHC class I molecules are longer than 10 amino acid residues, such as 11 residues (Trolle et al., 2016). In some embodiments, extracted target peptides are of length between about 13 and about 25 (e.g., for class II binding (Chicz et al., 1992)). In some embodiments, sliding windows of various size ranges described herein are used over the entire proteome. In some embodiments, other target peptide lengths for MHC class I and class II sliding windows can be utilized. In some embodiments, computational predictions of proteasomal cleavage are used to filter or select peptides in the candidate set. One computational method for predicting proteasomal cleavage is described by Nielsen et al., (2005). In some embodiments, peptide mutation rates, glycosylation, cleavage sites, or other criteria can be used to filter peptides as described in Liu et al., (2020). In some embodiments, peptides can be filtered based upon evolutionary sequence variation above a predetermined threshold. Evolutionary sequence variation can be computed with respect to other species, other pathogens, other pathogen strains, or other related organisms. In some embodiments, a first peptide set is the candidate set.

As shown in FIGS. 1-2, in some embodiments, the next step of the method includes scoring the target peptides in the candidate set for peptide-HLA binding to all considered HLA alleles as described in Liu et al., (2020) and Liu et al., (2020b). In some embodiments, a first peptide set is the candidate set after scoring the target peptides. Scoring can be accomplished for human HLA molecules, mouse H-2 molecules, swine SLA molecules, or MHC molecules of any species for which prediction algorithms are available or can be developed. Thus, vaccines targeted at non-human species can be designed with the method. Scoring metrics can include the affinity for a target peptide to an HLA allele in nanomolar, eluted ligand, presentation, and other scores that can be expressed as percentile rank or any other metric. The candidate set may be further filtered to exclude peptides whose predicted binding cores do not contain a particular pathogenic or neoantigen target residue of interest or whose predicted binding cores contain the target residue in an anchor position. The candidate set may also be filtered for target peptides of specific lengths, such as length 9 for MHC class I, for example. In some embodiments, scoring of target peptides is accomplished with experimental data or a combination of experimental data and computational prediction methods. When computational models are unavailable to make peptide-HLA binding predictions for particular (peptide, HLA) pairs, the binding value for such pairs can be defined by the mean, median, minimum, or maximum immunogenicity value taken over supported pairs, a fixed value (such as zero), or inferred using other techniques, including a function of the prediction of the most similar (peptide, HLA) pair available in the scoring model.

In some embodiments, a base set (also referred to as seed set herein) is constructed by selecting peptides from the scored candidate set using individual peptide-HLA binding or immunogenicity criteria (e.g., first peptide set) (FIG. 1). The criteria used for scoring peptide-HLA binding during the scoring procedure can accommodate different goals during the base set selection and vaccine design phases. For example, a target peptide with peptide-HLA binding affinities of 500 nM may be displayed by an individual that is diseased, but at a lower frequency than a target peptide with a 50 nM peptide-HLA binding affinity. During the combinatorial design phase of a vaccine, a more constrained affinity criteria may be used (e.g., when selecting a third peptide set), such a 50 nM, to increase the probability that a vaccine peptide will be found and displayed by HLA molecules. In some embodiments, a relatively less constrained threshold (e.g., less than about 1000 nM or less than about 500 nM) of peptide-HLA immunogenicity or peptide-HLA binding is used for filtering candidate peptides (the first Peptide Filtering and Scoring step in FIGS. 1 and 2) and a relatively more constrained threshold (e.g., less than about 50 nM) is used for filtering expanded set peptides (the second Peptide Filtering and Scoring step in FIGS. 1 and 2). The second threshold (second filtering step) is based on the observation that peptides that are not immunogenic enough for vaccine inclusion may be antigenic (first filtering step) and thus recognized by T cell clonotypes expanded by a vaccine. A peptide is antigenic when it is recognized by a T cell receptor and results in a response such as CD8+ T cell cytotoxicity. Derivatives of an antigenic peptide may be strongly immunogenic, included in a vaccine, and thus activate and expand T cells that recognize the antigenic peptide. The expansion of T cells that recognize an unmodified antigenic peptide can provide an immune response that contributes to disease control. In some embodiments, peptides are scored for third peptide set potential inclusion that have peptide-HLA binding affinities less than about 500 nM. In some embodiments, peptides are selected for the base set that have peptide-HLA binding affinities less than about 1000 nM. Alternatively, predictions of peptide-HLA immunogenicity can be used to qualify target peptides for base set inclusion. In some embodiments, experimental observations of the immunogenicity of peptides in the context of their display by HLA alleles or experimental observation of the binding of peptides to HLA alleles can be used to score peptides for binding to HLA alleles or peptide-HLA immunogenicity. In some embodiments, computational predictions of the immunogenicity of a peptide in the context of display by HLA alleles can used for scoring such as the methods of Ogishi et al., (2019).

In some embodiments, the method further includes running the OptiVax-Robust algorithm as described in Liu et al., (2020) using the HLA haplotype frequencies of a population on the scored candidate set to construct a base set (also referred to as seed set herein) of target peptides (FIG. 2). In some embodiments, HLA diplotype frequencies can be provided to OptiVax. OptiVax-Robust includes algorithms to eliminate peptide redundancy that arises from the sliding window approach with varying window sizes, but other redundancy elimination measures can be used to enforce minimum edit distance constraints between target peptides in the candidate set. The size of the seed set is determined by a point of diminishing returns of population coverage as a function of the number of target peptides in the seed set. Other criteria can also be used, including a minimum number of vaccine target peptides, maximum number of vaccine target peptides, and desired predicted population coverage. In some embodiments, a predetermined population coverage is less than about 0.4, between about 0.4 and 0.5, between about 0.5 and 0.6, between about 0.6 and 0.7, between about 0.7 and 0.8, between about 0.8 and 0.9, or greater than about 0.9. Another possible criterion is a minimum number of expected peptide-HLA binding hits in each individual. In alternate embodiments, the method further includes running the OptiVax-Unlinked algorithm as described in Liu et al., (2020) instead of OptiVax-Robust.

The OptiVax-Robust method uses binary predictions of peptide-HLA immunogenicity, and these binary predictions can be generated as described in Liu et al., (2020b). The OptiVax-Unlinked method uses the probability of target peptide binding to HLA alleles and can be generated as described in Liu et al., (2020). In some embodiments, OptiVax-Unlinked and EvalVax-Unlinked are used with the probabilities of peptide-HLA immunogenicity. Either method can be used for the purposes described herein, and thus the term "OptiVax" refers to either the Robust or Unlinked method. In some embodiments, the HLA haplotype or HLA allele frequencies of a population provided to OptiVax for vaccine design describe the world's population. In alternative embodiments, the HLA haplotype or HLA allele frequencies of a population provided to OptiVax for vaccine design are specific to a geographic region. In alternative embodiments, the HLA haplotype or HLA allele frequencies of a population provided to OptiVax for vaccine design are specific to an ancestry. In alternative embodiments, the HLA haplotype or HLA allele frequencies of a population provided to OptiVax for vaccine design are specific to a race. In alternative embodiments, the HLA haplotype or HLA allele frequencies of a population provided to OptiVax for vaccine design are specific to individuals with risk factors such as genetic indicators of risk, age, exposure to chemicals, alcohol use, chronic inflammation, diet, hormones, immunosuppression, infectious agents, obesity, radiation, sunlight, or tobacco use. In alternative embodiments, the HLA haplotype or HLA allele frequencies of a population provided to OptiVax for vaccine design are specific to individuals that carry certain HLA alleles. In alternative embodiments, the HLA diplotypes provided to OptiVax for vaccine design describe a single individual, and are used to design an individualized vaccine.

In some embodiments, the base (or seed) set of target peptides (e.g., first peptide set) that results from OptiVax application to the candidate set of target peptides describes a set of unmodified target peptides that represent a possible compact vaccine design (Seed Set in FIG. 2). A base peptide is a target peptide that is included in the base or seed peptide set (e.g., first peptide set). In some embodiments, the seed set (e.g., first peptide set) is based upon filtering candidate peptides by predicted or observed affinity or immunogenicity with respect to HLA molecules (Seed Set in FIG. 1). However, to improve the display of the target peptides in a wide range of HLA haplotypes as possible, some embodiments include modifications of the seed (or base) set. In some embodiments, experimental assays can be used to ensure that a modified seed (or base) peptide activates T cells that also recognize the base/seed peptide.

For a given target peptide, the optimal anchor residue selection may depend upon the HLA allele that is binding to and displaying the target peptide and the class of the HLA allele (MHC class I or class II). A seed peptide set (e.g., first peptide set) can become an expanded set by including anchor residue modified peptides of either MHC class I or II peptides (FIGS. 1-2). Thus, one aspect of vaccine design is considering how to select a limited set of heteroclitic peptides that derive from the same target peptide for vaccine inclusion given that different heteroclitic peptides will have different and potentially overlapping population coverages.

In some embodiments, all possible anchor modifications for each base set of target peptide are considered. There are typically two anchor residues in peptides bound by MHC class I molecules, typically at positions 2 and 9 for 9-mer peptides. In some embodiments, anchors for 8-mers, 10-mers, and 11-mers are found at positions 2 and n, where n is the last position (8, 10, and 11, respectively). For MHC class I molecules, the last position n is called the "C" position herein for carboxyl terminus. At each anchor position, 20 possible amino acids are attempted in order to select the best heteroclitic peptides. Thus, for MHC class I binding, 400 (i.e., 20 amino acids by 2 positions=$20^2$) minus 1 heteroclitic peptides are generated for each base target peptide. There are typically four anchor residues in peptides bound by MHC class II molecules, typically at positions 1, 4, 6, and 9 of the 9-mer binding core. Thus, for MHC class II binding there are 160,000 (i.e., 20 amino acids by 4 positions=$20^4$) minus 1 heteroclitic peptides generated for each base target peptide. In some embodiments, more than two (MHC class I) or four (MHC class II) positions are considered as anchors. Other methods, including Bayesian optimization, can be used to select optimal anchor residues to create heteroclitic peptides from each seed (or base) set peptide. Other methods are presented in "Machine learning optimization of peptides for presentation by class II MHCs" by Dai et al., (2020), incorporated in its entirety herein. In some embodiments, the anchor positions are determined by the HLA allele that presents a peptide, and thus the set of heteroclitic peptides includes for each set of HLA specific anchor positions, all possible anchor modifications.

In some embodiments, for all of the target peptides in the base/seed set, new peptide sequences with all possible anchor residue modifications (e.g., MHC class I or class II) are created resulting in a new heteroclitic base set (Expanded set in FIGS. 1-2) that includes all of the modifications. In some embodiments, anchor residue modifications of a peptide are not included in the heteroclitic base set if one or more of the peptide's anchor residue positions contains a substitution mutation that distinguishes the peptide from a self-peptide. In some embodiments, anchor residue modifications of a base/seed peptide are only included in the heteroclitic base set for peptide positions that do not contain a substitution mutation that distinguishes the base/seed peptide from a self-peptide. In some embodiments, anchor residue modifications of a peptide are not included in the heteroclitic base set when one or more of the peptide's mutations does not occur between a pair of its adjacent anchor residues. In some embodiments, for all of the target peptides in the base/seed set, new peptide sequences with anchor residue modifications (e.g., MHC class I or class II) at selected anchor locations are created resulting in a new heteroclitic base set (Expanded set in FIGS. 1-2) that includes the selected modifications. In some embodiments, the anchor residue positions used for modifying peptides are selected from anchor residue positions determined by the HLA alleles considered during vaccine evaluation. In some embodiments, the heteroclitic base set (Expanded set in FIGS. 1-2) also includes the original seed (or base) set (Seed Peptide Set in FIGS. 1-2). In some embodiments, the heteroclitic base set includes amino acid substitutions at non-anchor residues. In some embodiments, modifications of base peptide residues is accomplished to alter binding to T cell receptors to improve therapeutic efficacy (Candia, et al., 2016). In some embodiments, the heteroclitic base set includes amino acid substitutions of non-natural amino acid analogs. The heteroclitic base set is scored for HLA affinity, peptide-HLA immunogenicity, or other metrics as described herein (another round of Peptide Filtering and Scoring as shown in FIGS. 1-2). In some embodiments, the scoring predictions may be further updated for pairs of heteroclitic peptide and HLA allele, eliminating pairs where a heteroclitic peptide is predicted to be displayed by an allele but the seed (or base) peptide from which it was derived is not predicted to be displayed by the allele. The scoring predictions may also be filtered to ensure that predicted binding cores of the heteroclitic peptide displayed by a particular HLA allele align exactly in position with the binding cores of the respective seed (or base) set target peptide for that HLA allele. In some embodiments, the scoring predictions are filtered for an HLA allele to ensure that the heteroclitic peptides considered for that HLA allele are only modified at anchor positions determined by that HLA allele. Scoring produces a metric of peptide-HLA immunogenicity for peptides and HLA alleles that can be either binary, a probability of immunogenicity, or other metric of immunogenicity such as peptide-HLA affinity or percent rank, and can be based on computational predictions, experimental observations, or a combination of both computational predictions and experimental observations. In some embodiments, probabilities of peptide-HLA immunogenicity are utilized by OptiVax-Unlinked. In some embodiments, heteroclitic peptides are included in experimental assays such as MIRA (Klinger et al., 2015) to determine their immunogenicity with respect to specific HLA alleles. In some embodiments, the methods of Liu et al., (2020b), can be used to incorporate MIRA data for heteroclitic peptides into a model of peptide-HLA immunogenicity. In some embodiments, the immunogenicity of heteroclitic peptides are experimentally determined and their ability to activate T cells that also recognize the corresponding seed (or base) peptide of the heteroclitic peptide is performed as is known in the art to qualify the heteroclitic peptide for vaccine inclusion. In some embodiments, these assays of the immunogenicity and cross-reactivity of heteroclitic peptides are performed when the heteroclitic peptides are displayed by specific HLA alleles. In some embodiments, computational predictions of the immunogenicity of a heteroclitic peptide in the context of display by HLA alleles can used for scoring such as the methods of Ogishi et al., (2019). In some embodiments, a peptide in the heteroclitic base set is removed if (1) one of its anchor positions for an HLA allele corresponds to the location of a mutation in the base/seed peptide from which it was derived that distinguishes the base/seed peptide from a self-peptide, and (2) if the peptide-HLA binding or peptide-HLA immunogenicity of the self-peptide is stronger than a specified threshold for self-peptide binding or immunogenicity. This eliminates peptides in the heteroclitic base set that may cross-react with self-peptides as a result of sharing TCR facing residues with self-peptides. In some embodiments, the threshold for self-peptide binding is between approximately 500 nM to 1000 nM.

In some embodiments, redundant peptides in the heteroclitic base set are removed. In some embodiments, a redundant peptide is a first heteroclitic peptide that has peptide-HLA immunogenicity scores or peptide-HLA binding scores that are less immunogenic for all scored HLAs than a second heteroclitic peptide in the heteroclitic base set, where both the first and second heteroclitic peptides are derived from the same base (or seed) peptide. In some embodiments, peptide redundancy is determined by only comparing peptide-HLA immunogenicity scores or peptide-HLA binding scores for HLA alleles where the peptide-HLA immunogenicity scores or peptide-HLA binding scores for both peptides for an HLA allele are more immunogenic than a given threshold (e.g., 50 nM for binding). In some embodiments, a redundant peptide is a first heteroclitic peptide that has an average peptide-HLA immunogenicity score or peptide-HLA binding score that is less immunogenic than the average peptide-HLA immunogenicity score or peptide-HLA binding score of a second heteroclitic peptide in the heteroclitic base set, where both the first and second heteroclitic peptides are derived from the same base (or seed) peptide, and the average scores are computed for HLA alleles where the peptide-HLA immunogenicity scores or peptide-HLA binding scores for both peptides for an HLA allele are more immunogenic than a given threshold (e.g., 50 nM for binding). In some embodiments, a redundant peptide is a first heteroclitic peptide that has a weighted peptide-HLA immunogenicity score or peptide-HLA binding score that is less immunogenic than the weighted peptide-HLA immunogenicity score or peptide-HLA binding score of a second heteroclitic peptide in the heteroclitic base set, where both the first and second heteroclitic peptides are derived from the same base (or seed) peptide, and where the weighting is determined by the frequency of the HLA allele in a human population, and the weighted scores are computed for HLA alleles where the peptide-HLA immunogenicity scores or peptide-HLA binding scores for both peptides for an HLA allele are more immunogenic that a given threshold (e.g., 50 nM for binding).

In some embodiments, the next step involves filtering the heteroclitic base set (the second peptide set) to create a filtered second peptide set by comparing the peptide-HLA immunogenicity scores or peptide-HLA binding scores of the peptides for one or more HLA alleles to a threshold. In some embodiments, an affinity criterion of about 50 nM is used to increase the probability that a vaccine peptide will be found and displayed by HLA molecules. In some embodiments, the affinity criteria is more constrained than 50 nM. In some embodiments, the affinity criteria is more constrained than about 500 nM.

In some embodiments, the next step involves inputting the filtered second peptide set to OptiVax to select a compact set of vaccine peptides that maximizes predicted vaccine performance (Vaccine Performance Optimization; FIGS. 1-2). In some embodiments, predicted vaccine performance is a function of expected peptide-HLA binding affinity (e.g., a function of the distribution of peptide-HLA binding affinities across all peptide-HLA combinations for a given peptide set, or weighted by the occurrence of the HLA alleles in a population or individual). In some embodiments, predicted vaccine performance is the expected population coverage of a vaccine. In some embodiments, predicted vaccine performance is the expected number peptide-HLA hits produced by a vaccine in a population or individual. In some embodiments, predicted vaccine performance requires a minimum expected number of peptide-HLA hits (e.g., 1, 2, 3, 4, 5, 6, 7, 8, or more) produced by a vaccine. In some embodiments, predicted vaccine performance is a function of population coverage and expected number of peptide-HLA hits desired produced by a vaccine. In some embodiments, predicted vaccine performance is a metric that describes the overall immunogenic properties of a vaccine where all of the peptides in the vaccine are scored for peptide-HLA immunogenicity for two or more HLA alleles (e.g., three or more HLA alleles). In some embodiments, predicted vaccine performance excludes immunogenicity contributions by selected HLA alleles above a maximum number of peptide-HLA hits (e.g., 1, 2, 3, 4, 5, 6, 7, 8, or more). In some embodiments, predicted vaccine performance excludes immunogenicity contributions of individual HLA diplotypes above a maximum number of peptide-HLA hits (e.g., 1, 2, 3, 4, 5, 6, 7, 8, or more). In some embodiments, predicted vaccine performance is the fraction of covered HLA alleles, which is the expected fraction of HLA alleles in each individual that have a minimum number of peptides (e.g., 1, 2, 3, 4, 5, 6, 7, 8, or more) with predicted peptide-HLA immunogenicity produced by a vaccine. In some embodiments, predicted vaccine performance is the expected fraction of HLA alleles in a single individual that have a minimum number of peptides (e.g., 1, 2, 3, 4, 5, 6, 7, 8, or more) with predicted peptide-HLA immunogenicity produced by a vaccine.

In some embodiments, a vaccine is designed by the iterative selection of peptides from the heteroclitic base set (also referred to as Expanded set as shown in FIGS. 1-2) at progressively less stringent criteria for predicted peptide immunogenicity or display. In some embodiments, OptiVax is first used to design a vaccine with a desired vaccine performance with specific peptide qualification criteria (e.g., seed peptides from the candidate set must bind to MHC molecules at 500 nM or stronger, and peptides from the expanded set must bind to MHC molecules at 50 nM or stronger). The vaccine that results from this application of OptiVax is then used as the foundation for vaccine augmentation with less stringent criteria (e.g., seed peptides from the candidate set must bind to MHC molecules at 1000 nM or stronger, and peptides from the expanded set must bind to MHC molecules at 100 nM or stronger) to further improve the desired vaccine performance. Methods for vaccine augmentation are described in Liu et al., (2020b), incorporated by reference in its entirety herein. In some embodiments, multiple rounds of vaccine augmentation may be utilized. In some embodiments, the final augmented vaccine is the one selected.

In some embodiments, selection of peptide sets to meet a desired predicted vaccine performance can be accomplished by computational algorithms other than OptiVax. In some embodiments, integer linear programming or mixed-integer linear programming is employed for selecting peptide sets instead of OptiVax. One example of an integer programming method for peptide set selection is described by Toussaint et al., 2008, incorporated by reference in its entirety herein. An example solver for mixed-integer linear programming is Python-MIP than can be used in conjunction with Toussaint et al., 2008.

Predicted vaccine performance refers to a metric. Predicted vaccine performance can be expressed as a single numerical value, a plurality of numerical values, any number of non-numerical values, and a combination thereof. The value or values can be expressed in any mathematical or symbolic term and on any scale (e.g., nominal scale, ordinal scale, interval scale, or ratio scale).

A seed (or base) peptide and all of the modified peptides that are derived from that seed (or base) peptide comprise a single peptide family. In some embodiments, in the component of vaccine performance that is based on peptide-HLA immunogenicity for a given HLA allele, a maximum number of peptides (e.g., 1, 2, 3, 4, 5, 6, 7, 8, or more) that are in the same peptide family are given computational immunogenicity credit for that HLA allele. This limit on peptide family immunogenicity limits the credit caused by many modified versions of the same base peptide. In some embodiments, the methods described herein are included for running OptiVax with an EvalVax objective function that corresponds to a desired metric of predicted vaccine performance. In some embodiments, population coverage means the proportion of a subject population that presents one or more immunogenic peptides that activate T cells responsive to a seed (or base) target peptide. The metric of population coverage is computed using the HLA haplotype frequency in a given population such as a representative human population. In some embodiments, the metric of population coverage is computed using marginal HLA frequencies in a population. Maximizing population coverage means selecting a peptide set (either a base peptide set, a modified peptide set, or a combination of base and modified peptides; e.g., a first peptide set, second peptide set, or third peptide set) that collectively results in the greatest fraction of the population that has at least a minimum number (e.g., 1, 2, 3, 4, 5, 6, 7, 8, or more) of immunogenic peptide-HLA bindings based on proportions of HLA haplotypes in a given population (e.g., representative human population). In some embodiments, this process includes the OptiVax selection of heteroclitic peptides (as described in this disclosure) that activate T cells that respond to their corresponding seed (or base) peptide and the heteroclitic base peptides to improve population coverage. In some embodiments, the seed (or base) target peptides are always included in the final vaccine design. In some embodiments, peptides are only considered as candidates for a vaccine design (e.g., included in a first, second, and/or third peptide set) if they have been observed to be immunogenic in clinical data, animal models, or tissue culture models.

Although heteroclitic peptides are used as exemplary embodiments in this disclosure, any modified peptide could be used in place of a heteroclitic peptide. A modified peptide is a peptide that has one or more amino acid substitutions of a target base/seed peptide. The amino acid substitution could be located at an anchor position or any other non-anchor position.

In some embodiments, a candidate vaccine peptide (e.g., a base peptide or a modified peptide) is eliminated from vaccine inclusion if it activates T cells that recognize self-peptides (e.g., this can be achieved at the first and/or second round of Peptide Filtering and Sorting as shown in FIGS. 1-2). In some embodiments, a candidate vaccine peptide (e.g., a base peptide or a modified peptide) is computationally eliminated from vaccine inclusion if its outward facing amino acids when bound by an HLA allele are similar to outward facing self-peptide residues that are presented by the same HLA allele, where similarity can be defined by identity or defined similarity metrics such as BLOSUM matrices (BLOSUM matrices are known in the art). Testing a vaccine peptide for its ability to activate T cells that recognize self-peptides can be experimentally accomplished by the vaccination of animal models followed by ELISPOT or other immunogenicity assay or with human tissue protocols. In both cases, models with HLA alleles that present the vaccine peptide are used. In some embodiments, human primary blood mononuclear cells (PBMCs) are stimulated with a vaccine peptide, the T cells are allowed to grow, and then T cell activation with a self-peptide is assayed as described in Tapia-Calle et al., (2019) or other methods as known in the art. In some embodiments, the vaccine peptide is excluded from vaccine inclusion if the T cells are activated by the self-peptide. In some embodiments, computational predictions of the ability of a peptide to activate T cells that also recognize self-peptides can be utilized. These predictions can be based upon the modeling of the outward facing residues from the peptide-HLA complex and their interactions with other peptide residues. In some embodiments, a candidate vaccine peptide (e.g., a base peptide or a modified peptide) is eliminated from vaccine inclusion or experimentally tested for cross-reactivity if it is predicted to activate T cells that also recognize self-peptides based upon the structural similarity of the peptide-MHC complex of the candidate peptide (e.g., a base peptide or a modified peptide) and the peptide-MHC complex of a self-peptide. One method for the prediction of peptide-MHC structure is described by Park et al., (2013).

In some embodiments, a candidate heteroclitic vaccine peptide (e.g., a modified peptide) is eliminated from vaccine inclusion if it does not activate T cells that recognize its corresponding base/seed target peptide (second round of Peptide Filtering and Scoring, FIGS. 1-2). Testing a candidate heteroclitic peptide (e.g., a modified peptide) for its ability to activate T cells that recognize its corresponding seed (or base) target peptide with respect to the same HLA allele can be experimentally accomplished by the vaccination of animal models followed by ELISPOT or other immunogenicity assay or with human tissue protocols. In both cases, models with HLA alleles that present the heteroclitic peptide are used. In some embodiments, human PBMCs are stimulated with the heteroclitic peptide, the T cells are allowed to grow, and then T cell activation with the seed (or base) target peptide is assayed as described in Tapia-Calle et al., (2019) or using other methods known in the art. In some embodiments, computational predictions of the ability of a heteroclitic peptide to activate T cells that also recognize the corresponding seed (or base) target peptide can be utilized. These predictions can be based upon the modeling of the outward facing residues from the peptide-HLA complex and their interactions with other peptide residues. In some embodiments, the structural similarity of the peptide-HLA complex of a heteroclitic peptide and the peptide-HLA complex of the corresponding seed (or base) target is used to qualify heteroclitic peptides for vaccine inclusion or to require experimental immunogenicity testing before vaccine inclusion.

TCR Interface Divergence (TCRID) is the Least Root Mean Square Deviation of the difference between a first peptide's TCR facing residues' 3D positions and the corresponding residue positions of a second peptide with respect to a specific HLA allele. In some embodiments, TCRID is used to predict if two peptides when displayed by a given HLA allele will activate the same T cell clonotypes. In some embodiments, FlexPepDock (London et al., 2011, incorporated by reference in its entirety herein) or DINC (Antunes et al., 2018, incorporated by reference in its entirety herein) in conjunction with the crystal structures of HLA molecules can be used to compute TCRID metrics for pairs of peptides given an HLA molecule. In some embodiments, TCRID is computed by (1) determining the 3D peptide-HLA structures for two different peptides bound by a specific HLA allele, (2) aligning the HLA alpha helices of the peptide-HLA structures, and (3) computing the Least Root Mean Square Deviation of the difference between the TCR facing residues of the two peptides with respect to the aligned alpha helix reference frame.

In some embodiments, the second peptide filtering and scoring step in FIGS. 1 and 2 will zero the peptide-HLA binding or immunogenicity score for a heteroclitic peptide for a specific HLA allele when the HLA specific TCRID between the heteroclitic peptide and its corresponding base (or seed) peptide from which it was derived is over a first TCRID threshold. In some embodiments, the second peptide filtering and scoring step in FIGS. 1 and 2 will zero the peptide-HLA binding or immunogenicity score for a heteroclitic peptide for a specific HLA allele when the HLA specific TCRID between the heteroclitic peptide and its corresponding unmutated self-peptide from which it was derived is under a second TCRID threshold. In some embodiments, the first peptide filtering and scoring step in FIGS. 1 and 2 will zero the peptide-HLA binding or immunogenicity score for a candidate peptide and an HLA allele when the HLA specific TCRID between the peptide and its corresponding unmutated self-peptide is under a third TCRID threshold. In some embodiments, any of the TCRID thresholds are determined by experimentally observing or computationally predicting the cross-reactivity of TCR molecules to peptide-HLA complexes.

Figure 4A:
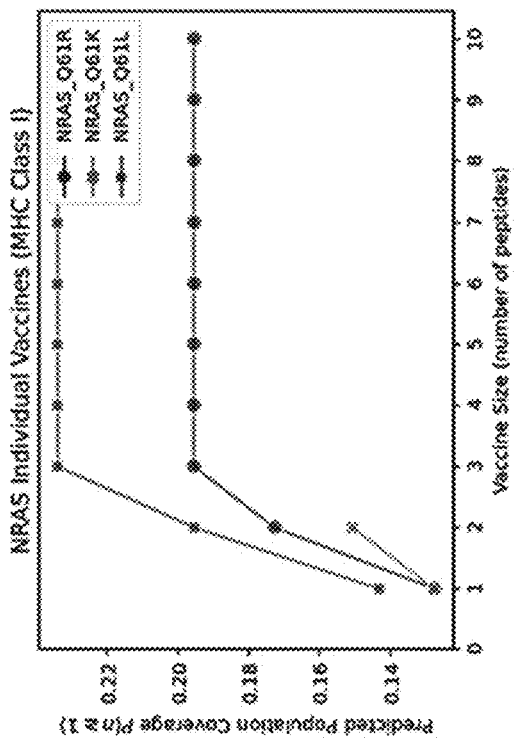
FIGS. 4A-C shows predicted population coverage for single target MHC class I vaccines by vaccine size for the mutations IDH1 R132H and IDH1 R132C (4A); NRAS Q61R, NRAS Q61K, and NRAS Q61L (4B); and TP53 R158L, TP53 R175H, TP53 R248Q, TP53 R273C, and TP53 R273H (4C).
Figure 4B:
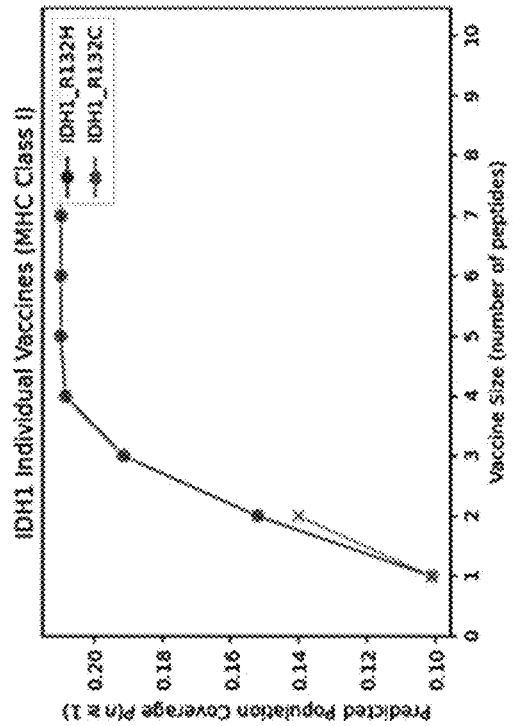
Figure 4C:
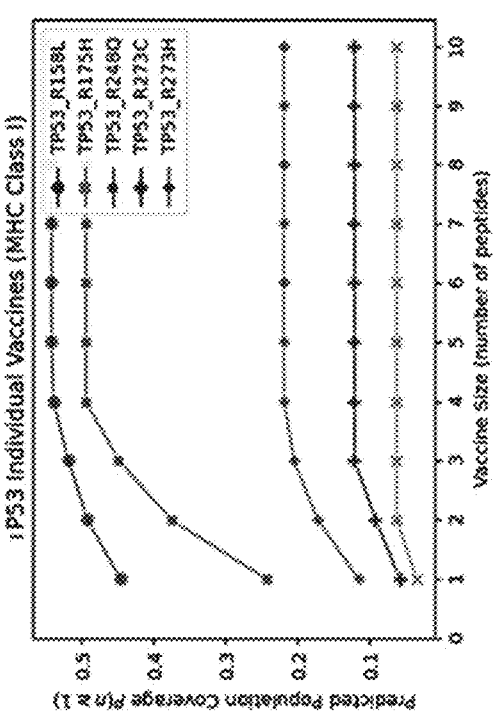
Figure 5A:
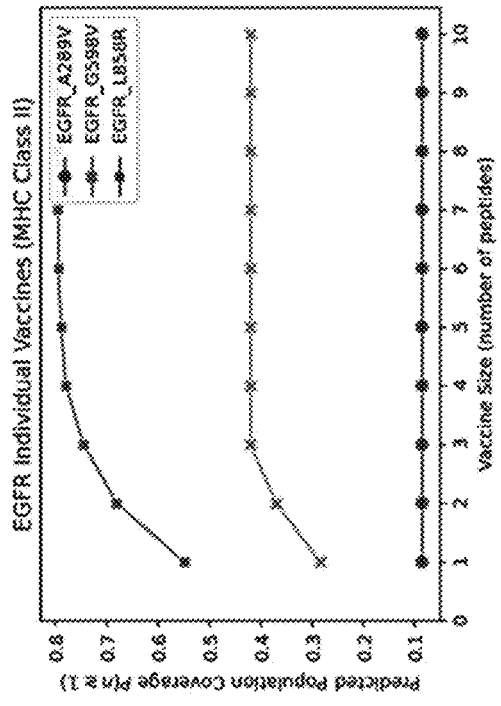
FIGS. 5A-D shows predicted population coverage for single target MHC class II vaccines by vaccine size for the mutations BRAF V600E and BRAF V600M (5A); EGFR A289V, EGRF G598V, and EGFR L858R, (5B); KRAS G12D, KRAS G12V, KRAS G12R, KRAS G12C, KRAS G13D, KRAS G12A, and KRAS G12S (5C); and PIK3CA E542K, PIK3CA E545K, and PIK3CA H1047R (5D).
Figure 5C:
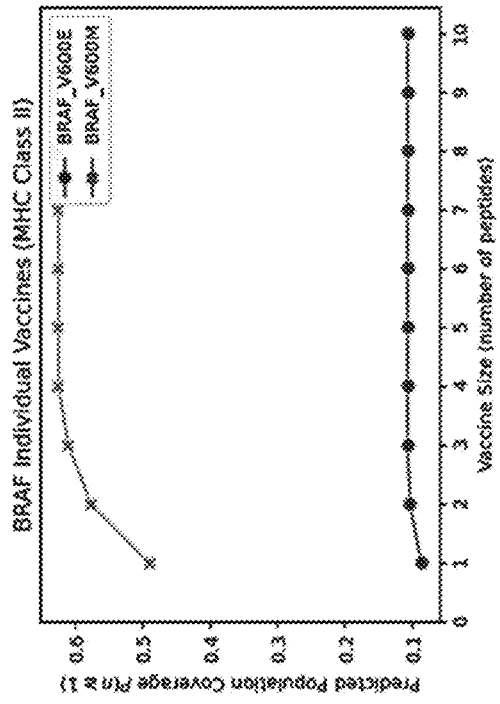
Figure 5B:
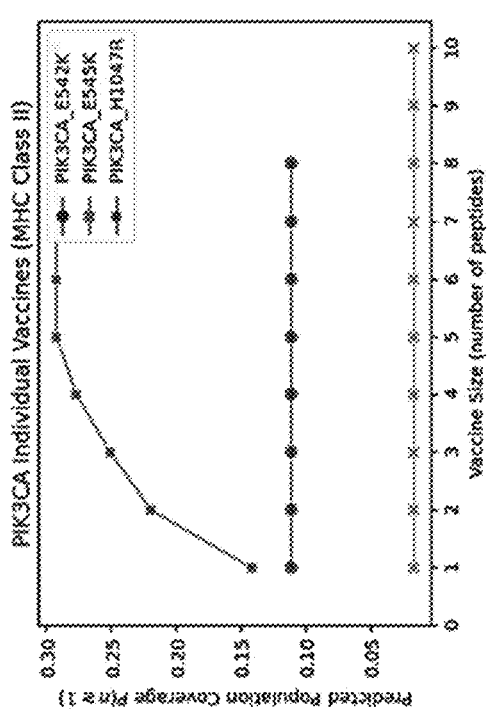
Figure 5D:
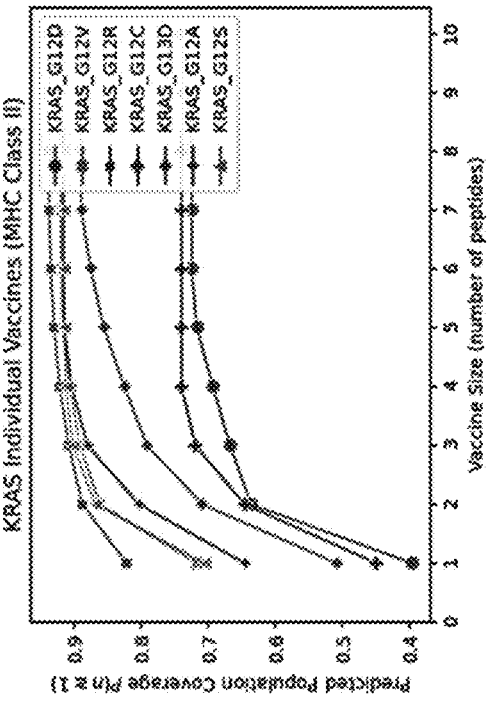
Figure 6A:
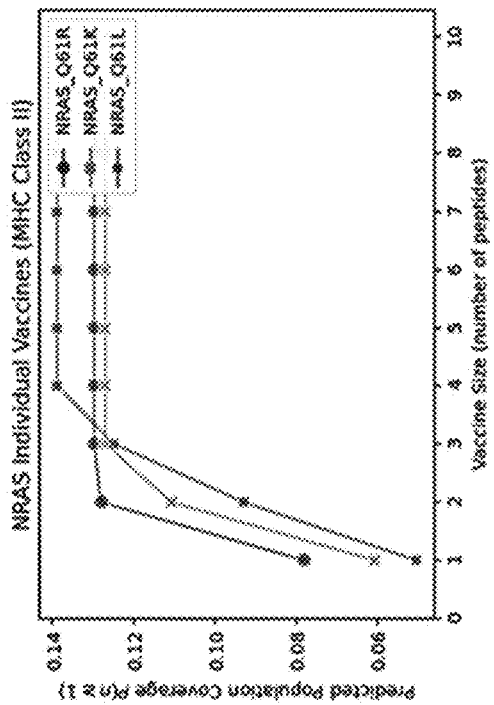
FIGS. 6A-C shows predicted population coverage for single target MHC class II vaccines by vaccine size for the mutations IDH1 R132H and IDH1 R132C (6A); NRAS Q61R, NRAS Q61K, and NRAS Q61L (6B); and TP53 R158L, TP53 R175H, TP53 R248Q, TP53 R273C, and TP53 R273H (6C).
Figure 6C:
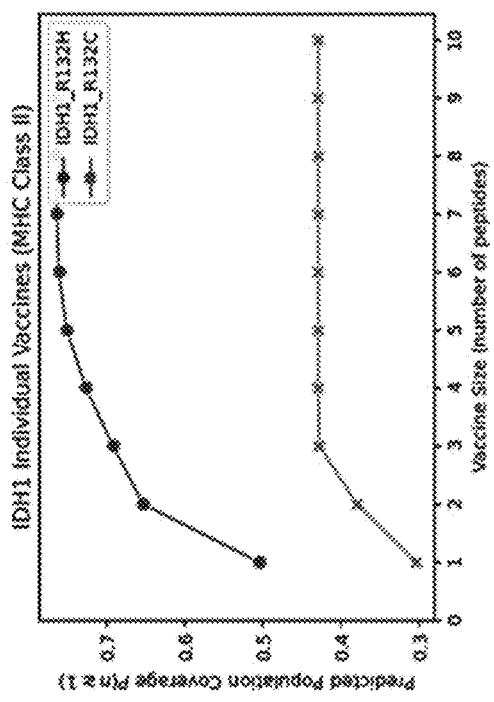
Figure 6B:
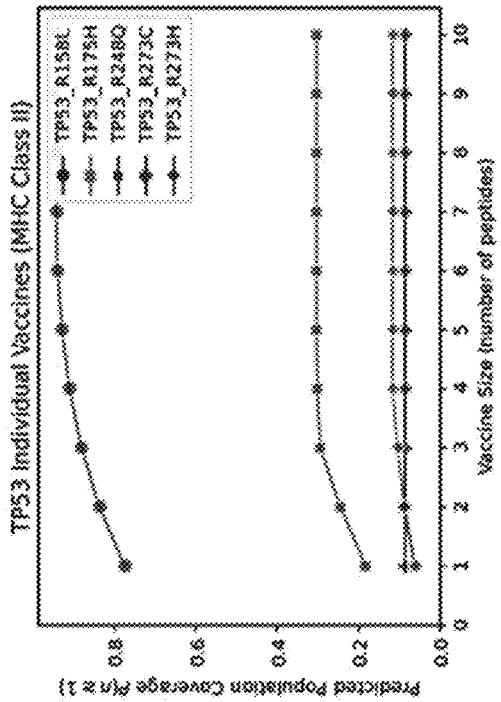

FIGS. 3 and 4 (MHC class I) and FIGS. 5 and 6 (MHC class II) show the predicted population coverage of OptiVax-Robust selected single target-specific vaccines with differing number of peptides designed for the mutations BRAF V600E, BRAF V600M, EGFR A289V, EGRF G598V, EGFR L858R, IDH1 R132H, IDH1 R132C, NRAS Q61R, NRAS Q61K, NRAS Q61L, KRAS G12D, KRAS G12V, KRAS G12R, KRAS G12C, KRAS G13D, KRAS G12A, KRAS G12S, PIK3CA E542K, PIK3CA E545K, PIK3CA H1047R, TP53 R158L, TP53 R175H, TP53 R248Q, TP53 R273C, and TP53 R273H. FIGS. 3-6 show that as the number of peptides increases for a vaccine, its predicted population coverage increases. The population coverage shown in FIGS. 3-6 are of those individuals that have the specific mutation that the vaccine is designed to cover. An increase in peptide count will also typically cause the average number of peptide-HLA hits in each individual to increase within the population.

OptiVax can be used to design a vaccine to maximize the fraction/proportion of the population whose HLA molecules are predicted to bind to and display at least p peptides from the vaccine. In some embodiments, this prediction (e.g., scoring) includes experimental immunogenicity data to directly predict at least p peptides will be immunogenic. The number p is input to OptiVax, and OptiVax can be run multiple times with varying values for p to obtain a predicted optimal target peptide set for different peptide counts p. Larger values of p will increase the redundancy of a vaccine at the cost of more peptides to achieve a desired population coverage. In some embodiments, it may not be possible to achieve a given population coverage given a specific heteroclitic base set. In some embodiments, the number p is a function of the desired size of a vaccine.

The methods described herein can be used to design separate vaccine formulations for MHC class I and class II based immunity.

In some embodiments, this procedure is used to create a vaccine for an individual. In some embodiments, the target peptides present in the individual are determined by sequencing the individual's tumor RNA or DNA, and identifying mutations that produce foreign peptides. One embodiment of this method is described in U.S. Pat. No. 10,738,355, incorporated in its entirety herein. In some embodiments, peptide sequencing methods are used to identify target peptides in the individual. One embodiment of this is described in U.S. Publication No.: 2011/0257890. In some embodiments, the target peptides used for the individual's vaccine are selected when a self-peptide, foreign peptide, or RNA encoding a self-peptide or foreign peptide is observed in a specimen from the individual is present at a predetermined level. The target peptides in the individual are used to construct a vaccine as described in the disclosure herein. For vaccine design, OptiVax is provided a diplotype comprising the HLA type of the individual. In an alternative embodiment, the HLA type of an individual is separated into multiple diplotypes with frequencies that sum to one, where each diplotype comprises one or more HLA alleles from the individual and a notation that the other allele positions should not be evaluated. The use of multiple diplotypes will cause OptiVax's objective function to increase the chance that immunogenic peptides will be displayed by all of the constructed diplotypes. This achieves the objective of maximizing the number of distinct HLA alleles in the individual that exhibit peptide-HLA immunogenicity and thus improves the allelic coverage of the vaccine in the individual.

Figure 14:
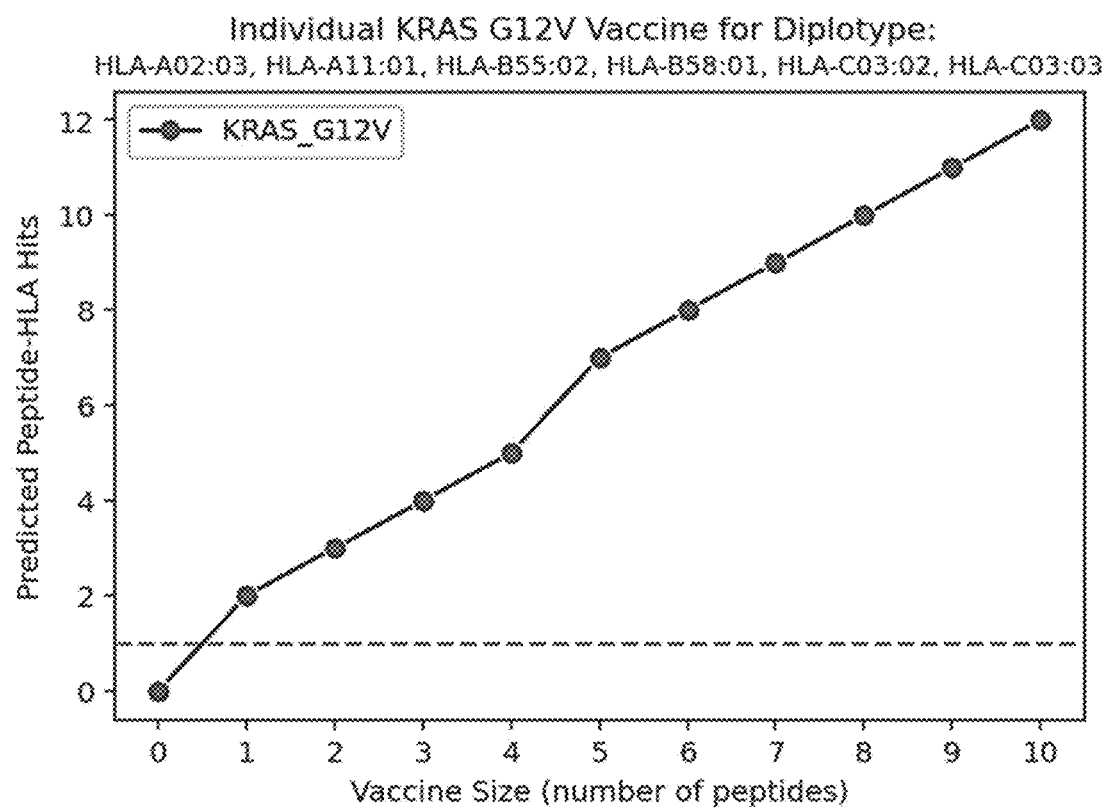
FIG. 14 shows predicated peptide-HLA hits by vaccine size for a KRAS G12V vaccine for the HLA diplotype HLA-A02:03, HLA-A11:01, HLA-B55:02, HLA-B58:01, HLA-C03:02, HLA-C03:03.

FIG. 14 shows the predicted vaccine performance (predicted number of peptide-HLA hits) of ten example G12V MHC class I vaccines for a single individual with the MHC class I HLA diplotype HLA-A02:03, HLA-A11:01, HLA-B55:02, HLA-B58:01, HLA-C03:02, HLA-C03:03. OptiVax was used to design ten G12V MHC class I vaccines for this HLA diplotype with peptide counts ranging from 1 to 10. For the results in FIG. 14, OptiVax was run with six synthetic diplotypes, each equally weighted, each with one HLA allele from the individual's HLA diplotype, and the other allele positions marked to not be evaluated. The 10 peptide vaccine in FIG. 14 comprises SEQ ID NO: 203 (LMVVGAVGV), SEQ ID NO: 208 (GAVGVGKSL), SEQ ID NO: 209 (GPVGVGKSA), SEQ ID NO: 213

(GPVGVGKSV), SEQ ID NO: 11036 (LMVVGAVGI), SEQ ID NO: 11037 (LMVVGAVGL), SEQ ID NO: 11095 (VTGAVGVGK), SEQ ID NO: 11122 (GAVGVGKSM), SEQ ID NO: 11457 (VAGAVGVGM), and SEQ ID NO: 11737 (VVGAVGVGK). Two peptides, SEQ ID NO: 208 (GAVGVGKSL) and SEQ ID NO: 11122 (GAVGVGKSM), are predicted to each bind two of the HLA alleles with an affinity of 50 nM or less.

MHC Class I Vaccine Design Procedure

In some embodiments, MHC class I vaccine design procedures consist of the following computations steps.

In some embodiments, the inputs for the computation are:
- $P_{1...n}$: Peptide sequence (length n) containing the neoantigen or pathogenic target(s) of interest (e.g., KRAS G12D, KRAS G12V, KRAS G12R, KRAS G12C, KRAS G13D). $P_i$ denotes the amino acid at position i.
- t: Position of target mutation in P, $t \in [1, \ldots n]$ (e.g., t=12 for KRAS G12D).
- s: Substitution mutation $s \in$ [true, false] is true if the mutation is a substitution, and false if the mutation is a deletion or insertion or the peptide does not contain a mutation. When the mutation is a deletion or insertion then t indicates the position immediately before the deletion or insertion.
- $\tau_1$: Threshold for potential presentation of peptides by MHC for peptide-MHC scoring (e.g., 500 nM binding affinity)
- $\tau_2$: Threshold for predicted display of peptides by MHC for peptide-MHC scoring (e.g., 50 nM binding affinity)
- $\mathcal{H}$: Set of HLA alleles (for HLA-A, HLA-B, HLA-C loci)
- F: $\mathcal{H}^3 \to \mathbb{R}$: Population haplotype frequencies (for OptiVax optimization and coverage evaluation).
- $N$: Parameter for EvalVax and OptiVax objective function. Specifies minimum number of predicted per-individual hits for population coverage objective to consider the individual covered. Default=1 (computes $P(n \geq 1)$ population coverage).

In some embodiments, Peptide-HLA Scoring Functions used are:
- ScorePotential: $P \times \mathcal{H} \to \mathbb{R}$: Scoring function mapping a (peptide, HLA allele) pair to a prediction of peptide-HLA display. If predicted affinity $\leq \tau_1$, then returns 1, else returns 0. Options include MHCflurry, NetMHCpan, PUFFIN, ensembles, or alternative metrics or software may be used, including models calibrated against immunogenicity data.
- ScoreDisplay: $P \times \mathcal{H} \to \mathbb{R}$: Scoring function mapping a (peptide, HLA allele) pair to a prediction of peptide-HLA display. If predicted affinity $\leq \tau_2$, then returns 1, else returns 0. Options include MHCflurry, NetMHCpan, PUFFIN, ensembles, or alternative metrics or software may be used, including models calibrated against immunogenicity data.

Next, from the seed protein sequence (P), a set $\mathcal{P}$ of windowed native peptides spanning the protein sequence(s) is constructed. $P_{j...j+(k-1)}$ only produces set members when the subscripts are within the range of the defined seed protein P. In some embodiments, 8-mers, 9-mers, 10-mers, and 11-mers are produced, but this process can be performed with any desired window lengths and the resulting peptide sets combined. In some embodiments, only 9-mers are produced.

$$\mathcal{P} = \bigcup_{k \in [8,\ldots,11]} \mathcal{P}_k$$

$$\mathcal{P}_k = \{P_{j\ldots j+(k-1)} \mid j \in [t-(k-1), \ldots, t], \text{ if } s \text{ then } j \neq \{t-(k-1), t-1\}\}$$

The second condition $j \neq \{t-(k-1), t-1\}$ excludes peptides where the mutation at t is in positions P2 or Pk of the windowed k-mer peptide (i.e., the anchor positions) and the mutation is a substitution.

Next, each peptide sequence in $\mathcal{P}$ is scored against all HLA alleles in $\mathcal{H}$ for potential presentation using ScorePotential (with threshold $\tau_1$=500 nM) and store results in a $|\mathcal{P} \times \mathcal{H}|$ matrix S:

$$S[p,h] = \text{ScorePotential}(p,h) \forall p \in \mathcal{P}, \in \mathcal{H}$$

Note that S is a binary matrix where 1 indicates the HLA is predicted to potentially present the peptide, and 0 indicates no potential presentation.

Define Base Set of Peptides $B \subseteq \mathcal{P}$:

$$B = \{p \in \mathcal{P} \mid \exists h \text{ s.t. } S[p,h]=1\}$$

Thus, B contains the native peptides that are predicted to be potentially presented by at least 1 HLA.

Create a Set of all Heteroclitic Peptides B' Stemming from Peptides in B:

$$B' = \bigcup_{b \in B} \text{ANCHOR-MODIFIED}(b)$$

where ANCHOR-MODIFIED(b) returns a set of all 399 anchor-modified peptides stemming from b (with all possible modifications to the amino acids at P2 and P9).

Next, all heteroclitic candidate peptides (e.g., modified peptides) in B' are scored against all HLA alleles in $\mathcal{H}$ for predicted display using ScoreDisplay (with threshold $\tau_2$=50 nM), and store results in binary $|B'| \times \mathcal{H}|$ matrix $S_1'$:

$$S_1'[b',h] = \text{ScoreDisplay}(b',h) \forall b' \in B', h \in \mathcal{H}$$

Next, an updated scoring matrix $S_2'$ is computed for heteroclitic peptides conditioned on the potential presentation of the corresponding base peptides by each HLA:

$$S_2'[b', h] = \begin{cases} S_1'[b', h], & \text{if } S[b, h] = 1 \\ 0, & \text{otherwise} \end{cases} \forall b' \in B', h \in \mathcal{H}$$

where each heteroclitic peptide $b' \in B'$ is a mutation of base peptide $b \in B$. This condition enforces that if h was not predicted to potentially present b, then all heteroclitic peptides b' derived from b will not be displayed by h (even if h would otherwise be predicted to display b').

In some embodiments, OptiVax-Robust is used to design a final peptide set (e.g., third peptide set) from the union of base peptides and heteroclitic peptides $B \cup B'$ (with corresponding scoring matrices S and $S_2'$ for B and B', respectively). Let $\mathcal{V}_k$ denote the compact set of vaccine peptides output by OptiVax containing k peptides. Note that $\mathcal{V}_{k+1}$ is not necessarily a superset of $\mathcal{V}_k$. (In alternate embodiments, OptiVax can be used to augment the base set B with peptides from B' using scoring matrix $S_2'$ to return set $\mathcal{A}_k$, and the final vaccine set $\mathcal{V}_{k+|B|}$ consists of peptides $B \cup \mathcal{A}_k$)

In some embodiments, this procedure is repeated independently for each target of interest, and the resulting independent vaccine sets can be merged into a combined vaccine as described below.

MHC Class II Vaccine Design Procedure

In some embodiments, MHC class II vaccine design procedures consist of the following computations steps.

In some embodiments, the inputs for the computation are:

$P_{1\ldots n}$: Peptide sequence(s) (length n) containing the neoantigen(s) of interest (e.g., KRAS G12D, KRAS G12V, KRAS G12R, KRAS G12C, KRAS G13D). $P_i$ denotes the amino acid at position i.

t: Position of target mutation in P, $t \in [1, \ldots, n]$ (e.g., t=12 for KRAS G12D).

s: Substitution mutation $s \in \{true, false\}$ is true if the mutation is a substitution, and false if the mutation is a deletion or insertion or the peptide does not contain a mutation. When the mutation is a deletion or insertion then t indicates the position immediately before the deletion or insertion.

$\tau_1$: Threshold for potential presentation of peptides by MHC for peptide-MHC scoring (e.g., 500 nM binding affinity)

$\tau_2$: Threshold for predicted display of peptides by MHC for peptide-MHC scoring (e.g., 50 nM binding affinity)

$\mathcal{H}$: Set of HLA alleles (for HLA-DR, HLA-DQ, HLA-DP loci)

F: $\mathcal{H}^3 \to \mathbb{R}$: Population haplotype frequencies (for OptiVax optimization and coverage evaluation).

N: Parameter for EvalVax and OptiVax objective function. Specifies minimum number of predicted per-individual hits for population coverage objective to consider the individual covered. Default=1 (computes P(n≥1) population coverage).

In some embodiments, Peptide-HLA Scoring Functions used are:

ScorePotential: $P \times \mathcal{H} \to \mathbb{R}$: Scoring function mapping a (peptide, HLA allele) pair to a prediction of display. If predicted affinity $\leq \tau_1$, then returns 1, else returns 0. Options include NetMHCIIpan, PUFFIN, ensembles, or alternative metrics or software may be used, including models calibrated against immunogenicity data.

ScoreDisplay: $P \in \mathcal{H} \to \mathbb{R}$: Scoring function mapping a (peptide, HLA allele) pair to a prediction of peptide-HLA display. If predicted affinity $\leq \tau_2$, then returns 1, else returns 0. Options include NetMHCIIpan, PUFFIN, ensembles, or alternative metrics or software may be used, including models calibrated against immunogenicity data.

FindCore: $P \times \mathcal{H} \to [1, \ldots, n]$: Function mapping a (peptide, HLA allele) pair to a prediction of the 9-mer binding core. The core may be specified as the offset position (index) into the peptide where the core begins.

Next, from the seed protein sequence (P), a set $\mathcal{P}$ of peptides spanning the protein sequence are constructed. $P_{j \ldots j+(k-1)}$ only produces set members when the subscripts are within the range of the defined seed protein P. Here, we extract all windowed peptides of length 13-25 spanning the target mutation, but this process can be performed using any desired window lengths (e.g., only 15-mers).

$$\mathcal{P} = \bigcup_{k \in [13, \ldots, 25]} \mathcal{P}_k$$

$$\mathcal{P}_k = \{P_{j \ldots j+(k-1)} \mid j \in [t-(k-1), \ldots, t]\}$$

where $\mathcal{P}_k$ contains all sliding windows of length k, which are combined to form $\mathcal{P}$. Note that here (unlike MHC class I), no peptides are excluded based on binding core or anchor residue positions (for MHC class II, filtering is performed as described in this disclosure).

Next, each peptide sequence in P is scored against all HLA alleles in $\mathcal{H}$ for potential presentation using ScorePotential (with threshold $\tau_1$=500 nM) and store results in a $|\mathcal{P}| \times |\mathcal{H}|$ matrix $S_1$:

$$S_1[p,h] = \text{ScorePotential}(p,h) \forall p \in \mathcal{V}, h \in \mathcal{H}$$

Note that $S_1$ is a binary matrix where 1 indicates the HLA is predicted to potentially present the peptide, and 0 indicates no potential presentation.

For each (peptide, HLA allele) pair (p, h), identify/predict the 9-mer binding core using FindCore. The predicted binding core is recorded in a matrix C:

$$C[p,h] = \text{FindCore}(p,h) \forall p \in \mathcal{P}, h \in \mathcal{H}$$

Next, if not(s) then $S_2[p, h] = S_1[p, h]$ otherwise an updated scoring matrix $S_2$ is computed for native peptides in $\mathcal{P}$:

$$S_2[p, h] = \begin{cases} S_1[p, h] & \text{if } C[p, h] \text{ specifies } P_t \text{ at a non-anchor position inside core} \\ 0, & \text{otherwise} \end{cases} \forall p \in \mathcal{P}, h \in \mathcal{H}$$

where $P_t$ is the target residue of interest (e.g., the mutation site of KRAS G12D). This condition enforces the target residue to fall within the binding core at a non-anchor position for all (peptide, HLA allele) pairs with non-zero scores in $S_2$, and allows the binding core to vary by allele per peptide (as the binding cores of a particular peptide may differ based on the HLA allele presenting the peptide). Thus, for each pair (p, h), if the predicted binding core C[p, h] specifies the target residue $P_t$ at an anchor position (P1, P4, P6, or P9 of the 9-mer core), or if $P_t$ is not contained within the binding core, then $S_2[p, h]=0$. In an alternate embodiment, $P_t$ can be located outside of the core or inside the core in a non-anchor position. In some embodiments, $P_t$ can only be located at specific positions inside and/or outside of the core. In some embodiments, the binding core predictions in C are accompanied by prediction confidences. In some embodiments, if the confidence for predicted core C[p, h] is below a desired threshold (e.g., 0.5, 0.6, 0.7, 0.8, or 0.9), then $S_2[p, h]=0$.

Next, OptiVax-Robust is run with peptides $\mathcal{P}$ and scoring matrix $S_2$ to identify a non-redundant base set of peptides $B \subseteq \mathcal{P}$. (In alternate embodiments, B can be chosen as the entire set $\mathcal{P}$ rather than identifying a non-redundant base set.)

Next, a set of all heteroclitic peptides B' is created stemming from peptides in B:

$$B' = \bigcup_{b \in \cup B} \{\text{ANCHOR} - \text{MODIFIED}(b, c) \ \forall \ c \mid \exists \ h \text{ s.t. } S_2[b, h] = 1\}$$

where ANCHOR-MODIFIED(b,c) returns a set of all $20^4$-1 anchor-modified peptides stemming from b with all possible modifications to the amino acids at P1, P4, P6, and P9 of the 9-mer binding core c. Thus, for each base peptide b, the heteroclitic set B' contains all anchor-modified peptides b' with modifications to all unique cores of b identified for any HLA alleles that potentially present b with a valid core position as indicated by scoring matrix $S_2$.

Next, all heteroclitic candidate peptides (e.g., modified peptides) in B' are scored against all HLA alleles in $\mathcal{H}$ for predicted display using SCOREDISPLAY (with threshold $\tau_2$=50 nM), and store results in binary $|B'| \times |\mathcal{H}|$ matrix $S_1'$:

$$S_1'[b',h] = \text{ScoreDisplay}(b',h) \forall b' \in B', h \in \mathcal{H}$$

For each (heteroclitic peptide, HLA allele) pair (b',h), identify/predict the 9-mer binding core using FINDCORE. The predicted binding core is recorded in a matrix C':

$$C'[b',h] = \text{FINDCORE}(b',h) \forall b' \in B', h \in \mathcal{H}$$

An updated scoring matrix $S_2'$ is computed for heteroclitic peptides conditioned on the identified binding cores of a heteroclitic and base peptides occurring at the same offset by a particular HLA:

$$S_2'[b', h] = \begin{cases} S_1'[b', h], & \text{if } C'[b', h] = C[b, h] \\ 0, & \text{otherwise} \end{cases} \forall \ b' \in B', h \in \mathcal{H}$$

where each heteroclitic peptide b'∈B' is a mutation of base peptide b ∈ B. This condition enforces the binding core of the heteroclitic peptide b' to be at the same relative position as the base peptide b, and, implicitly, enforces that the target residue $P_t$ still falls in a non-anchor position within the 9-mer binding core (Step 3).

An updated scoring matrix $S_3'$ is computed for heteroclitic peptides conditioned on the potential presentation of the corresponding base peptides by each HLA:

$$S_3'[b', h] = \begin{cases} S_2'[b', h], & \text{if } S[b, h] = 1 \\ 0, & \text{otherwise} \end{cases} \forall \ b' \in B', h \in \mathcal{H}$$

where each heteroclitic peptide b'∈B' is a mutation of base peptide b∈B. This condition enforces that if h was not predicted to display b, then all heteroclitic peptides b' derived from b will not be displayed by h (even if h would otherwise be predicted to display b').

OptiVax-Robust is used to design a final peptide set (e.g., third peptide set) from the union of base peptides and heteroclitic peptides B∪B' (with corresponding scoring matrices $S_2$ and $S_3'$ for B and B', respectively). Let $\mathcal{V}_k$ denote the compact set of vaccine peptides output by OptiVax containing k peptides. Note that $\mathcal{V}_{k+1}$ is not necessarily a superset of $\mathcal{V}_k$. (In alternate embodiments, OptiVax can be used to augment the base set B with peptides from B' using scoring matrix $S_2'$ to return set $\mathcal{A}_k$, and the final vaccine set $\mathcal{V}_{k+|B|}$ consists of peptides B∪$\mathcal{A}_k$)

In some embodiments, this procedure is repeated independently for each single target of interest, and the resulting independent vaccine sets can be merged into a combined vaccine as described below.

Methods for Combining Multiple Vaccines

The above described methods will produce an optimized target peptide set (e.g., third peptide set) for one or more individual targets. In some embodiments, a method is provided for designing separate vaccines for MHC class I and class II based immunity for multiple targets (e.g., two or more targets such as KRAS G12D and KRAS G12V).

In some embodiments, a method is disclosed for producing a combined peptide vaccine for multiple targets by using a table of presentations for a disease that is based upon empirical data from sources such as the Cancer Genome Atlas (TCGA). FIG. 7 shows one embodiment for factoring disease presentation type probabilities (e.g., pancreatic cancer, colorectal cancer, and skin cancer) by probability, for each disease presentation, of target presented for various mutation targets (e.g., KRAS G12D, KRAS G12V, and KRAS G12R). A presentation is a unique set of targets that are presented by one form of a disease (e.g., distinct type of cancer or cancer indication as shown in FIG. 7). For each presentation, FIG. 7 shows an example of the probability of that presentation, and the probability that a given target is observed. For a given presentation, there can be one or more targets, each having a probability. In some embodiments, the method for multi-target vaccine design will allocate peptide resources for inducing disease immunity based on the presentation and respective target probabilities as shown in FIG. 7, for example. In some embodiments, presentations correspond to the prevalence of targets in different human populations or different risk groups. The probability of a target in a population is computed by summing for each possible presentation the probability of that presentation times the probability of the target in that presentation. FIG. 7 shows weights used for merging individual vaccines for each target (row) into combined vaccines for each disease indication (column). Values indicate the observed fraction of cases containing each target mutation. Data are from The Cancer Genome Atlas (TCGA). For each disease indication, TCGA data are filtered to cases where the Primary Site is the indication.

In some embodiments, the same vaccine design will be generated for mutations to different proteins when the base peptides generated by the mutations to the different proteins are identical. For example, in some embodiments of base peptide selection the following mutations have identical vaccine designs because they share the same set of base peptides: HRAS Q61K, NRAS Q61K, and KRAS Q61K; HRAS Q61L, NRAS Q61L, and KRAS Q61L; HRAS Q61R, NRAS Q61R, and KRAS Q61R. Referring to FIG. 7, in some embodiments when two mutations have identical individual vaccine designs their presentation specific probabilities are added when weighting the individual vaccine design for inclusion in a combined vaccine as described below (e.g., for Thyroid Cancer NRAS Q61R and HRAS Q61R).

Figure 8:
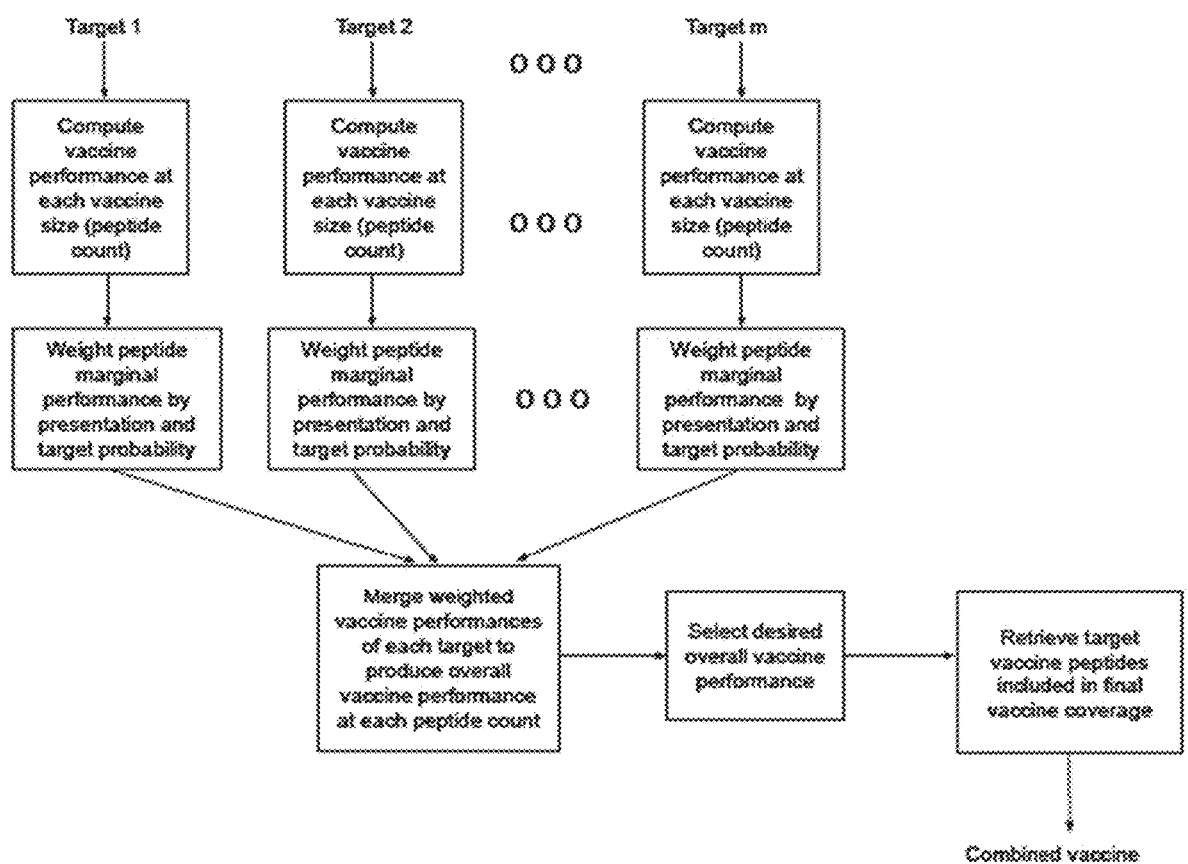
FIG. 8 is a flow chart showing a multiple target (combined) vaccine optimization method.
Figure 9A:
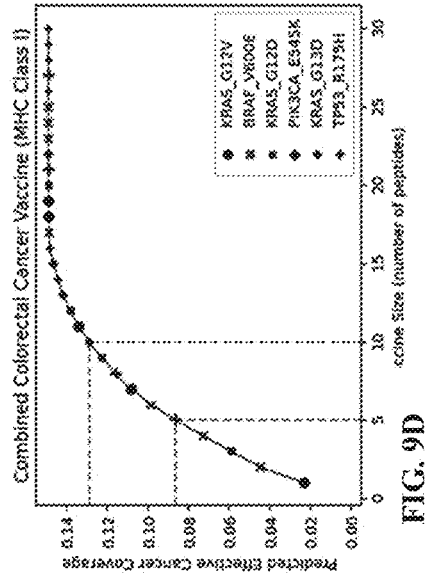
FIGS. 9A-D shows predicted population coverage for multiple target (combined) MHC class I vaccines by vaccine size for pancreatic cancer (9A), colorectal cancer (9B), brain cancer (9C), and thyroid cancer (9D).
Figure 9B:
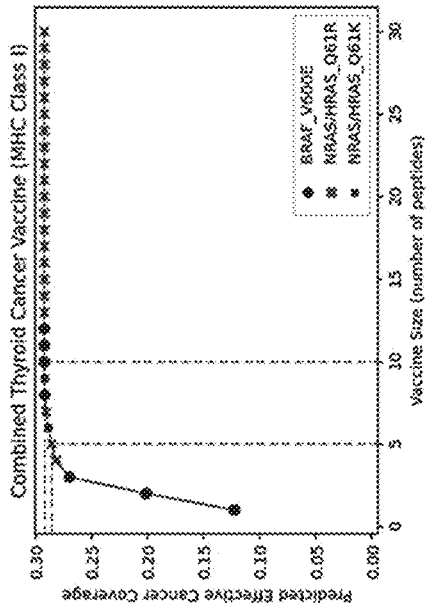
Figure 9C:
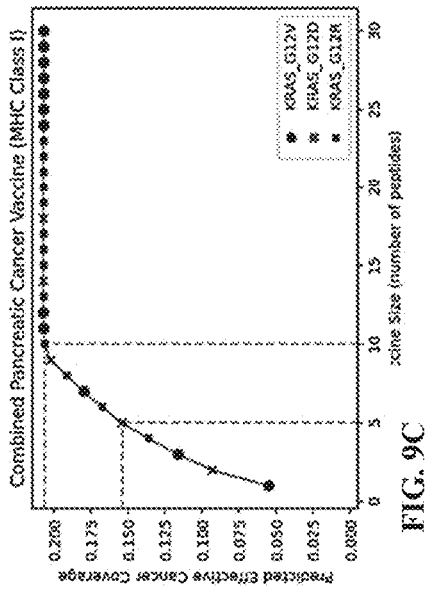
Figure 9D:
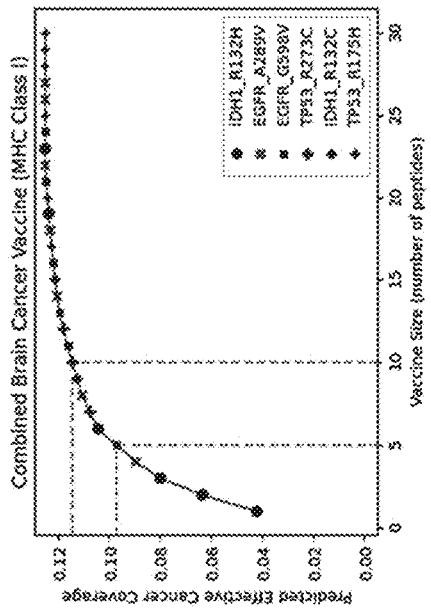

Referring to FIG. 8, in some embodiments, the method first includes designing an individual peptide vaccine for each target to create a combined vaccine design for multiple targets. This initially results in sets of target-specific vaccine designs. In some embodiments, the marginal predicted vaccine performance of each target-specific vaccine at size k is defined by predicted vaccine performance at size k minus the predicted vaccine performance of the vaccine at size k minus one (see FIGS. 3-6). The composition of a vaccine may change as the number of peptides used in the vaccine increases, and thus for computing contributions to a combined vaccine the marginal predicted vaccine performance of each target-specific vaccine is used instead of a specific set of peptides.

In some embodiments, the weighted marginal predicted vaccine performance of a target-specific vaccine design for each target specific vaccine size is computed as shown in FIG. 8. For a given target specific vaccine size, its weighted predicted vaccine performance is computed by multiplying its predicted vaccine performance times the probability of the target in the population (e.g., by using values as shown in FIG. 7). The marginal weighted predicted vaccine performance for a target specific vaccine is its weighted coverage at size k minus its coverage a size k minus one (e.g., see FIGS. 3-6). The marginal weighted predicted vaccine performance of a target specific vaccine of size one is its weighted predicted vaccine performance. The marginal weighted predicted vaccine performances for all vaccines are combined into a single list, and the combined list is sorted from largest to least by the weighted marginal predicted vaccine performances of the target specific vaccines as shown in FIG. 8. The combined vaccine of size n is then determined by the first n elements of this list. The peptides for the combined vaccine are determined by the individual peptide target vaccines whose sizes add to n and whose weighted predicted vaccine performances sums to the same sum as the first n elements of the sorted list. This maximizes the predicted vaccine performance of the combined vaccine of size n.

In some embodiments, the combined multiple target vaccine can be designed on its overall predicted coverage for the disease described depending on the presentation table used (e.g., see FIG. 7), by its predicted coverage for a specific indication, and/or by its predicted coverage for a specific target by adjusting the weighting used for predicted vaccine performance accordingly. Once a desired level of coverage is selected, the peptides of the combined vaccine are determined by the contributions of target-specific designs. For example, if the combined vaccine includes a target-specific vaccine of size k, then the vaccine peptides for this target at size k are used in the combined vaccine.

Figure 10A:
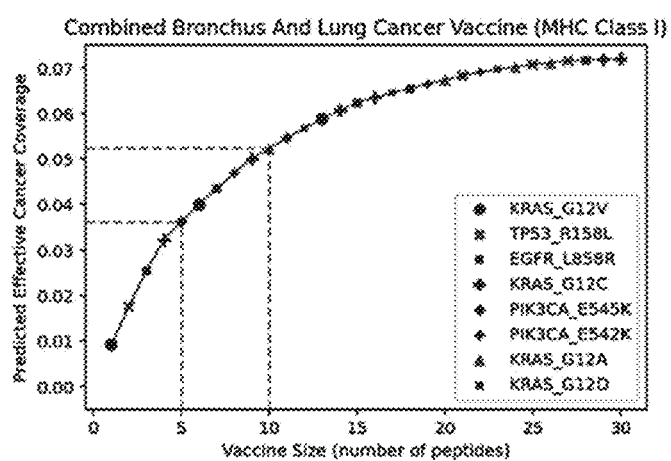
FIGS. 10A-B shows predicted population coverage for multiple target (combined) MHC class I vaccines by vaccine size for bronchus and lung cancer (10A), and skin cancer (10B).
Figure 10B:
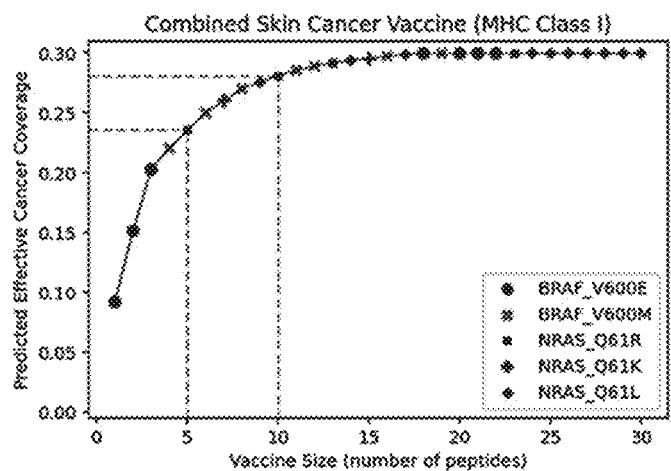
Figure 11B:
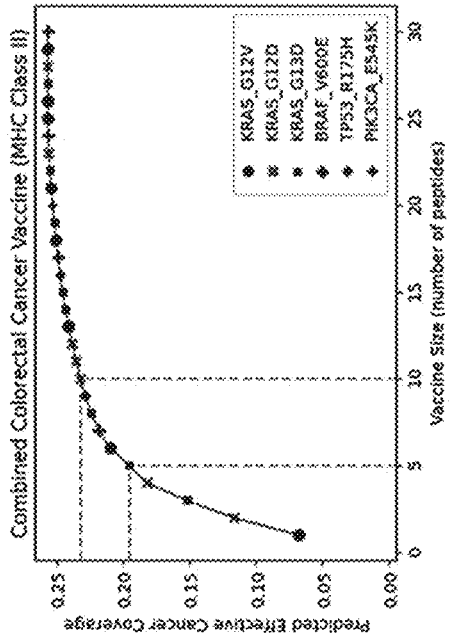
FIGS. 11A-D shows predicted population coverage for multiple target (combined) MHC class II vaccines by vaccine size for pancreatic cancer (11A), colorectal cancer (11B), brain cancer (11C), and thyroid cancer (11D).
Figure 11D:
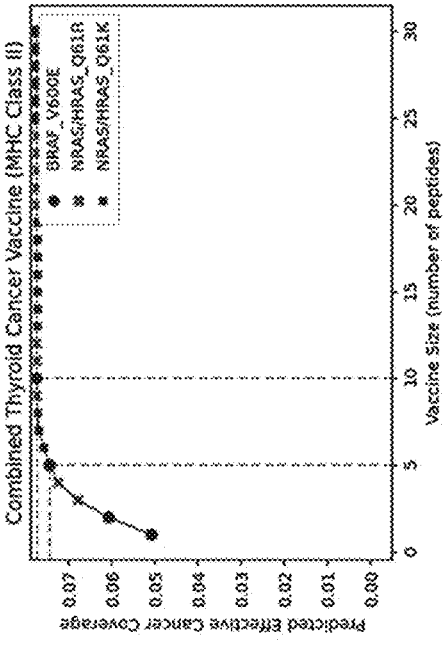
Figure 11A:
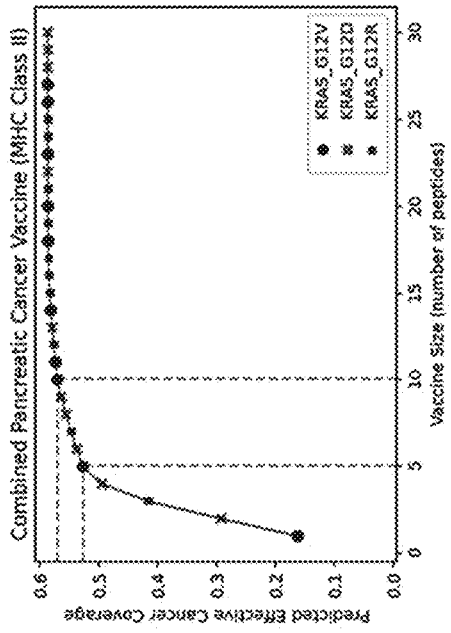
Figure 11C:
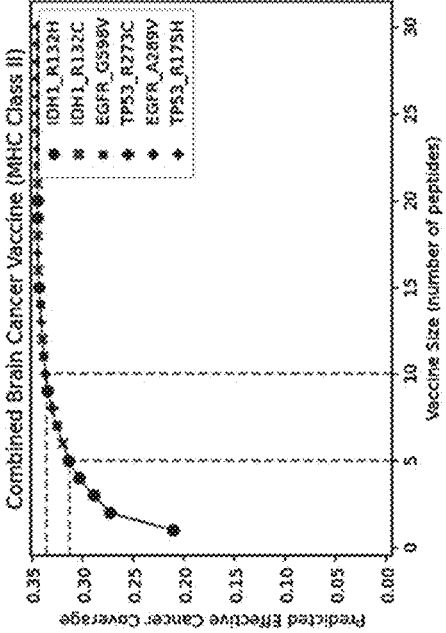
Figure 12A:
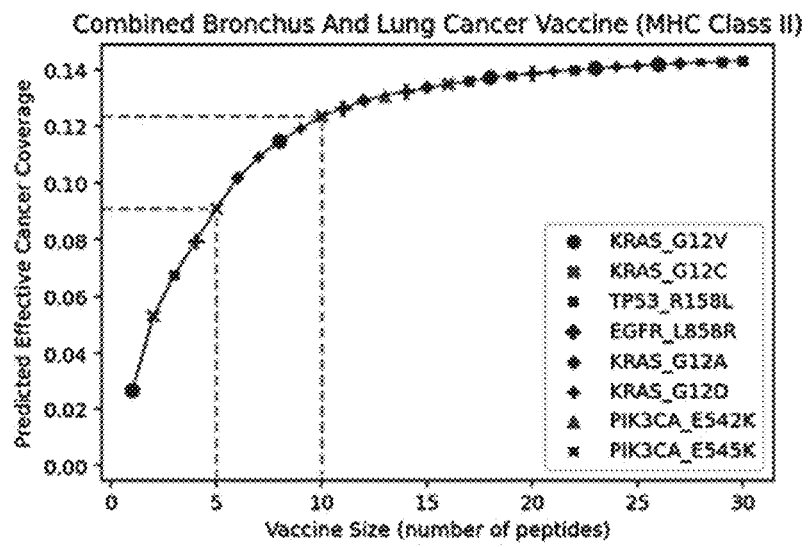
FIGS. 12A-B shows predicted population coverage for multiple target (combined) MHC class II vaccines by vaccine size for bronchus and lung cancer (12A), and skin cancer (12B).
Figure 12B:
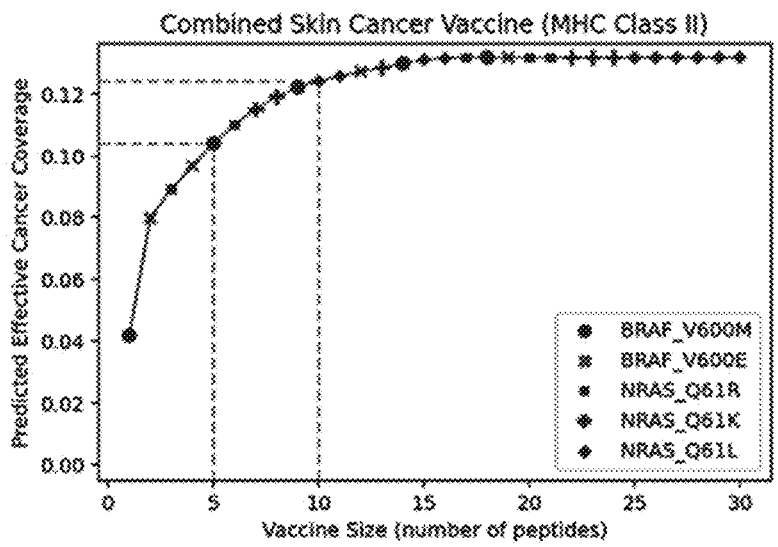

As an example of one embodiment, FIG. 7 shows mutations (e.g., KRAS G12D, G12V, and G12R) and their respective probabilities of occurring in an individual with different cancer indications (e.g., pancreatic cancer). FIGS. 3 and 4 (MHC class I) and FIGS. 5 and 6 (MHC class II) show the population coverage of target-specific vaccines for targets using the methods for vaccines described herein. The marginal population coverage of each target-specific vaccine at a given vaccine size is the improvement in coverage at that size and the size less one. The coverage with no peptides is zero. The marginal coverage of each target-specific vaccine is multiplied by the probability of the target in the population as determined by the proportions as shown in FIG. 7 for a selected indication (e.g., pancreatic cancer). These weighted marginal coverages of all target-specific vaccines are sorted to determine the best target-specific compositions, and the resulting list describes the composition of a combined vaccine for the selected indication at each size k by taking the first k elements of the list. As an example of one embodiment, FIGS. 9 and 10 (MHC Class I) and FIGS. 11 and 12 (MHC Class II) show the target specific contributions at each vaccine size for a combined vaccines for Pancreatic Cancer, Skin Cancer, Thyroid Cancer, Brain Cancer, Colorectal Cancer, and Bronchus And Lung Cancer. The methods for combined vaccine protocol described herein was used to compute the examples in FIGS. 9 to 12. At each combined vaccine size, different components of the target-specific vaccines are utilized for the indication illustrated. Table 1 (below) contains the peptides present in independent (single target) and combined (multiple target) MHC class I vaccine designs. Table 2 (below) contains the contains the peptides present in independent (single target) MHC class II vaccine designs combined (multiple target) MHC class II vaccine designs. Tables 1 and 2 include peptides for Breast Cancer and Ovarian Cancer vaccines for the mutations present in FIG. 7. For alternate embodiments, Sequence Listing provides heteroclitic peptides useful in MHC class I vaccines and MHC class II vaccines for the mutated proteins, specific protein mutations, and indications in Tables 1 and 2. Any subset of the individual/single target vaccines for MHC class I and class II can be combined to create a vaccine for two or more multiple targets.

Combined Vaccine Design Procedure

In some embodiments, the procedure described herein is used to combine individual compact vaccines optimized for different targets into a single optimized combined vaccine.

In some embodiments, the computational inputs for the procedure are:

$\mathcal{T}$: Set of neoantigen or pathogenic targets of interest (e.g., KRAS G12D, KRAS G12V, KRAS G12R)

$\mathcal{V}$: Vaccine sets optimized individually for each target. Let $\mathcal{V}_{t,k}$ denote the optimal vaccine set of exactly k peptides for target t∈$\mathcal{T}$ (e.g., as computed by the procedures describe above). Note that $\mathcal{V}_{t,k+1}$ may not necessarily be a superset of $\mathcal{V}_{t,k}$.

W: $\mathcal{T}$ →[0,1]: Target weighting function mapping each target t∈$\mathcal{T}$ to a probability or weight of t in a particular presentation of interest (e.g., pancreatic cancer; see Exhibit A, Table 1 for example).

POPULATIONCOVERAGE: $\mathcal{V}$ →[0,1]: Function mapping a peptide set into population coverage (e.g., EvalVax). This function may also take as input additional parameters, including HLA haplotype frequencies and a minimum per-individual number of peptide-HLA hits N (here, we compute coverage as P(n≥1) using EvalVax-Robust).

For each target t (individually) and vaccine size (peptide count) k, the unweighted population coverage $c_{t,k}$ is computed:

$$c_{t,k}=\text{PopulationCouerage}(\mathcal{V}_{t,k}) \forall t \in \mathcal{T}, k$$

Note that for each target t, $c_{t,k}$ is generally monotonically increasing and concave down for increasing values of k (each additional peptide increases coverage but with decreasing returns).

For each target t (individually), the marginal coverage $m_{t,k}$ is computed of the k-th peptide added to the vaccine set:

$$m_{t,k} = \begin{cases} c_{t,k} & \text{if } k=1 \\ c_{t,k} = c_{t,k-1}, & \text{otherwise} \end{cases} \forall t \in \mathcal{T}, k$$

Note that for each target t, $m_{t,k}$ should be a monotonically decreasing function in k (by Step 1 above).

The weighted marginal population coverage $\tilde{m}_{t,k}$ is computed using weights of each target in W:

$$\tilde{m}_{t,k}=W(t) \cdot m_{t,k} \forall t \in \mathcal{T}, k$$

The weighted marginal population coverage gives the effective marginal coverage of the k-th peptide in the vaccine weighted by the prevalence of the target in the presentation (by multiplication with the probability/ weight of the target in the presentation).

The individual vaccines are combined into a combined vaccine via the MERGEMULTI procedure called on the weighted marginal population coverage lists $\tilde{m}_t=[\tilde{m}_{t,k}, k\in 1, 2, \ldots]$. FIG. 13 shows an example Python implementation of the MERGEMULTI function. This procedure takes as input multiple sorted (descending) lists and merges them into a single sorted (descending) list. Let M indicate the output of MERGEMULTI where each element $M_k$ contains both the marginal weighted coverage and source (target) of the k-th peptide in the combined vaccine. The combined vaccine contains peptides from different targets. In particular, the combined vaccine with k peptides contains $C_{t,k}=\Sigma_{j\leq k} \mathbb{1} \{M_k$ from t} peptides from target t. Note that $C_{t,k}\in[0, k]$ and $\Sigma_t C_{t,k}=k$ ($C_{t,k}$ gives the distribution of the k peptides in the combined vaccine across the targets).

The optimal combined vaccine set $\hat{v}_k$ is defined as:

$$\hat{v}_k = \bigcup_{t\in T} v_{t,C_{t,k}}$$

Thus, the combined vaccine with k peptides is the combination of the optimal individual ($C_{t,k}$)-peptide vaccines. The marginal weighted coverage values of the combine vaccine $M_k$ can be cumulatively summed over k to give the overall effective (target-weighted) population coverage of the combined vaccine containing k peptides as $\Sigma_{j\leq K} M_k$ (taking into account both the probabilities/weights of the targets in the presentation and the expected population coverage of peptides based on HLA display). The final vaccine size k can vary based upon the specific population coverage goals of the vaccine.

MHC Class I Peptide Sequences

In some embodiments, a peptide vaccine (single target or combined multiple target vaccine) comprises about 1 to 40 MHC class I peptides with each peptide consisting of 8 or more amino acids. In some embodiments, an MHC class I peptide vaccine is intended for one or more of the AKT1, BRAF, EGFR, GTF2I, HRAS, IDH1, KRAS, NRAS, PIK3CA, PTEN, or TP53 mutated protein targets. In some embodiments, an MHC class I peptide vaccine is intended for one or more of the AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, or TP53 Y220C protein mutation targets. In some embodiments, an MHC class I peptide vaccine is intended for one or more of the pancreatic cancer, skin cancer, thyroid cancer, brain cancer, colorectal cancer, bronchus and lung cancer, breast cancer, or ovarian cancer indications.

In some embodiments, the amino acid sequence for a MHC class I peptide vaccine for mutation in the AKT1 protein comprises one or more of the SEQ ID NOs: 1 to 18 and SEQ ID NO: 459. In some embodiments, any one of the peptides in the AKT1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 1 to 18 or SEQ ID NO: 459.

In some embodiments, the amino acid sequence for a MHC class I peptide vaccine for mutation in the AKT1 protein comprises one or more of the SEQ ID NOs: 1 to 18, SEQ ID NO: 459, SEQ ID NOs: 760 to 1768, and SEQ ID NOs: 22386 to 22396. In some embodiments, any one of the peptides in the AKT1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 1 to 18, SEQ ID NO: 459, SEQ ID NOs: 760 to 1768, or SEQ ID NOs: 22386 to 22396.

In some embodiments, the amino acid sequence for a MHC class I peptide vaccine for mutation in the AKT1 protein comprises two or more of the SEQ ID NOs: 1 to 18 and SEQ ID NO: 459. In some embodiments, any one of the peptides in the AKT1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 1 to 18 or SEQ ID NO: 459.

In some embodiments, the amino acid sequence for a MHC class I peptide vaccine for mutation in the AKT1 protein comprises two or more of the SEQ ID NOs: 1 to 18, SEQ ID NO: 459, SEQ ID NOs: 760 to 1768, and SEQ ID NOs: 22386 to 22396. In some embodiments, any one of the peptides in the AKT1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 1 to 18, SEQ ID NO: 459, SEQ ID NOs: 760 to 1768, or SEQ ID NOs: 22386 to 22396.

In some embodiments, the amino acid sequence for a MHC class I peptide vaccine for mutation in the BRAF protein comprises one or more of the SEQ ID NOs: 19 to 50. In some embodiments, any one of the peptides in the BRAF vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 19 to 50.

In some embodiments, the amino acid sequence for a MHC class I peptide vaccine for mutation in the BRAF protein comprises one or more of the SEQ ID NOs: 19 to 50, SEQ ID NOs: 1769 to 3170, and SEQ ID NOs: 22397 to 22417. In some embodiments, any one of the peptides in the BRAF vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 19 to 50, SEQ ID NOs: 1769 to 3170, or SEQ ID NOs: 22397 to 22417.

In some embodiments, the amino acid sequence for a MHC class I peptide vaccine for mutation in the BRAF protein comprises two or more of the SEQ ID NOs: 19 to 50. In some embodiments, any one of the peptides in the BRAF vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 19 to 50.

In some embodiments, the amino acid sequence for a MHC class I peptide vaccine for mutation in the BRAF protein comprises two or more of the SEQ ID NOs: 19 to 50, SEQ ID NOs: 1769 to 3170, and SEQ ID NOs: 22397 to 22417. In some embodiments, any one of the peptides in the BRAF vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 19 to 50, SEQ ID NOs: 1769 to 3170, or SEQ ID NOs: 22397 to 22417.

In some embodiments, the amino acid sequence for a MHC class I peptide vaccine for mutation in the EGFR protein comprises one or more of the SEQ ID NOs: 51 to 98. In some embodiments, any one of the peptides in the EGFR vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 51 to 98.

In some embodiments, the amino acid sequence for a MHC class I peptide vaccine for mutation in the EGFR protein comprises one or more of the SEQ ID NOs: 51 to 98, SEQ ID NOs: 3171 to 5756, and SEQ ID NOs: 22418 to 22449. In some embodiments, any one of the peptides in the EGFR vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 51 to 98, SEQ ID NOs: 3171 to 5756, or SEQ ID NOs: 22418 to 22449.

In some embodiments, the amino acid sequence for a MHC class I peptide vaccine for mutation in the EGFR protein comprises two or more of the SEQ ID NOs: 51 to 98. In some embodiments, any one of the peptides in the EGFR vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 51 to 98.

In some embodiments, the amino acid sequence for a MHC class I peptide vaccine for mutation in the EGFR protein comprises two or more of the SEQ ID NOs: 51 to 98, SEQ ID NOs: 3171 to 5756, and SEQ ID NOs: 22418 to 22449. In some embodiments, any one of the peptides in the EGFR vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 51 to 98, SEQ ID NOs: 3171 to 5756, or SEQ ID NOs: 22418 to 22449.

In some embodiments, the amino acid sequence for a MHC class I peptide vaccine for mutation in the GTF2I protein comprises one or more of the SEQ ID NOs: 99 to 118. In some embodiments, any one of the peptides in the GTF2I vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 99 to 118.

In some embodiments, the amino acid sequence for a MHC class I peptide vaccine for mutation in the GTF2I protein comprises one or more of the SEQ ID NOs: 99 to 118, SEQ ID NOs: 5757 to 6498, and SEQ ID NOs: 22450 to 22466. In some embodiments, any one of the peptides in the GTF2I vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 99 to 118, SEQ ID NOs: 5757 to 6498, or SEQ ID NOs: 22450 to 22466.

In some embodiments, the amino acid sequence for a MHC class I peptide vaccine for mutation in the GTF2I protein comprises two or more of the SEQ ID NOs: 99 to 118. In some embodiments, any one of the peptides in the GTF2I vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 99 to 118.

In some embodiments, the amino acid sequence for a MHC class I peptide vaccine for mutation in the GTF2I protein comprises two or more of the SEQ ID NOs: 99 to 118, SEQ ID NOs: 5757 to 6498, and SEQ ID NOs: 22450 to 22466. In some embodiments, any one of the peptides in the GTF2I vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 99 to 118, SEQ ID NOs: 5757 to 6498, or SEQ ID NOs: 22450 to 22466.

In some embodiments, the amino acid sequence for a MHC class I peptide vaccine for mutation in the IDH1 protein comprises one or more of the SEQ ID NOs: 119 to 140 and SEQ ID NOs: 460 to 461. In some embodiments, any one of the peptides in the IDH1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 119 to 140 or SEQ ID NOs: 460 to 461.

In some embodiments, the amino acid sequence for a MHC class I peptide vaccine for mutation in the IDH1 protein comprises one or more of the SEQ ID NOs: 119 to 140, SEQ ID NOs: 460 to 461, SEQ ID NOs: 6499 to 7098, and SEQ ID NOs: 22467 to 22488. In some embodiments, any one of the peptides in the IDH1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 119 to 140, SEQ ID NOs: 460 to 461, SEQ ID NOs: 6499 to 7098, or SEQ ID NOs: 22467 to 22488.

In some embodiments, the amino acid sequence for a MHC class I peptide vaccine for mutation in the IDH1 protein comprises two or more of the SEQ ID NOs: 119 to 140 and SEQ ID NOs: 460 to 461. In some embodiments, any one of the peptides in the IDH1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 119 to 140 or SEQ ID NOs: 460 to 461.

In some embodiments, the amino acid sequence for a MHC class I peptide vaccine for mutation in the IDH1 protein comprises two or more of the SEQ ID NOs: 119 to 140, SEQ ID NOs: 460 to 461, SEQ ID NOs: 6499 to 7098, and SEQ ID NOs: 22467 to 22488. In some embodiments, any one of the peptides in the IDH1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 119 to 140, SEQ ID NOs: 460 to 461, SEQ ID NOs: 6499 to 7098, or SEQ ID NOs: 22467 to 22488.

In some embodiments, the amino acid sequence for a MHC class I peptide vaccine for mutation in the KRAS protein comprises one or more of the SEQ ID NOs: 141 to 229 and SEQ ID NOs: 462 to 466. In some embodiments, any one of the peptides in the KRAS vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 141 to 229 or SEQ ID NOs: 462 to 466.

In some embodiments, the amino acid sequence for a MHC class I peptide vaccine for mutation in the KRAS protein comprises one or more of the SEQ ID NOs: 141 to 229, SEQ ID NOs: 462 to 466, SEQ ID NOs: 7099 to 12814, and SEQ ID NOs: 22489 to 22558. In some embodiments, any one of the peptides in the KRAS vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 141 to 229, SEQ ID NOs: 462 to 466, SEQ ID NOs: 7099 to 12814, or SEQ ID NOs: 22489 to 22558.

In some embodiments, the amino acid sequence for a MHC class I peptide vaccine for mutation in the KRAS protein comprises two or more of the SEQ ID NOs: 141 to 229 and SEQ ID NOs: 462 to 466. In some embodiments, any one of the peptides in the KRAS vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 141 to 229 or SEQ ID NOs: 462 to 466.

In some embodiments, the amino acid sequence for a MHC class I peptide vaccine for mutation in the KRAS protein comprises two or more of the SEQ ID NOs: 141 to 229, SEQ ID NOs: 462 to 466, SEQ ID NOs: 7099 to 12814, and SEQ ID NOs: 22489 to 22558. In some embodiments, any one of the peptides in the KRAS vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 141 to 229, SEQ ID NOs: 462 to 466, SEQ ID NOs: 7099 to 12814, or SEQ ID NOs: 22489 to 22558.

In some embodiments, the amino acid sequence for a MHC class I peptide vaccine for mutation in the NRAS protein comprises one or more of the SEQ ID NOs: 230 to 272. In some embodiments, any one of the peptides in the NRAS vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 230 to 272.

In some embodiments, the amino acid sequence for a MHC class I peptide vaccine for mutation in the NRAS protein comprises one or more of the SEQ ID NOs: 230 to 272, SEQ ID NOs: 12815 to 14836, and SEQ ID NOs: 22559 to 22582. In some embodiments, any one of the peptides in the NRAS vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 230 to 272, SEQ ID NOs: 12815 to 14836, or SEQ ID NOs: 22559 to 22582.

In some embodiments, the amino acid sequence for a MHC class I peptide vaccine for mutation in the NRAS protein comprises two or more of the SEQ ID NOs: 230 to 272. In some embodiments, any one of the peptides in the NRAS vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 230 to 272.

In some embodiments, the amino acid sequence for a MHC class I peptide vaccine for mutation in the NRAS protein comprises two or more of the SEQ ID NOs: 230 to 272, SEQ ID NOs: 12815 to 14836, and SEQ ID NOs: 22559 to 22582. In some embodiments, any one of the peptides in the NRAS vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 230 to 272, SEQ ID NOs: 12815 to 14836, or SEQ ID NOs: 22559 to 22582.

In some embodiments, the amino acid sequence for a MHC class I peptide vaccine for mutation in the PIK3CA protein comprises one or more of the SEQ ID NOs: 273 to 322 and SEQ ID NOs: 467 to 468. In some embodiments, any one of the peptides in the PIK3CA vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 273 to 322 or SEQ ID NOs: 467 to 468.

In some embodiments, the amino acid sequence for a MHC class I peptide vaccine for mutation in the PIK3CA protein comprises one or more of the SEQ ID NOs: 273 to 322, SEQ ID NOs: 467 to 468, SEQ ID NOs: 14837 to 17342, and SEQ ID NOs: 22583 to 22622. In some embodiments, any one of the peptides in the PIK3CA vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 273 to 322, SEQ ID NOs: 467 to 468, SEQ ID NOs: 14837 to 17342, or SEQ ID NOs: 22583 to 22622.

In some embodiments, the amino acid sequence for a MHC class I peptide vaccine for mutation in the PIK3CA protein comprises two or more of the SEQ ID NOs: 273 to 322 and SEQ ID NOs: 467 to 468. In some embodiments, any one of the peptides in the PIK3CA vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 273 to 322 or SEQ ID NOs: 467 to 468.

In some embodiments, the amino acid sequence for a MHC class I peptide vaccine for mutation in the PIK3CA protein comprises two or more of the SEQ ID NOs: 273 to 322, SEQ ID NOs: 467 to 468, SEQ ID NOs: 14837 to 17342, and SEQ ID NOs: 22583 to 22622. In some embodiments, any one of the peptides in the PIK3CA vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 273 to 322, SEQ ID NOs: 467 to 468, SEQ ID NOs: 14837 to 17342, or SEQ ID NOs: 22583 to 22622.

In some embodiments, the amino acid sequence for a MHC class I peptide vaccine for mutation in the PTEN protein comprises one or more of the SEQ ID NOs: 323 to 353. In some embodiments, any one of the peptides in the PTEN vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 323 to 353.

In some embodiments, the amino acid sequence for a MHC class I peptide vaccine for mutation in the PTEN protein comprises one or more of the SEQ ID NOs: 323 to 353, SEQ ID NOs: 17343 to 18205, and SEQ ID NOs: 22623 to 22636. In some embodiments, any one of the peptides in the PTEN vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 323 to 353, SEQ ID NOs: 17343 to 18205, or SEQ ID NOs: 22623 to 22636.

In some embodiments, the amino acid sequence for a MHC class I peptide vaccine for mutation in the PTEN protein comprises two or more of the SEQ ID NOs: 323 to 353. In some embodiments, any one of the peptides in the PTEN vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 323 to 353.

In some embodiments, the amino acid sequence for a MHC class I peptide vaccine for mutation in the PTEN protein comprises two or more of the SEQ ID NOs: 323 to 353, SEQ ID NOs: 17343 to 18205, and SEQ ID NOs: 22623 to 22636. In some embodiments, any one of the peptides in the PTEN vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 323 to 353, SEQ ID NOs: 17343 to 18205, or SEQ ID NOs: 22623 to 22636.

In some embodiments, the amino acid sequence for a MHC class I peptide vaccine for mutation in the TP53 protein comprises one or more of the SEQ ID NOs: 354 to 458 and SEQ ID NOs: 469 to 474. In some embodiments, any one of the peptides in the TP53 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 354 to 458 or SEQ ID NOs: 469 to 474.

In some embodiments, the amino acid sequence for a MHC class I peptide vaccine for mutation in the TP53 protein comprises one or more of the SEQ ID NOs: 354 to 458, SEQ ID NOs: 469 to 474, SEQ ID NOs: 18206 to 22385, and SEQ ID NOs: 22637 to 22727. In some embodiments, any one of the peptides in the TP53 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 354 to 458, SEQ ID NOs: 469 to 474, SEQ ID NOs: 18206 to 22385, or SEQ ID NOs: 22637 to 22727.

In some embodiments, the amino acid sequence for a MHC class I peptide vaccine for mutation in the TP53 protein comprises two or more of the SEQ ID NOs: 354 to 458 and SEQ ID NOs: 469 to 474. In some embodiments, any one of the peptides in the TP53 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 354 to 458 or SEQ ID NOs: 469 to 474.

In some embodiments, the amino acid sequence for a MHC class I peptide vaccine for mutation in the TP53 protein comprises two or more of the SEQ ID NOs: 354 to 458, SEQ ID NOs: 469 to 474, SEQ ID NOs: 18206 to 22385, and SEQ ID NOs: 22637 to 22727. In some embodiments, any one of the peptides in the TP53 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 354 to 458, SEQ ID NOs: 469 to 474, SEQ ID NOs: 18206 to 22385, or SEQ ID NOs: 22637 to 22727.

In some embodiments, the amino acid sequence for a MHC class I peptide vaccine for mutation in the RAS protein comprises one or more of the SEQ ID NOs: 141 to 272 and SEQ ID NOs: 462 to 466. In some embodiments, any one of the peptides in the RAS vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 141 to 272 or SEQ ID NOs: 462 to 466.

In some embodiments, the amino acid sequence for a MHC class I peptide vaccine for mutation in the RAS protein comprises one or more of the SEQ ID NOs: 141 to 272, SEQ ID NOs: 462 to 466, SEQ ID NOs: 7099 to 14836, and SEQ ID NOs: 22489 to 22582. In some embodiments, any one of the peptides in the RAS vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 141 to 272, SEQ ID NOs: 462 to 466, SEQ ID NOs: 7099 to 14836, or SEQ ID NOs: 22489 to 22582.

In some embodiments, the amino acid sequence for a MHC class I peptide vaccine for mutation in the RAS protein comprises two or more of the SEQ ID NOs: 141 to 272 and SEQ ID NOs: 462 to 466. In some embodiments, any one of the peptides in the RAS vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 141 to 272 or SEQ ID NOs: 462 to 466.

In some embodiments, the amino acid sequence for a MHC class I peptide vaccine for mutation in the RAS protein comprises two or more of the SEQ ID NOs: 141 to 272, SEQ ID NOs: 462 to 466, SEQ ID NOs: 7099 to 14836, and SEQ ID NOs: 22489 to 22582. In some embodiments, any one of the peptides in the RAS vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 141 to 272, SEQ ID NOs: 462 to 466, SEQ ID NOs: 7099 to 14836, or SEQ ID NOs: 22489 to 22582.

In some embodiments, the amino acid sequence for a MHC class I peptide vaccine for the BRAF V600E protein mutation comprises one or more of the SEQ ID NOs: 19 to 33. In some embodiments, any one of the peptides in the BRAF V600E vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 19 to 33.

In some embodiments, the amino acid sequence for a MHC class I peptide vaccine for the BRAF V600E protein mutation comprises one or more of the SEQ ID NOs: 19 to 33, SEQ ID NOs: 1769 to 2329, and SEQ ID NOs: 22397 to 22405. In some embodiments, any one of the peptides in the BRAF V600E vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 19 to 33, SEQ ID NOs: 1769 to 2329, or SEQ ID NOs: 22397 to 22405.

In some embodiments, the amino acid sequence for a MHC class I peptide vaccine for the BRAF V600E protein mutation comprises two or more of the SEQ ID NOs: 19 to 33. In some embodiments, any one of the peptides in the BRAF V600E vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 19 to 33.

In some embodiments, the amino acid sequence for a MHC class I peptide vaccine for the BRAF V600E protein mutation comprises two or more of the SEQ ID NOs: 19 to 33, SEQ ID NOs: 1769 to 2329, and SEQ ID NOs: 22397 to 22405. In some embodiments, any one of the peptides in the BRAF V600E vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 19 to 33, SEQ ID NOs: 1769 to 2329, or SEQ ID NOs: 22397 to 22405.

In some embodiments, the amino acid sequence for a MHC class I peptide vaccine for the BRAF V600M protein mutation comprises one or more of the SEQ ID NOs: 34 to 50. In some embodiments, any one of the peptides in the BRAF V600M vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 34 to 50.

In some embodiments, the amino acid sequence for a MHC class I peptide vaccine for the BRAF V600M protein mutation comprises one or more of the SEQ ID NOs: 34 to 50, SEQ ID NOs: 2330 to 3170, and SEQ ID NOs: 22406 to 22417. In some embodiments, any one of the peptides in the BRAF V600M vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 34 to 50, SEQ ID NOs: 2330 to 3170, or SEQ ID NOs: 22406 to 22417.

In some embodiments, the amino acid sequence for a MHC class I peptide vaccine for the BRAF V600M protein mutation comprises two or more of the SEQ ID NOs: 34 to 50. In some embodiments, any one of the peptides in the BRAF V600M vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 34 to 50.

In some embodiments, the amino acid sequence for a MHC class I peptide vaccine for the BRAF V600M protein mutation comprises two or more of the SEQ ID NOs: 34 to 50, SEQ ID NOs: 2330 to 3170, and SEQ ID NOs: 22406 to 22417. In some embodiments, any one of the peptides in the BRAF V600M vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 34 to 50, SEQ ID NOs: 2330 to 3170, or SEQ ID NOs: 22406 to 22417.

In some embodiments, the amino acid sequence for a MHC class I peptide vaccine for the EGFR A289V protein mutation comprises one or more of the SEQ ID NOs: 51 to 66. In some embodiments, any one of the peptides in the EGFR A289V vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 51 to 66.

In some embodiments, the amino acid sequence for a MHC class I peptide vaccine for the EGFR A289V protein mutation comprises one or more of the SEQ ID NOs: 51 to 66, SEQ ID NOs: 3171 to 4055, and SEQ ID NOs: 22418 to 22430. In some embodiments, any one of the peptides in the EGFR A289V vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 51 to 66, SEQ ID NOs: 3171 to 4055, or SEQ ID NOs: 22418 to 22430.

In some embodiments, the amino acid sequence for a MHC class I peptide vaccine for the EGFR A289V protein mutation comprises two or more of the SEQ ID NOs: 51 to 66. In some embodiments, any one of the peptides in the EGFR A289V vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 51 to 66.

In some embodiments, the amino acid sequence for a MHC class I peptide vaccine for the EGFR A289V protein mutation comprises two or more of the SEQ ID NOs: 51 to 66, SEQ ID NOs: 3171 to 4055, and SEQ ID NOs: 22418 to 22430. In some embodiments, any one of the peptides in the EGFR A289V vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 51 to 66, SEQ ID NOs: 3171 to 4055, or SEQ ID NOs: 22418 to 22430.

In some embodiments, the amino acid sequence for a MHC class I peptide vaccine for the EGFR G598V protein mutation comprises one or more of the SEQ ID NOs: 67 to 81. In some embodiments, any one of the peptides in the EGFR G598V vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 67 to 81.

In some embodiments, the amino acid sequence for a MHC class I peptide vaccine for the EGFR G598V protein mutation comprises one or more of the SEQ ID NOs: 67 to 81, SEQ ID NOs: 4056 to 4718, and SEQ ID NOs: 22431 to 22437. In some embodiments, any one of the peptides in the EGFR G598V vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 67 to 81, SEQ ID NOs: 4056 to 4718, or SEQ ID NOs: 22431 to 22437.

In some embodiments, the amino acid sequence for a MHC class I peptide vaccine for the EGFR G598V protein mutation comprises two or more of the SEQ ID NOs: 67 to 81. In some embodiments, any one of the peptides in the EGFR G598V vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 67 to 81.

In some embodiments, the amino acid sequence for a MHC class I peptide vaccine for the EGFR G598V protein mutation comprises two or more of the SEQ ID NOs: 67 to 81, SEQ ID NOs: 4056 to 4718, and SEQ ID NOs: 22431 to 22437. In some embodiments, any one of the peptides in the EGFR G598V vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 67 to 81, SEQ ID NOs: 4056 to 4718, or SEQ ID NOs: 22431 to 22437.

In some embodiments, the amino acid sequence for a MHC class I peptide vaccine for the EGFR L858R protein mutation comprises one or more of the SEQ ID NOs: 82 to 98. In some embodiments, any one of the peptides in the EGFR L858R vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 82 to 98.

In some embodiments, the amino acid sequence for a MHC class I peptide vaccine for the EGFR L858R protein mutation comprises one or more of the SEQ ID NOs: 82 to 98, SEQ ID NOs: 4719 to 5756, and SEQ ID NOs: 22438 to 22449. In some embodiments, any one of the peptides in the EGFR L858R vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 82 to 98, SEQ ID NOs: 4719 to 5756, or SEQ ID NOs: 22438 to 22449.

In some embodiments, the amino acid sequence for a MHC class I peptide vaccine for the EGFR L858R protein mutation comprises two or more of the SEQ ID NOs: 82 to 98. In some embodiments, any one of the peptides in the EGFR L858R vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 82 to 98.

In some embodiments, the amino acid sequence for a MHC class I peptide vaccine for the EGFR L858R protein mutation comprises two or more of the SEQ ID NOs: 82 to 98, SEQ ID NOs: 4719 to 5756, and SEQ ID NOs: 22438 to 22449. In some embodiments, any one of the peptides in the EGFR L858R vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 82 to 98, SEQ ID NOs: 4719 to 5756, or SEQ ID NOs: 22438 to 22449.

In some embodiments, the amino acid sequence for a MHC class I peptide vaccine for the IDH1 R132H protein mutation comprises one or more of the SEQ ID NOs: 125 to 140 and SEQ ID NO: 461. In some embodiments, any one of the peptides in the IDH1 R132H vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 125 to 140 or SEQ ID NO: 461.

In some embodiments, the amino acid sequence for a MHC class I peptide vaccine for the IDH1 R132H protein mutation comprises one or more of the SEQ ID NOs: 125 to 140, SEQ ID NO: 461, SEQ ID NOs: 6738 to 7098, and SEQ ID NOs: 22477 to 22488. In some embodiments, any one of the peptides in the IDH1 R132H vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 125 to 140, SEQ ID NO: 461, SEQ ID NOs: 6738 to 7098, or SEQ ID NOs: 22477 to 22488.

In some embodiments, the amino acid sequence for a MHC class I peptide vaccine for the IDH1 R132H protein mutation comprises two or more of the SEQ ID NOs: 125 to 140 and SEQ ID NO: 461. In some embodiments, any one of the peptides in the IDH1 R132H vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 125 to 140 or SEQ ID NO: 461.

In some embodiments, the amino acid sequence for a MHC class I peptide vaccine for the IDH1 R132H protein mutation comprises two or more of the SEQ ID NOs: 125 to 140, SEQ ID NO: 461, SEQ ID NOs: 6738 to 7098, and SEQ ID NOs: 22477 to 22488. In some embodiments, any one of the peptides in the IDH1 R132H vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 125 to 140, SEQ ID NO: 461, SEQ ID NOs: 6738 to 7098, or SEQ ID NOs: 22477 to 22488.

In some embodiments, the amino acid sequence for a MHC class I peptide vaccine for the IDH1 R132C protein mutation comprises one or more of the SEQ ID NOs: 119 to 124 and SEQ ID NO: 460. In some embodiments, any one of the peptides in the IDH1 R132C vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 119 to 124 or SEQ ID NO: 460.

In some embodiments, the amino acid sequence for a MHC class I peptide vaccine for the IDH1 R132C protein mutation comprises one or more of the SEQ ID NOs: 119 to 124, SEQ ID NO: 460, SEQ ID NOs: 6499 to 6737, and SEQ ID NOs: 22467 to 22476. In some embodiments, any one of the peptides in the IDH1 R132C vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 119 to 124, SEQ ID NO: 460, SEQ ID NOs: 6499 to 6737, or SEQ ID NOs: 22467 to 22476.

In some embodiments, the amino acid sequence for a MHC class I peptide vaccine for the IDH1 R132C protein mutation comprises two or more of the SEQ ID NOs: 119 to 124 and SEQ ID NO: 460. In some embodiments, any one of the peptides in the IDH1 R132C vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 119 to 124 or SEQ ID NO: 460.

In some embodiments, the amino acid sequence for a MHC class I peptide vaccine for the IDH1 R132C protein mutation comprises two or more of the SEQ ID NOs: 119 to 124, SEQ ID NO: 460, SEQ ID NOs: 6499 to 6737, and SEQ ID NOs: 22467 to 22476. In some embodiments, any one of the peptides in the IDH1 R132C vaccine comprise an amino acid sequence 80, 81, 82, 83, 84, 85, 86, 87, 88, 89, 90, 91, 92, 93, 94, 95, 96, 97, 98 or 99% identical to SEQ ID NOs:

119 to 124, SEQ ID NO: 460, SEQ ID NOs: 6499 to 6737, or SEQ ID NOs: 22467 to 22476.

In some embodiments, the amino acid sequence for a MHC class I peptide vaccine for the KRAS G12D protein mutation comprises one or more of the SEQ ID NOs: 167 to 178 and SEQ ID NO: 464. In some embodiments, any one of the peptides in the KRAS G12D vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 167 to 178 or SEQ ID NO: 464.

In some embodiments, the amino acid sequence for a MHC class I peptide vaccine for the KRAS G12D protein mutation comprises one or more of the SEQ ID NOs: 167 to 178, SEQ ID NO: 464, SEQ ID NOs: 8432 to 9733, and SEQ ID NOs: 22507 to 22518. In some embodiments, any one of the peptides in the KRAS G12D vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 167 to 178, SEQ ID NO: 464, SEQ ID NOs: 8432 to 9733, or SEQ ID NOs: 22507 to 22518.

In some embodiments, the amino acid sequence for a MHC class I peptide vaccine for the KRAS G12D protein mutation comprises two or more of the SEQ ID NOs: 167 to 178 and SEQ ID NO: 464. In some embodiments, any one of the peptides in the KRAS G12D vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 167 to 178 or SEQ ID NO: 464.

In some embodiments, the amino acid sequence for a MHC class I peptide vaccine for the KRAS G12D protein mutation comprises two or more of the SEQ ID NOs: 167 to 178, SEQ ID NO: 464, SEQ ID NOs: 8432 to 9733, and SEQ ID NOs: 22507 to 22518. In some embodiments, any one of the peptides in the KRAS G12D vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 167 to 178, SEQ ID NO: 464, SEQ ID NOs: 8432 to 9733, or SEQ ID NOs: 22507 to 22518.

In some embodiments, the amino acid sequence for a MHC class I peptide vaccine for the KRAS G12V protein mutation comprises one or more of the SEQ ID NOs: 203 to 213. In some embodiments, any one of the peptides in the KRAS G12V vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 203 to 213.

In some embodiments, the amino acid sequence for a MHC class I peptide vaccine for the KRAS G12V protein mutation comprises one or more of the SEQ ID NOs: 203 to 213, SEQ ID NOs: 11009 to 11744, and SEQ ID NOs: 22537 to 22546. In some embodiments, any one of the peptides in the KRAS G12V vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 203 to 213, SEQ ID NOs: 11009 to 11744, or SEQ ID NOs: 22537 to 22546.

In some embodiments, the amino acid sequence for a MHC class I peptide vaccine for the KRAS G12V protein mutation comprises two or more of the SEQ ID NOs: 203 to 213. In some embodiments, any one of the peptides in the KRAS G12V vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 203 to 213.

In some embodiments, the amino acid sequence for a MHC class I peptide vaccine for the KRAS G12V protein mutation comprises two or more of the SEQ ID NOs: 203 to 213, SEQ ID NOs: 11009 to 11744, and SEQ ID NOs: 22537 to 22546. In some embodiments, any one of the peptides in the KRAS G12V vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 203 to 213, SEQ ID NOs: 11009 to 11744, or SEQ ID NOs: 22537 to 22546.

In some embodiments, the amino acid sequence for a MHC class I peptide vaccine for the KRAS G12R protein mutation comprises one or more of the SEQ ID NOs: 179 to 191 and SEQ ID NO: 465. In some embodiments, any one of the peptides in the KRAS G12R vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 179 to 191 or SEQ ID NO: 465.

In some embodiments, the amino acid sequence for a MHC class I peptide vaccine for the KRAS G12R protein mutation comprises one or more of the SEQ ID NOs: 179 to 191, SEQ ID NO: 465, SEQ ID NOs: 9734 to 10236, and SEQ ID NOs: 22519 to 22527. In some embodiments, any one of the peptides in the KRAS G12R vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 179 to 191, SEQ ID NO: 465, SEQ ID NOs: 9734 to 10236, or SEQ ID NOs: 22519 to 22527.

In some embodiments, the amino acid sequence for a MHC class I peptide vaccine for the KRAS G12R protein mutation comprises two or more of the SEQ ID NOs: 179 to 191 and SEQ ID NO: 465. In some embodiments, any one of the peptides in the KRAS G12R vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 179 to 191 or SEQ ID NO: 465.

In some embodiments, the amino acid sequence for a MHC class I peptide vaccine for the KRAS G12R protein mutation comprises two or more of the SEQ ID NOs: 179 to 191, SEQ ID NO: 465, SEQ ID NOs: 9734 to 10236, and SEQ ID NOs: 22519 to 22527. In some embodiments, any one of the peptides in the KRAS G12R vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 179 to 191, SEQ ID NO: 465, SEQ ID NOs: 9734 to 10236, or SEQ ID NOs: 22519 to 22527.

In some embodiments, the amino acid sequence for a MHC class I peptide vaccine for the KRAS G12C protein mutation comprises one or more of the SEQ ID NOs: 154 to 166 and SEQ ID NO: 463. In some embodiments, any one of the peptides in the KRAS G12C vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 154 to 166 or SEQ ID NO: 463.

In some embodiments, the amino acid sequence for a MHC class I peptide vaccine for the KRAS G12C protein mutation comprises one or more of the SEQ ID NOs: 154 to 166, SEQ ID NO: 463, SEQ ID NOs: 7881 to 8431, and SEQ ID NOs: 22498 to 22506. In some embodiments, any one of the peptides in the KRAS G12C vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 154 to 166, SEQ ID NO: 463, SEQ ID NOs: 7881 to 8431, or SEQ ID NOs: 22498 to 22506.

In some embodiments, the amino acid sequence for a MHC class I peptide vaccine for the KRAS G12C protein mutation comprises two or more of the SEQ ID NOs: 154 to 166 and SEQ ID NO: 463. In some embodiments, any one of the peptides in the KRAS G12C vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 154 to 166 or SEQ ID NO: 463.

In some embodiments, the amino acid sequence for a MHC class I peptide vaccine for the KRAS G12C protein mutation comprises two or more of the SEQ ID NOs: 154 to 166, SEQ ID NO: 463, SEQ ID NOs: 7881 to 8431, and SEQ ID NOs: 22498 to 22506. In some embodiments, any one of the peptides in the KRAS G12C vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 154 to 166, SEQ ID NO: 463, SEQ ID NOs: 7881 to 8431, or SEQ
ID NOs: 22498 to 22506.

In some embodiments, the amino acid sequence for a MHC class I peptide vaccine for the KRAS G13D protein mutation comprises one or more of the SEQ ID NOs: 214 to 229 and SEQ ID NO: 466. In some embodiments, any one of the peptides in the KRAS G13D vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 214 to 229 or SEQ ID NO: 466.

In some embodiments, the amino acid sequence for a MHC class I peptide vaccine for the KRAS G13D protein mutation comprises one or more of the SEQ ID NOs: 214 to 229, SEQ ID NO: 466, SEQ ID NOs: 11745 to 12814, and SEQ ID NOs: 22547 to 22558. In some embodiments, any one of the peptides in the KRAS G13D vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 214 to 229, SEQ ID NO: 466, SEQ ID NOs: 11745 to 12814, or SEQ ID NOs: 22547 to 22558.

In some embodiments, the amino acid sequence for a MHC class I peptide vaccine for the KRAS G13D protein mutation comprises two or more of the SEQ ID NOs: 214 to 229 and SEQ ID NO: 466. In some embodiments, any one of the peptides in the KRAS G13D vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 214 to 229 or SEQ ID NO: 466.

In some embodiments, the amino acid sequence for a MHC class I peptide vaccine for the KRAS G13D protein mutation comprises two or more of the SEQ ID NOs: 214 to 229, SEQ ID NO: 466, SEQ ID NOs: 11745 to 12814, and SEQ ID NOs: 22547 to 22558. In some embodiments, any one of the peptides in the KRAS G13D vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 214 to 229, SEQ ID NO: 466, SEQ ID NOs: 11745 to 12814, or SEQ ID NOs: 22547 to 22558.

In some embodiments, the amino acid sequence for a MHC class I peptide vaccine for the KRAS G12A protein mutation comprises one or more of the SEQ ID NOs: 141 to 153 and SEQ ID NO: 462. In some embodiments, any one of the peptides in the KRAS G12A vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 141 to 153 or SEQ ID NO: 462.

In some embodiments, the amino acid sequence for a MHC class I peptide vaccine for the KRAS G12A protein mutation comprises one or more of the SEQ ID NOs: 141 to 153, SEQ ID NO: 462, SEQ ID NOs: 7099 to 7880, and SEQ ID NOs: 22489 to 22497. In some embodiments, any one of the peptides in the KRAS G12A vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 141 to 153, SEQ ID NO: 462, SEQ ID NOs: 7099 to 7880, or SEQ ID NOs: 22489 to 22497.

In some embodiments, the amino acid sequence for a MHC class I peptide vaccine for the KRAS G12A protein mutation comprises two or more of the SEQ ID NOs: 141 to 153 and SEQ ID NO: 462. In some embodiments, any one of the peptides in the KRAS G12A vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 141 to 153 or SEQ ID NO: 462.

In some embodiments, the amino acid sequence for a MHC class I peptide vaccine for the KRAS G12A protein mutation comprises two or more of the SEQ ID NOs: 141 to 153, SEQ ID NO: 462, SEQ ID NOs: 7099 to 7880, and SEQ ID NOs: 22489 to 22497. In some embodiments, any one of the peptides in the KRAS G12A vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 141 to 153, SEQ ID NO: 462, SEQ ID NOs: 7099 to 7880, or SEQ ID NOs: 22489 to 22497.

In some embodiments, the amino acid sequence for a MHC class I peptide vaccine for the KRAS G12S protein mutation comprises one or more of the SEQ ID NOs: 192 to 202. In some embodiments, any one of the peptides in the KRAS G12S vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 192 to 202.

In some embodiments, the amino acid sequence for a MHC class I peptide vaccine for the KRAS G12S protein mutation comprises one or more of the SEQ ID NOs: 192 to 202, SEQ ID NOs: 10237 to 11008, and SEQ ID NOs: 22528 to 22536. In some embodiments, any one of the peptides in the KRAS G12S vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 192 to 202, SEQ ID NOs: 10237 to 11008, or SEQ ID NOs: 22528 to 22536.

In some embodiments, the amino acid sequence for a MHC class I peptide vaccine for the KRAS G12S protein mutation comprises two or more of the SEQ ID NOs: 192 to 202. In some embodiments, any one of the peptides in the KRAS G12S vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 192 to 202.

In some embodiments, the amino acid sequence for a MHC class I peptide vaccine for the KRAS G12S protein mutation comprises two or more of the SEQ ID NOs: 192 to 202, SEQ ID NOs: 10237 to 11008, and SEQ ID NOs: 22528 to 22536. In some embodiments, any one of the peptides in the KRAS G12S vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 192 to 202, SEQ ID NOs: 10237 to 11008, or SEQ ID NOs: 22528 to 22536.

In some embodiments, the amino acid sequence for a MHC class I peptide vaccine for the NRAS Q61R protein mutation comprises one or more of the SEQ ID NOs: 256 to 272. In some embodiments, any one of the peptides in the NRAS Q61R vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 256 to 272.

In some embodiments, the amino acid sequence for a MHC class I peptide vaccine for the NRAS Q61R protein mutation comprises one or more of the SEQ ID NOs: 256 to 272, SEQ ID NOs: 14315 to 14836, and SEQ ID NOs: 22577 to 22582. In some embodiments, any one of the peptides in the NRAS Q61R vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 256 to 272, SEQ ID NOs: 14315 to 14836, or SEQ ID NOs: 22577 to 22582.

In some embodiments, the amino acid sequence for a MHC class I peptide vaccine for the NRAS Q61R protein mutation comprises two or more of the SEQ ID NOs: 256 to 272. In some embodiments, any one of the peptides in the NRAS Q61R vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 256 to 272.

In some embodiments, the amino acid sequence for a MHC class I peptide vaccine for the NRAS Q61R protein mutation comprises two or more of the SEQ ID NOs: 256 to 272, SEQ ID NOs: 14315 to 14836, and SEQ ID NOs: 22577 to 22582. In some embodiments, any one of the peptides in the NRAS Q61R vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 256 to 272, SEQ ID NOs: 14315 to 14836, or SEQ ID NOs: 22577 to 22582.

In some embodiments, the amino acid sequence for a MHC class I peptide vaccine for the NRAS Q61K protein mutation comprises one or more of the SEQ ID NOs: 230 to 238. In some embodiments, any one of the peptides in the NRAS Q61K vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 230 to 238.

In some embodiments, the amino acid sequence for a MHC class I peptide vaccine for the NRAS Q61K protein mutation comprises one or more of the SEQ ID NOs: 230 to 238, SEQ ID NOs: 12815 to 13434, and SEQ ID NOs: 22559 to 22567. In some embodiments, any one of the peptides in the NRAS Q61K vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 230 to 238, SEQ ID NOs: 12815 to 13434, or SEQ ID NOs: 22559 to 22567.

In some embodiments, the amino acid sequence for a MHC class I peptide vaccine for the NRAS Q61K protein mutation comprises two or more of the SEQ ID NOs: 230 to 238. In some embodiments, any one of the peptides in the NRAS Q61K vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 230 to 238.

In some embodiments, the amino acid sequence for a MHC class I peptide vaccine for the NRAS Q61K protein mutation comprises two or more of the SEQ ID NOs: 230 to 238, SEQ ID NOs: 12815 to 13434, and SEQ ID NOs: 22559 to 22567. In some embodiments, any one of the peptides in the NRAS Q61K vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 230 to 238, SEQ ID NOs: 12815 to 13434, or SEQ ID NOs: 22559 to 22567.

In some embodiments, the amino acid sequence for a MHC class I peptide vaccine for the NRAS Q61L protein mutation comprises one or more of the SEQ ID NOs: 239 to 255. In some embodiments, any one of the peptides in the NRAS Q61L vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 239 to 255.

In some embodiments, the amino acid sequence for a MHC class I peptide vaccine for the NRAS Q61L protein mutation comprises one or more of the SEQ ID NOs: 239 to 255, SEQ ID NOs: 13435 to 14314, and SEQ ID NOs: 22568 to 22576. In some embodiments, any one of the peptides in the NRAS Q61L vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 239 to 255, SEQ ID NOs: 13435 to 14314, or SEQ ID NOs: 22568 to 22576.

In some embodiments, the amino acid sequence for a MHC class I peptide vaccine for the NRAS Q61L protein mutation comprises two or more of the SEQ ID NOs: 239 to 255. In some embodiments, any one of the peptides in the NRAS Q61L vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 239 to 255.

In some embodiments, the amino acid sequence for a MHC class I peptide vaccine for the NRAS Q61L protein mutation comprises two or more of the SEQ ID NOs: 239 to 255, SEQ ID NOs: 13435 to 14314, and SEQ ID NOs: 22568 to 22576. In some embodiments, any one of the peptides in the NRAS Q61L vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 239 to 255, SEQ ID NOs: 13435 to 14314, or SEQ ID NOs: 22568 to 22576.

In some embodiments, the amino acid sequence for a MHC class I peptide vaccine for the PIK3CA E542K protein mutation comprises one or more of the SEQ ID NOs: 273 to 285. In some embodiments, any one of the peptides in the PIK3CA E542K vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 273 to 285.

In some embodiments, the amino acid sequence for a MHC class I peptide vaccine for the PIK3CA E542K protein mutation comprises one or more of the SEQ ID NOs: 273 to 285, SEQ ID NOs: 14837 to 15625, and SEQ ID NOs: 22583 to 22592. In some embodiments, any one of the peptides in the PIK3CA E542K vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 273 to 285, SEQ ID NOs: 14837 to 15625, or SEQ ID NOs: 22583 to 22592.

In some embodiments, the amino acid sequence for a MHC class I peptide vaccine for the PIK3CA E542K protein mutation comprises two or more of the SEQ ID NOs: 273 to 285. In some embodiments, any one of the peptides in the PIK3CA E542K vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 273 to 285.

In some embodiments, the amino acid sequence for a MHC class I peptide vaccine for the PIK3CA E542K protein mutation comprises two or more of the SEQ ID NOs: 273 to 285, SEQ ID NOs: 14837 to 15625, and SEQ ID NOs: 22583 to 22592. In some embodiments, any one of the peptides in the PIK3CA E542K vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 273 to 285, SEQ ID NOs: 14837 to 15625, or SEQ ID NOs: 22583 to 22592.

In some embodiments, the amino acid sequence for a MHC class I peptide vaccine for the PIK3CA E545K protein mutation comprises one or more of the SEQ ID NOs: 286 to 293 and SEQ ID NO: 467. In some embodiments, any one of the peptides in the PIK3CA E545K vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 286 to 293 or SEQ ID NO: 467.

In some embodiments, the amino acid sequence for a MHC class I peptide vaccine for the PIK3CA E545K protein mutation comprises one or more of the SEQ ID NOs: 286 to 293, SEQ ID NO: 467, SEQ ID NOs: 15626 to 15907, and SEQ ID NOs: 22593 to 22602. In some embodiments, any one of the peptides in the PIK3CA E545K vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 286 to 293, SEQ ID NO: 467, SEQ ID NOs: 15626 to 15907, or SEQ ID NOs: 22593 to 22602.

In some embodiments, the amino acid sequence for a MHC class I peptide vaccine for the PIK3CA E545K protein mutation comprises two or more of the SEQ ID NOs: 286 to 293 and SEQ ID NO: 467. In some embodiments, any one of the peptides in the PIK3CA E545K vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 286 to 293 or SEQ ID NO: 467.

In some embodiments, the amino acid sequence for a MHC class I peptide vaccine for the PIK3CA E545K protein mutation comprises two or more of the SEQ ID NOs: 286 to 293, SEQ ID NO: 467, SEQ ID NOs: 15626 to 15907, and SEQ ID NOs: 22593 to 22602. In some embodiments, any one of the peptides in the PIK3CA E545K vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 286 to 293, SEQ ID NO: 467, SEQ ID NOs: 15626 to 15907, or SEQ ID NOs: 22593 to 22602.

In some embodiments, the amino acid sequence for a MHC class I peptide vaccine for the PIK3CA H1047R protein mutation comprises one or more of the SEQ ID NOs: 294 to 309. In some embodiments, any one of the peptides in the PIK3CA H1047R vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 294 to 309.

In some embodiments, the amino acid sequence for a MHC class I peptide vaccine for the PIK3CA H1047R protein mutation comprises one or more of the SEQ ID NOs: 294 to 309, SEQ ID NOs: 15908 to 16276, and SEQ ID NOs: 22603 to 22608. In some embodiments, any one of the peptides in the PIK3CA H1047R vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 294 to 309, SEQ ID NOs: 15908 to 16276, or SEQ ID NOs: 22603 to 22608.

In some embodiments, the amino acid sequence for a MHC class I peptide vaccine for the PIK3CA H1047R protein mutation comprises two or more of the SEQ ID NOs: 294 to 309. In some embodiments, any one of the peptides in the PIK3CA H1047R vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 294 to 309.

In some embodiments, the amino acid sequence for a MHC class I peptide vaccine for the PIK3CA H1047R protein mutation comprises two or more of the SEQ ID NOs: 294 to 309, SEQ ID NOs: 15908 to 16276, and SEQ ID NOs: 22603 to 22608. In some embodiments, any one of the peptides in the PIK3CA H1047R vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 294 to 309, SEQ ID NOs: 15908 to 16276, or SEQ ID NOs: 22603 to 22608.

In some embodiments, the amino acid sequence for a MHC class I peptide vaccine for the TP53 R158L protein mutation comprises one or more of the SEQ ID NOs: 359 to 374 and SEQ ID NOs: 469 to 470. In some embodiments, any one of the peptides in the TP53 R158L vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 359 to 374 or SEQ ID NOs: 469 to 470.

In some embodiments, the amino acid sequence for a MHC class I peptide vaccine for the TP53 R158L protein mutation comprises one or more of the SEQ ID NOs: 359 to 374, SEQ ID NOs: 469 to 470, SEQ ID NOs: 18414 to 19404, and SEQ ID NOs: 22644 to 22657. In some embodiments, any one of the peptides in the TP53 R158L vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 359 to 374, SEQ ID NOs: 469 to 470, SEQ ID NOs: 18414 to 19404, or SEQ ID NOs: 22644 to 22657.

In some embodiments, the amino acid sequence for a MHC class I peptide vaccine for the TP53 R158L protein mutation comprises two or more of the SEQ ID NOs: 359 to 374 and SEQ ID NOs: 469 to 470. In some embodiments, any one of the peptides in the TP53 R158L vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 359 to 374 or SEQ ID NOs: 469 to 470.

In some embodiments, the amino acid sequence for a MHC class I peptide vaccine for the TP53 R158L protein mutation comprises two or more of the SEQ ID NOs: 359 to 374, SEQ ID NOs: 469 to 470, SEQ ID NOs: 18414 to 19404, and SEQ ID NOs: 22644 to 22657. In some embodiments, any one of the peptides in the TP53 R158L vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 359 to 374, SEQ ID NOs: 469 to 470, SEQ ID NOs: 18414 to 19404, or SEQ ID NOs: 22644 to 22657.

In some embodiments, the amino acid sequence for a MHC class I peptide vaccine for the TP53 R175H protein mutation comprises one or more of the SEQ ID NOs: 375 to 386 and SEQ ID NOs: 471 to 472. In some embodiments, any one of the peptides in the TP53 R175H vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 375 to 386 or SEQ ID NOs: 471 to 472.

In some embodiments, the amino acid sequence for a MHC class I peptide vaccine for the TP53 R175H protein mutation comprises one or more of the SEQ ID NOs: 375 to 386, SEQ ID NOs: 471 to 472, SEQ ID NOs: 19405 to 19752, and SEQ ID NOs: 22658 to 22665. In some embodiments, any one of the peptides in the TP53 R175H vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 375 to 386, SEQ ID NOs: 471 to 472, SEQ ID NOs: 19405 to 19752, or SEQ ID NOs: 22658 to 22665.

In some embodiments, the amino acid sequence for a MHC class I peptide vaccine for the TP53 R175H protein mutation comprises two or more of the SEQ ID NOs: 375 to 386 and SEQ ID NOs: 471 to 472. In some embodiments, any one of the peptides in the TP53 R175H vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 375 to 386 or SEQ ID NOs: 471 to 472.

In some embodiments, the amino acid sequence for a MHC class I peptide vaccine for the TP53 R175H protein mutation comprises two or more of the SEQ ID NOs: 375 to 386, SEQ ID NOs: 471 to 472, SEQ ID NOs: 19405 to 19752, and SEQ ID NOs: 22658 to 22665. In some embodiments, any one of the peptides in the TP53 R175H vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 375 to 386, SEQ ID NOs: 471 to 472, SEQ ID NOs: 19405 to 19752, or SEQ ID NOs: 22658 to 22665.

In some embodiments, the amino acid sequence for a MHC class I peptide vaccine for the TP53 R248Q protein mutation comprises one or more of the SEQ ID NOs: 387 to 401. In some embodiments, any one of the peptides in the TP53 R248Q vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 387 to 401.

In some embodiments, the amino acid sequence for a MHC class I peptide vaccine for the TP53 R248Q protein mutation comprises one or more of the SEQ ID NOs: 387 to 401, SEQ ID NOs: 19753 to 20608, and SEQ ID NOs: 22666 to 22678. In some embodiments, any one of the peptides in the TP53 R248Q vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 387 to 401, SEQ ID NOs: 19753 to 20608, or SEQ ID NOs: 22666 to 22678.

In some embodiments, the amino acid sequence for a MHC class I peptide vaccine for the TP53 R248Q protein mutation comprises two or more of the SEQ ID NOs: 387 to 401. In some embodiments, any one of the peptides in the TP53 R248Q vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 387 to 401.

In some embodiments, the amino acid sequence for a MHC class I peptide vaccine for the TP53 R248Q protein mutation comprises two or more of the SEQ ID NOs: 387 to 401, SEQ ID NOs: 19753 to 20608, and SEQ ID NOs: 22666 to 22678. In some embodiments, any one of the peptides in the TP53 R248Q vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 387 to 401, SEQ ID NOs: 19753 to 20608, or SEQ ID NOs: 22666 to 22678.

In some embodiments, the amino acid sequence for a MHC class I peptide vaccine for the TP53 R273C protein mutation comprises one or more of the SEQ ID NOs: 422 to 432 and SEQ ID NO: 473. In some embodiments, any one of the peptides in the TP53 R273C vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 422 to 432 or SEQ ID NO: 473.

In some embodiments, the amino acid sequence for a MHC class I peptide vaccine for the TP53 R273C protein mutation comprises one or more of the SEQ ID NOs: 422 to 432, SEQ ID NO: 473, SEQ ID NOs: 21192 to 21462, and SEQ ID NOs: 22690 to 22701. In some embodiments, any one of the peptides in the TP53 R273C vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 422 to 432, SEQ ID NO: 473, SEQ ID NOs: 21192 to 21462, or SEQ ID NOs: 22690 to 22701.

In some embodiments, the amino acid sequence for a MHC class I peptide vaccine for the TP53 R273C protein mutation comprises two or more of the SEQ ID NOs: 422 to 432 and SEQ ID NO: 473. In some embodiments, any one of the peptides in the TP53 R273C vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 422 to 432 or SEQ ID NO: 473.

In some embodiments, the amino acid sequence for a MHC class I peptide vaccine for the TP53 R273C protein mutation comprises two or more of the SEQ ID NOs: 422 to 432, SEQ ID NO: 473, SEQ ID NOs: 21192 to 21462, and SEQ ID NOs: 22690 to 22701. In some embodiments, any one of the peptides in the TP53 R273C vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 422 to 432, SEQ ID NO: 473, SEQ ID NOs: 21192 to 21462, or SEQ ID NOs: 22690 to 22701.

In some embodiments, the amino acid sequence for a MHC class I peptide vaccine for the TP53 R273H protein mutation comprises one or more of the SEQ ID NOs: 433 to 446 and SEQ ID NO: 474. In some embodiments, any one of the peptides in the TP53 R273H vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 433 to 446 or SEQ ID NO: 474.

In some embodiments, the amino acid sequence for a MHC class I peptide vaccine for the TP53 R273H protein mutation comprises one or more of the SEQ ID NOs: 433 to 446, SEQ ID NO: 474, SEQ ID NOs: 21463 to 21845, and SEQ ID NOs: 22702 to 22713. In some embodiments, any one of the peptides in the TP53 R273H vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 433 to 446, SEQ ID NO: 474, SEQ ID NOs: 21463 to 21845, or SEQ ID NOs: 22702 to 22713.

In some embodiments, the amino acid sequence for a MHC class I peptide vaccine for the TP53 R273H protein mutation comprises two or more of the SEQ ID NOs: 433 to 446 and SEQ ID NO: 474. In some embodiments, any one of the peptides in the TP53 R273H vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 433 to 446 or SEQ ID NO: 474.

In some embodiments, the amino acid sequence for a MHC class I peptide vaccine for the TP53 R273H protein mutation comprises two or more of the SEQ ID NOs: 433 to 446, SEQ ID NO: 474, SEQ ID NOs: 21463 to 21845, and SEQ ID NOs: 22702 to 22713. In some embodiments, any one of the peptides in the TP53 R273H vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 433 to 446, SEQ ID NO: 474, SEQ ID NOs: 21463 to 21845, or SEQ ID NOs: 22702 to 22713.

In some embodiments, the amino acid sequence for a MHC class I peptide vaccine for the TP53 R248W protein mutation comprises one or more of the SEQ ID NOs: 402 to 421. In some embodiments, any one of the peptides in the TP53 R248W vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 402 to 421.

In some embodiments, the amino acid sequence for a MHC class I peptide vaccine for the TP53 R248W protein mutation comprises one or more of the SEQ ID NOs: 402 to 421, SEQ ID NOs: 20609 to 21191, and SEQ ID NOs: 22679 to 22689. In some embodiments, any one of the peptides in the TP53 R248W vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 402 to 421, SEQ ID NOs: 20609 to 21191, or SEQ ID NOs: 22679 to 22689.

In some embodiments, the amino acid sequence for a MHC class I peptide vaccine for the TP53 R248W protein mutation comprises two or more of the SEQ ID NOs: 402 to 421. In some embodiments, any one of the peptides in the TP53 R248W vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 402 to 421.

In some embodiments, the amino acid sequence for a MHC class I peptide vaccine for the TP53 R248W protein mutation comprises two or more of the SEQ ID NOs: 402 to 421, SEQ ID NOs: 20609 to 21191, and SEQ ID NOs: 22679 to 22689. In some embodiments, any one of the peptides in the TP53 R248W vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 402 to 421, SEQ ID NOs: 20609 to 21191, or SEQ ID NOs: 22679 to 22689.

In some embodiments, the amino acid sequence for a MHC class I peptide vaccine for the TP53 R282W protein mutation comprises one or more of the SEQ ID NOs: 447 to 449. In some embodiments, any one of the peptides in the TP53 R282W vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 447 to 449.

In some embodiments, the amino acid sequence for a MHC class I peptide vaccine for the TP53 R282W protein mutation comprises one or more of the SEQ ID NOs: 447 to 449, SEQ ID NOs: 21846 to 21940, and SEQ ID NOs: 22714 to 22720. In some embodiments, any one of the peptides in the TP53 R282W vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 447 to 449, SEQ ID NOs: 21846 to 21940, or SEQ ID NOs: 22714 to 22720.

In some embodiments, the amino acid sequence for a MHC class I peptide vaccine for the TP53 R282W protein mutation comprises two or more of the SEQ ID NOs: 447 to 449. In some embodiments, any one of the peptides in the TP53 R282W vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 447 to 449.

In some embodiments, the amino acid sequence for a MHC class I peptide vaccine for the TP53 R282W protein mutation comprises two or more of the SEQ ID NOs: 447 to 449, SEQ ID NOs: 21846 to 21940, and SEQ ID NOs: 22714 to 22720. In some embodiments, any one of the peptides in the TP53 R282W vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 447 to 449, SEQ ID NOs: 21846 to 21940, or SEQ ID NOs: 22714 to 22720.

In some embodiments, the amino acid sequence for a MHC class I peptide vaccine for the TP53 Y220C protein mutation comprises one or more of the SEQ ID NOs: 450 to 458. In some embodiments, any one of the peptides in the TP53 Y220C vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 450 to 458.

In some embodiments, the amino acid sequence for a MHC class I peptide vaccine for the TP53 Y220C protein mutation comprises one or more of the SEQ ID NOs: 450 to 458, SEQ ID NOs: 21941 to 22385, and SEQ ID NOs: 22721 to 22727. In some embodiments, any one of the peptides in the TP53 Y220C vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 450 to 458, SEQ ID NOs: 21941 to 22385, or SEQ ID NOs: 22721 to 22727.

In some embodiments, the amino acid sequence for a MHC class I peptide vaccine for the TP53 Y220C protein mutation comprises two or more of the SEQ ID NOs: 450 to 458. In some embodiments, any one of the peptides in the TP53 Y220C vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 450 to 458.

In some embodiments, the amino acid sequence for a MHC class I peptide vaccine for the TP53 Y220C protein mutation comprises two or more of the SEQ ID NOs: 450 to 458, SEQ ID NOs: 21941 to 22385, and SEQ ID NOs: 22721 to 22727. In some embodiments, any one of the peptides in the TP53 Y220C vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 450 to 458, SEQ ID NOs: 21941 to 22385, or SEQ ID NOs: 22721 to 22727.

In some embodiments, the amino acid sequence for a MHC class I peptide vaccine for the PIK3CA R88Q protein mutation comprises one or more of the SEQ ID NOs: 310 to 322 and SEQ ID NO: 468. In some embodiments, any one of the peptides in the PIK3CA R88Q vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 310 to 322 or SEQ ID NO: 468.

In some embodiments, the amino acid sequence for a MHC class I peptide vaccine for the PIK3CA R88Q protein mutation comprises one or more of the SEQ ID NOs: 310 to 322, SEQ ID NO: 468, SEQ ID NOs: 16277 to 17342, and SEQ ID NOs: 22609 to 22622. In some embodiments, any one of the peptides in the PIK3CA R88Q vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 310 to 322, SEQ ID NO: 468, SEQ ID NOs: 16277 to 17342, or SEQ ID NOs: 22609 to 22622.

In some embodiments, the amino acid sequence for a MHC class I peptide vaccine for the PIK3CA R88Q protein mutation comprises two or more of the SEQ ID NOs: 310 to 322 and SEQ ID NO: 468. In some embodiments, any one of the peptides in the PIK3CA R88Q vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 310 to 322 or SEQ ID NO: 468.

In some embodiments, the amino acid sequence for a MHC class I peptide vaccine for the PIK3CA R88Q protein mutation comprises two or more of the SEQ ID NOs: 310 to 322, SEQ ID NO: 468, SEQ ID NOs: 16277 to 17342, and SEQ ID NOs: 22609 to 22622. In some embodiments, any one of the peptides in the PIK3CA R88Q vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 310 to 322, SEQ ID NO: 468, SEQ ID NOs: 16277 to 17342, or SEQ ID NOs: 22609 to 22622.

In some embodiments, the amino acid sequence for a MHC class I peptide vaccine for the GTF2I L424H protein mutation comprises one or more of the SEQ ID NOs: 99 to 118. In some embodiments, any one of the peptides in the GTF2I L424H vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 99 to 118.

In some embodiments, the amino acid sequence for a MHC class I peptide vaccine for the GTF2I L424H protein mutation comprises one or more of the SEQ ID NOs: 99 to 118, SEQ ID NOs: 5757 to 6498, and SEQ ID NOs: 22450 to 22466. In some embodiments, any one of the peptides in the GTF2I L424H vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 99 to 118, SEQ ID NOs: 5757 to 6498, or SEQ ID NOs: 22450 to 22466.

In some embodiments, the amino acid sequence for a MHC class I peptide vaccine for the GTF2I L424H protein mutation comprises two or more of the SEQ ID NOs: 99 to 118. In some embodiments, any one of the peptides in the GTF2I L424H vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 99 to 118.

In some embodiments, the amino acid sequence for a MHC class I peptide vaccine for the GTF2I L424H protein mutation comprises two or more of the SEQ ID NOs: 99 to 118, SEQ ID NOs: 5757 to 6498, and SEQ ID NOs: 22450 to 22466. In some embodiments, any one of the peptides in the GTF2I L424H vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 99 to 118, SEQ ID NOs: 5757 to 6498, or SEQ ID NOs: 22450 to 22466.

In some embodiments, the amino acid sequence for a MHC class I peptide vaccine for the PTEN R130Q protein mutation comprises one or more of the SEQ ID NOs: 338 to 353. In some embodiments, any one of the peptides in the PTEN R130Q vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 338 to 353.

In some embodiments, the amino acid sequence for a MHC class I peptide vaccine for the PTEN R130Q protein mutation comprises one or more of the SEQ ID NOs: 338 to 353, SEQ ID NOs: 17869 to 18205, and SEQ ID NOs: 22630 to 22636. In some embodiments, any one of the peptides in the PTEN R130Q vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 338 to 353, SEQ ID NOs: 17869 to 18205, or SEQ ID NOs: 22630 to 22636.

In some embodiments, the amino acid sequence for a MHC class I peptide vaccine for the PTEN R130Q protein mutation comprises two or more of the SEQ ID NOs: 338 to 353. In some embodiments, any one of the peptides in the PTEN R130Q vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 338 to 353.

In some embodiments, the amino acid sequence for a MHC class I peptide vaccine for the PTEN R130Q protein mutation comprises two or more of the SEQ ID NOs: 338 to 353, SEQ ID NOs: 17869 to 18205, and SEQ ID NOs: 22630 to 22636. In some embodiments, any one of the peptides in the PTEN R130Q vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 338 to 353, SEQ ID NOs: 17869 to 18205, or SEQ ID NOs: 22630 to 22636.

In some embodiments, the amino acid sequence for a MHC class I peptide vaccine for the AKT1 E17K protein mutation comprises one or more of the SEQ ID NOs: 1 to 18 and SEQ ID NO: 459. In some embodiments, any one of the peptides in the AKT1 E17K vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 1 to 18 or SEQ ID NO: 459.

In some embodiments, the amino acid sequence for a MHC class I peptide vaccine for the AKT1 E17K protein mutation comprises one or more of the SEQ ID NOs: 1 to 18, SEQ ID NO: 459, SEQ ID NOs: 760 to 1768, and SEQ ID NOs: 22386 to 22396. In some embodiments, any one of the peptides in the AKT1 E17K vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 1 to 18, SEQ ID NO: 459, SEQ ID NOs: 760 to 1768, or SEQ ID NOs: 22386 to 22396.

In some embodiments, the amino acid sequence for a MHC class I peptide vaccine for the AKT1 E17K protein mutation comprises two or more of the SEQ ID NOs: 1 to 18 and SEQ ID NO: 459. In some embodiments, any one of the peptides in the AKT1 E17K vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 1 to 18 or SEQ ID NO: 459.

In some embodiments, the amino acid sequence for a MHC class I peptide vaccine for the AKT1 E17K protein mutation comprises two or more of the SEQ ID NOs: 1 to 18, SEQ ID NO: 459, SEQ ID NOs: 760 to 1768, and SEQ ID NOs: 22386 to 22396. In some embodiments, any one of the peptides in the AKT1 E17K vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 1 to 18, SEQ ID NO: 459, SEQ ID NOs: 760 to 1768, or SEQ ID NOs: 22386 to 22396.

In some embodiments, the amino acid sequence for a MHC class I peptide vaccine for the PTEN R130G protein mutation comprises one or more of the SEQ ID NOs: 323 to 337. In some embodiments, any one of the peptides in the PTEN R130G vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 323 to 337.

In some embodiments, the amino acid sequence for a MHC class I peptide vaccine for the PTEN R130G protein mutation comprises one or more of the SEQ ID NOs: 323 to 337, SEQ ID NOs: 17343 to 17868, and SEQ ID NOs: 22623 to 22629. In some embodiments, any one of the peptides in the PTEN R130G vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 323 to 337, SEQ ID NOs: 17343 to 17868, or SEQ ID NOs: 22623 to 22629.

In some embodiments, the amino acid sequence for a MHC class I peptide vaccine for the PTEN R130G protein mutation comprises two or more of the SEQ ID NOs: 323 to 337. In some embodiments, any one of the peptides in the PTEN R130G vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 323 to 337.

In some embodiments, the amino acid sequence for a MHC class I peptide vaccine for the PTEN R130G protein mutation comprises two or more of the SEQ ID NOs: 323 to 337, SEQ ID NOs: 17343 to 17868, and SEQ ID NOs: 22623 to 22629. In some embodiments, any one of the peptides in the PTEN R130G vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 323 to 337, SEQ ID NOs: 17343 to 17868, or SEQ ID NOs: 22623 to 22629.

In some embodiments, the amino acid sequence for a MHC class I peptide vaccine for the TP53 H179R protein mutation comprises one or more of the SEQ ID NOs: 354 to 358. In some embodiments, any one of the peptides in the TP53 H179R vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 354 to 358.

In some embodiments, the amino acid sequence for a MHC class I peptide vaccine for the TP53 H179R protein mutation comprises one or more of the SEQ ID NOs: 354 to 358, SEQ ID NOs: 18206 to 18413, and SEQ ID NOs: 22637 to 22643. In some embodiments, any one of the peptides in the TP53 H179R vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 354 to 358, SEQ ID NOs: 18206 to 18413, or SEQ ID NOs: 22637 to 22643.

In some embodiments, the amino acid sequence for a MHC class I peptide vaccine for the TP53 H179R protein mutation comprises two or more of the SEQ ID NOs: 354 to 358. In some embodiments, any one of the peptides in the TP53 H179R vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 354 to 358.

In some embodiments, the amino acid sequence for a MHC class I peptide vaccine for the TP53 H179R protein mutation comprises two or more of the SEQ ID NOs: 354 to 358, SEQ ID NOs: 18206 to 18413, and SEQ ID NOs: 22637 to 22643. In some embodiments, any one of the peptides in the TP53 H179R vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 354 to 358, SEQ ID NOs: 18206 to 18413, or SEQ ID NOs: 22637 to 22643.

In some embodiments, the amino acid sequence vaccine for a MHC class I peptide vaccine for pancreatic cancer comprises one or more of the SEQ ID NOs: 168 to 169, SEQ ID NO: 171, SEQ ID NOs: 179 to 180, SEQ ID NOs: 182 to 183, SEQ ID NOs: 203 to 204, and SEQ ID NO: 207. In some embodiments, any one of the peptides in the pancreatic cancer vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 168 to 169, SEQ ID NO: 171, SEQ ID NOs: 179 to 180, SEQ ID NOs: 182 to 183, SEQ ID NOs: 203 to 204, or SEQ ID NO: 207.

In some embodiments, the amino acid sequence vaccine for a MHC class I peptide vaccine for pancreatic cancer comprises two or more of the SEQ ID NOs: 168 to 169, SEQ ID NO: 171, SEQ ID NOs: 179 to 180, SEQ ID NOs: 182 to 183, SEQ ID NOs: 203 to 204, and SEQ ID NO: 207. In some embodiments, any one of the peptides in the pancreatic cancer vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 168 to 169, SEQ ID NO: 171, SEQ ID NOs: 179 to 180, SEQ ID NOs: 182 to 183, SEQ ID NOs: 203 to 204, or SEQ ID NO: 207.

In some embodiments, the amino acid sequence vaccine for a MHC class I peptide vaccine for skin cancer comprises one or more of the SEQ ID NOs: 19 to 23, SEQ ID NOs: 34 to 40, SEQ ID NOs: 230 to 231, SEQ ID NO: 239, SEQ ID NOs: 241 to 242, and SEQ ID NOs: 260 to 262. In some embodiments, any one of the peptides in the skin cancer vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 19 to 23, SEQ ID NOs: 34 to 40, SEQ ID NOs: 230 to 231, SEQ ID NO: 239, SEQ ID NOs: 241 to 242, or SEQ ID NOs: 260 to 262.

In some embodiments, the amino acid sequence vaccine for a MHC class I peptide vaccine for skin cancer comprises two or more of the SEQ ID NOs: 19 to 23, SEQ ID NOs: 34 to 40, SEQ ID NOs: 230 to 231, SEQ ID NO: 239, SEQ ID NOs: 241 to 242, and SEQ ID NOs: 260 to 262. In some embodiments, any one of the peptides in the skin cancer vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 19 to 23, SEQ ID NOs: 34 to 40, SEQ ID NOs: 230 to 231, SEQ ID NO: 239, SEQ ID NOs: 241 to 242, or SEQ ID NOs: 260 to 262.

In some embodiments, the amino acid sequence vaccine for a MHC class I peptide vaccine for thyroid cancer comprises one or more of the SEQ ID NOs: 19 to 23, SEQ ID NOs: 230 to 231, and SEQ ID NOs: 260 to 262. In some embodiments, any one of the peptides in the thyroid cancer vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 19 to 23, SEQ ID NOs: 230 to 231, or SEQ ID NOs: 260 to 262.

In some embodiments, the amino acid sequence vaccine for a MHC class I peptide vaccine for thyroid cancer comprises two or more of the SEQ ID NOs: 19 to 23, SEQ ID NOs: 230 to 231, and SEQ ID NOs: 260 to 262. In some embodiments, any one of the peptides in the thyroid cancer vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 19 to 23, SEQ ID NOs: 230 to 231, or SEQ ID NOs: 260 to 262.

In some embodiments, the amino acid sequence vaccine for a MHC class I peptide vaccine for brain cancer comprises one or more of the SEQ ID NOs: 51 to 55, SEQ ID NOs: 67 to 70, SEQ ID NOs: 72 to 73, SEQ ID NOs: 119 to 120, SEQ ID NOs: 125 to 130, SEQ ID NO: 375, SEQ ID NO: 423, SEQ ID NO: 425, and SEQ ID NOs: 471 to 473. In some embodiments, any one of the peptides in the brain cancer vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 51 to 55, SEQ ID NOs: 67 to 70, SEQ ID NOs: 72 to 73, SEQ ID NOs: 119 to 120, SEQ ID NOs: 125 to 130, SEQ ID NO: 375, SEQ ID NO: 423, SEQ ID NO: 425, or SEQ ID NOs: 471 to 473.

In some embodiments, the amino acid sequence vaccine for a MHC class I peptide vaccine for brain cancer comprises two or more of the SEQ ID NOs: 51 to 55, SEQ ID NOs: 67 to 70, SEQ ID NOs: 72 to 73, SEQ ID NOs: 119 to 120, SEQ ID NOs: 125 to 130, SEQ ID NO: 375, SEQ ID NO: 423, SEQ ID NO: 425, and SEQ ID NOs: 471 to 473. In some embodiments, any one of the peptides in the brain cancer vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 51 to 55, SEQ ID NOs: 67 to 70, SEQ ID NOs: 72 to 73, SEQ ID NOs: 119 to 120, SEQ ID NOs: 125 to 130, SEQ ID NO: 375, SEQ ID NO: 423, SEQ ID NO: 425, or SEQ ID NOs: 471 to 473.

In some embodiments, the amino acid sequence vaccine for a MHC class I peptide vaccine for colorectal cancer comprises one or more of the SEQ ID NOs: 20 to 23, SEQ ID NOs: 167 to 169, SEQ ID NO: 171, SEQ ID NOs: 203 to 207, SEQ ID NOs: 215 to 217, SEQ ID NO: 288, SEQ ID NO: 467, and SEQ ID NOs: 471 to 472. In some embodiments, any one of the peptides in the colorectal cancer vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 20 to 23, SEQ ID NOs: 167 to 169, SEQ ID NO: 171, SEQ ID NOs: 203 to 207, SEQ ID NOs: 215 to 217, SEQ ID NO: 288, SEQ ID NO: 467, or SEQ ID NOs: 471 to 472.

In some embodiments, the amino acid sequence vaccine for a MHC class I peptide vaccine for colorectal cancer comprises two or more of the SEQ ID NOs: 20 to 23, SEQ ID NOs: 167 to 169, SEQ ID NO: 171, SEQ ID NOs: 203 to 207, SEQ ID NOs: 215 to 217, SEQ ID NO: 288, SEQ ID NO: 467, and SEQ ID NOs: 471 to 472. In some embodiments, any one of the peptides in the colorectal cancer vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 20 to 23, SEQ ID NOs: 167 to 169, SEQ ID NO: 171, SEQ ID NOs: 203 to 207, SEQ ID NOs: 215 to 217, SEQ ID NO: 288, SEQ ID NO: 467, or SEQ ID NOs: 471 to 472.

In some embodiments, the amino acid sequence vaccine for a MHC class I peptide vaccine for bronchus and lung cancer comprises one or more of the SEQ ID NOs: 82 to 86, SEQ ID NOs: 141 to 144, SEQ ID NOs: 154 to 159, SEQ ID NOs: 168 to 169, SEQ ID NO: 171, SEQ ID NOs: 203 to 204, SEQ ID NO: 207, SEQ ID NOs: 274 to 276, SEQ ID NO: 288, SEQ ID NO: 359, SEQ ID NOs: 362 to 364, and SEQ ID NO: 467. In some embodiments, any one of the peptides in the bronchus and lung cancer vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 82 to 86, SEQ ID NOs: 141 to 144, SEQ ID NOs: 154 to 159, SEQ ID NOs: 168 to 169, SEQ ID NO: 171, SEQ ID NOs: 203 to 204, SEQ ID NO: 207, SEQ ID NOs:

274 to 276, SEQ ID NO: 288, SEQ ID NO: 359, SEQ ID NOs: 362 to 364, or SEQ ID NO: 467.

In some embodiments, the amino acid sequence vaccine for a MHC class I peptide vaccine for bronchus and lung cancer comprises two or more of the SEQ ID NOs: 82 to 86, SEQ ID NOs: 141 to 144, SEQ ID NOs: 154 to 159, SEQ ID NOs: 168 to 169, SEQ ID NO: 171, SEQ ID NOs: 203 to 204, SEQ ID NO: 207, SEQ ID NOs: 274 to 276, SEQ ID NO: 288, SEQ ID NO: 359, SEQ ID NOs: 362 to 364, and SEQ ID NO: 467. In some embodiments, any one of the peptides in the bronchus and lung cancer vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 82 to 86, SEQ ID NOs: 141 to 144, SEQ ID NOs: 154 to 159, SEQ ID NOs: 168 to 169, SEQ ID NO: 171, SEQ ID NOs: 203 to 204, SEQ ID NO: 207, SEQ ID NOs: 274 to 276, SEQ ID NO: 288, SEQ ID NO: 359, SEQ ID NOs: 362 to 364, or SEQ ID NO: 467.

In some embodiments, the amino acid sequence vaccine for a MHC class I peptide vaccine for breast cancer comprises one or more of the SEQ ID NOs: 273 to 309, SEQ ID NOs: 375 to 386, SEQ ID NOs: 422 to 446, SEQ ID NO: 467, and SEQ ID NOs: 471 to 474. In some embodiments, any one of the peptides in the breast cancer vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 273 to 309, SEQ ID NOs: 375 to 386, SEQ ID NOs: 422 to 446, SEQ ID NO: 467, or SEQ ID NOs: 471 to 474.

In some embodiments, the amino acid sequence vaccine for a MHC class I peptide vaccine for breast cancer comprises two or more of the SEQ ID NOs: 273 to 309, SEQ ID NOs: 375 to 386, SEQ ID NOs: 422 to 446, SEQ ID NO: 467, and SEQ ID NOs: 471 to 474. In some embodiments, any one of the peptides in the breast cancer vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 273 to 309, SEQ ID NOs: 375 to 386, SEQ ID NOs: 422 to 446, SEQ ID NO: 467, or SEQ ID NOs: 471 to 474.

In some embodiments, the amino acid sequence vaccine for a MHC class I peptide vaccine for ovarian cancer comprises one or more of the SEQ ID NOs: 273 to 309, SEQ ID NOs: 375 to 386, SEQ ID NOs: 422 to 446, SEQ ID NO: 467, and SEQ ID NOs: 471 to 474. In some embodiments, any one of the peptides in the ovarian cancer vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 273 to 309, SEQ ID NOs: 375 to 386, SEQ ID NOs: 422 to 446, SEQ ID NO: 467, or SEQ ID NOs: 471 to 474.

In some embodiments, the amino acid sequence vaccine for a MHC class I peptide vaccine for ovarian cancer comprises two or more of the SEQ ID NOs: 273 to 309, SEQ ID NOs: 375 to 386, SEQ ID NOs: 422 to 446, SEQ ID NO: 467, and SEQ ID NOs: 471 to 474. In some embodiments, any one of the peptides in the ovarian cancer vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 273 to 309, SEQ ID NOs: 375 to 386, SEQ ID NOs: 422 to 446, SEQ ID NO: 467, or SEQ ID NOs: 471 to 474.

Table 1 shows MHC class I peptide sequences described herein including the respective SEQ ID NO, amino acid sequence corresponding to the SEQ ID NO, protein target (with specific mutation), the seed amino acid sequence (i.e., the amino acid sequence of the wild type protein fragment), the amino acid substitution (if any) for heteroclitic peptides at positions 2 and C (carboxyl terminus), and notes detailing embodiments in which the peptide may be included in a combined peptide vaccine as described herein. In some embodiments, any combination of peptides listed in Table 1 (SEQ ID NOs: 1 to 474) may be used to create a combined peptide vaccine having between about 2 and about 40 peptides. In some embodiments, any one of the peptides (peptides 1 to 474; SEQ ID NOs: 1 to 474) in the combined vaccine comprises an amino acid sequence 80, 81, 82, 83, 84, 85, 86, 87, 88, 89, 90, 91, 92, 93, 94, 95, 96, 97, 98 or 99% identical to any of SEQ ID NOs: 1 to 474.

Additional amino acid sequences of MHC class I vaccine peptides are provided in Sequence Listings (SEQ ID NOs: 760 to 22727). In some embodiments, any combination of MHC class I peptides disclosed herein (SEQ ID NOs: 1 to 474 and SEQ ID NOs: 760 to 22727) may be used to create a combined peptide vaccine having between about 2 and about 40 peptides. In some embodiments, any one of the peptides (SEQ ID NOs: 1 to 474 and SEQ ID NOs: 760 to 22727) in the combined vaccine comprises or contains an amino acid sequence 80, 81, 82, 83, 84, 85, 86, 87, 88, 89, 90, 91, 92, 93, 94, 95, 96, 97, 98 or 99% identical to any of SEQ ID NOs: 1 to 474 or SEQ ID NOs: 760 to 22727.

MHC Class II Peptide Sequences

In some embodiments, a peptide vaccine (single target or combined multiple target vaccine) comprises about 1 to 40 MHC class II peptides with each peptide consisting of about 20 amino acids. In some embodiments, an MHC class II peptide vaccine is intended for one or more of the AKT1, BRAF, EGFR, GTF2I, HRAS, IDH1, KRAS, NRAS, PIK3CA, PTEN, or TP53 mutated protein targets. In some embodiments, an MHC class II peptide vaccine is intended for one or more of the AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, or TP53 Y220C protein mutation targets. In some embodiments, an MHC class II peptide vaccine is intended for one or more of the pancreatic cancer, skin cancer, thyroid cancer, brain cancer, colorectal cancer, bronchus and lung cancer, breast cancer, or ovarian cancer indications.

In some embodiments, the amino acid sequence for a MHC class II peptide vaccine for mutation in the AKT1 protein comprises one or more of the SEQ ID NOs: 475 to 483. In some embodiments, any one of the peptides in the AKT1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 475 to 483.

In some embodiments, the amino acid sequence for a MHC class II peptide vaccine for mutation in the AKT1 protein comprises one or more of the SEQ ID NOs: 475 to 483, SEQ ID NOs: 22728 to 22838, and SEQ ID NOs: 25305 to 25488. In some embodiments, any one of the peptides in the AKT1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 475 to 483, SEQ ID NOs: 22728 to 22838, or SEQ ID NOs: 25305 to 25488.

In some embodiments, the amino acid sequence for a MHC class II peptide vaccine for mutation in the AKT1 protein comprises two or more of the SEQ ID NOs: 475 to 483. In some embodiments, any one of the peptides in the AKT1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 475 to 483.

In some embodiments, the amino acid sequence for a MHC class II peptide vaccine for mutation in the AKT1 protein comprises two or more of the SEQ ID NOs: 475 to 483, SEQ ID NOs: 22728 to 22838, and SEQ ID NOs: 25305 to 25488. In some embodiments, any one of the peptides in the AKT1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 475 to 483, SEQ ID NOs: 22728 to 22838, or SEQ ID NOs: 25305 to 25488.

In some embodiments, the amino acid sequence for a MHC class II peptide vaccine for mutation in the BRAF protein comprises one or more of the SEQ ID NOs: 484 to 502. In some embodiments, any one of the peptides in the BRAF vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 484 to 502.

In some embodiments, the amino acid sequence for a MHC class II peptide vaccine for mutation in the BRAF protein comprises one or more of the SEQ ID NOs: 484 to 502, SEQ ID NOs: 22839 to 22966, and SEQ ID NOs: 25489 to 25616. In some embodiments, any one of the peptides in the BRAF vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 484 to 502, SEQ ID NOs: 22839 to 22966, or SEQ ID NOs: 25489 to 25616.

In some embodiments, the amino acid sequence for a MHC class II peptide vaccine for mutation in the BRAF protein comprises two or more of the SEQ ID NOs: 484 to 502. In some embodiments, any one of the peptides in the BRAF vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 484 to 502.

In some embodiments, the amino acid sequence for a MHC class II peptide vaccine for mutation in the BRAF protein comprises two or more of the SEQ ID NOs: 484 to 502, SEQ ID NOs: 22839 to 22966, and SEQ ID NOs: 25489 to 25616. In some embodiments, any one of the peptides in the BRAF vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 484 to 502, SEQ ID NOs: 22839 to 22966, or SEQ ID NOs: 25489 to 25616.

In some embodiments, the amino acid sequence for a MHC class II peptide vaccine for mutation in the EGFR protein comprises one or more of the SEQ ID NOs: 503 to 527. In some embodiments, any one of the peptides in the EGFR vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 503 to 527.

In some embodiments, the amino acid sequence for a MHC class II peptide vaccine for mutation in the EGFR protein comprises one or more of the SEQ ID NOs: 503 to 527, SEQ ID NOs: 22967 to 23263, and SEQ ID NOs: 25617 to 26046. In some embodiments, any one of the peptides in the EGFR vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 503 to 527, SEQ ID NOs: 22967 to 23263, or SEQ ID NOs: 25617 to 26046.

In some embodiments, the amino acid sequence for a MHC class II peptide vaccine for mutation in the EGFR protein comprises two or more of the SEQ ID NOs: 503 to 527. In some embodiments, any one of the peptides in the EGFR vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 503 to 527.

In some embodiments, the amino acid sequence for a MHC class II peptide vaccine for mutation in the EGFR protein comprises two or more of the SEQ ID NOs: 503 to 527, SEQ ID NOs: 22967 to 23263, and SEQ ID NOs: 25617 to 26046. In some embodiments, any one of the peptides in the EGFR vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 503 to 527, SEQ ID NOs: 22967 to 23263, or SEQ ID NOs: 25617 to 26046.

In some embodiments, the amino acid sequence for a MHC class II peptide vaccine for mutation in the GTF2I protein comprises one or more of the SEQ ID NOs: 528 to 534. In some embodiments, any one of the peptides in the GTF2I vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 528 to 534.

In some embodiments, the amino acid sequence for a MHC class II peptide vaccine for mutation in the GTF2I protein comprises one or more of the SEQ ID NOs: 528 to 534, SEQ ID NOs: 23264 to 23415, and SEQ ID NOs: 26047 to 26375. In some embodiments, any one of the peptides in the GTF2I vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 528 to 534, SEQ ID NOs: 23264 to 23415, or SEQ ID NOs: 26047 to 26375.

In some embodiments, the amino acid sequence for a MHC class II peptide vaccine for mutation in the GTF2I protein comprises two or more of the SEQ ID NOs: 528 to 534. In some embodiments, any one of the peptides in the GTF2I vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 528 to 534.

In some embodiments, the amino acid sequence for a MHC class II peptide vaccine for mutation in the GTF2I protein comprises two or more of the SEQ ID NOs: 528 to 534, SEQ ID NOs: 23264 to 23415, and SEQ ID NOs: 26047 to 26375. In some embodiments, any one of the peptides in the GTF2I vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 528 to 534, SEQ ID NOs: 23264 to 23415, or SEQ ID NOs: 26047 to 26375.

In some embodiments, the amino acid sequence for a MHC class II peptide vaccine for mutation in the IDH1 protein comprises one or more of the SEQ ID NOs: 535 to 553. In some embodiments, any one of the peptides in the IDH1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 535 to 553.

In some embodiments, the amino acid sequence for a MHC class II peptide vaccine for mutation in the IDH1 protein comprises one or more of the SEQ ID NOs: 535 to 553, SEQ ID NOs: 23416 to 23631, and SEQ ID NOs: 26376 to 26614. In some embodiments, any one of the peptides in the IDH1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 535 to 553, SEQ ID NOs: 23416 to 23631, or SEQ ID NOs: 26376 to 26614.

In some embodiments, the amino acid sequence for a MHC class II peptide vaccine for mutation in the IDH1 protein comprises two or more of the SEQ ID NOs: 535 to 553. In some embodiments, any one of the peptides in the IDH1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 535 to 553.

In some embodiments, the amino acid sequence for a MHC class II peptide vaccine for mutation in the IDH1 protein comprises two or more of the SEQ ID NOs: 535 to 553, SEQ ID NOs: 23416 to 23631, and SEQ ID NOs: 26376 to 26614. In some embodiments, any one of the peptides in the IDH1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 535 to 553, SEQ ID NOs: 23416 to 23631, or SEQ ID NOs: 26376 to 26614.

In some embodiments, the amino acid sequence for a MHC class II peptide vaccine for mutation in the KRAS protein comprises one or more of the SEQ ID NOs: 554 to 615 and SEQ ID NO: 759. In some embodiments, any one of the peptides in the KRAS vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 554 to 615 or SEQ ID NO: 759.

In some embodiments, the amino acid sequence for a MHC class II peptide vaccine for mutation in the KRAS protein comprises one or more of the SEQ ID NOs: 554 to 615, SEQ ID NO: 759, SEQ ID NOs: 23632 to 24129, and SEQ ID NOs: 26615 to 27328. In some embodiments, any one of the peptides in the KRAS vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 554 to 615, SEQ ID NO: 759, SEQ ID NOs: 23632 to 24129, or SEQ ID NOs: 26615 to 27328.

In some embodiments, the amino acid sequence for a MHC class II peptide vaccine for mutation in the KRAS protein comprises two or more of the SEQ ID NOs: 554 to 615 and SEQ ID NO: 759. In some embodiments, any one of the peptides in the KRAS vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 554 to 615 or SEQ ID NO: 759.

In some embodiments, the amino acid sequence for a MHC class II peptide vaccine for mutation in the KRAS protein comprises two or more of the SEQ ID NOs: 554 to 615, SEQ ID NO: 759, SEQ ID NOs: 23632 to 24129, and SEQ ID NOs: 26615 to 27328. In some embodiments, any one of the peptides in the KRAS vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 554 to 615, SEQ ID NO: 759, SEQ ID NOs: 23632 to 24129, or SEQ ID NOs: 26615 to 27328.

In some embodiments, the amino acid sequence for a MHC class II peptide vaccine for mutation in the NRAS protein comprises one or more of the SEQ ID NOs: 616 to 645. In some embodiments, any one of the peptides in the NRAS vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 616 to 645.

In some embodiments, the amino acid sequence for a MHC class II peptide vaccine for mutation in the NRAS protein comprises one or more of the SEQ ID NOs: 616 to 645, SEQ ID NOs: 24130 to 24347, and SEQ ID NOs: 27329 to 27557. In some embodiments, any one of the peptides in the NRAS vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 616 to 645, SEQ ID NOs: 24130 to 24347, or SEQ ID NOs: 27329 to 27557.

In some embodiments, the amino acid sequence for a MHC class II peptide vaccine for mutation in the NRAS protein comprises two or more of the SEQ ID NOs: 616 to 645. In some embodiments, any one of the peptides in the NRAS vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 616 to 645.

In some embodiments, the amino acid sequence for a MHC class II peptide vaccine for mutation in the NRAS protein comprises two or more of the SEQ ID NOs: 616 to 645, SEQ ID NOs: 24130 to 24347, and SEQ ID NOs: 27329 to 27557. In some embodiments, any one of the peptides in the NRAS vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 616 to 645, SEQ ID NOs: 24130 to 24347, or SEQ ID NOs: 27329 to 27557.

In some embodiments, the amino acid sequence for a MHC class II peptide vaccine for mutation in the PIK3CA protein comprises one or more of the SEQ ID NOs: 646 to 675. In some embodiments, any one of the peptides in the PIK3CA vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 646 to 675.

In some embodiments, the amino acid sequence for a MHC class II peptide vaccine for mutation in the PIK3CA protein comprises one or more of the SEQ ID NOs: 646 to 675, SEQ ID NOs: 24348 to 24571, and SEQ ID NOs: 27558 to 27889. In some embodiments, any one of the peptides in the PIK3CA vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 646 to 675, SEQ ID NOs: 24348 to 24571, or SEQ ID NOs: 27558 to 27889.

In some embodiments, the amino acid sequence for a MHC class II peptide vaccine for mutation in the PIK3CA protein comprises two or more of the SEQ ID NOs: 646 to 675. In some embodiments, any one of the peptides in the PIK3CA vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 646 to 675.

In some embodiments, the amino acid sequence for a MHC class II peptide vaccine for mutation in the PIK3CA protein comprises two or more of the SEQ ID NOs: 646 to 675, SEQ ID NOs: 24348 to 24571, and SEQ ID NOs: 27558 to 27889. In some embodiments, any one of the peptides in the PIK3CA vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 646 to 675, SEQ ID NOs: 24348 to 24571, or SEQ ID NOs: 27558 to 27889.

In some embodiments, the amino acid sequence for a MHC class II peptide vaccine for mutation in the PTEN protein comprises one or more of the SEQ ID NOs: 676 to 690. In some embodiments, any one of the peptides in the PTEN vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 676 to 690.

In some embodiments, the amino acid sequence for a MHC class II peptide vaccine for mutation in the PTEN protein comprises one or more of the SEQ ID NOs: 676 to 690, SEQ ID NOs: 24572 to 24724, and SEQ ID NOs: 27890 to 28052. In some embodiments, any one of the peptides in the PTEN vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 676 to 690, SEQ ID NOs: 24572 to 24724, or SEQ ID NOs: 27890 to 28052.

In some embodiments, the amino acid sequence for a MHC class II peptide vaccine for mutation in the PTEN protein comprises two or more of the SEQ ID NOs: 676 to 690. In some embodiments, any one of the peptides in the PTEN vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 676 to 690.

In some embodiments, the amino acid sequence for a MHC class II peptide vaccine for mutation in the PTEN protein comprises two or more of the SEQ ID NOs: 676 to 690, SEQ ID NOs: 24572 to 24724, and SEQ ID NOs: 27890 to 28052. In some embodiments, any one of the peptides in the PTEN vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 676 to 690, SEQ ID NOs: 24572 to 24724, or SEQ ID NOs: 27890 to 28052.

In some embodiments, the amino acid sequence for a MHC class II peptide vaccine for mutation in the TP53 protein comprises one or more of the SEQ ID NOs: 691 to 758. In some embodiments, any one of the peptides in the TP53 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 691 to 758.

In some embodiments, the amino acid sequence for a MHC class II peptide vaccine for mutation in the TP53 protein comprises one or more of the SEQ ID NOs: 691 to 758, SEQ ID NOs: 24725 to 25304, and SEQ ID NOs: 28053 to 28795. In some embodiments, any one of the peptides in the TP53 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 691 to 758, SEQ ID NOs: 24725 to 25304, or SEQ ID NOs: 28053 to 28795.

In some embodiments, the amino acid sequence for a MHC class II peptide vaccine for mutation in the TP53 protein comprises two or more of the SEQ ID NOs: 691 to 758. In some embodiments, any one of the peptides in the TP53 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 691 to 758.

In some embodiments, the amino acid sequence for a MHC class II peptide vaccine for mutation in the TP53 protein comprises two or more of the SEQ ID NOs: 691 to 758, SEQ ID NOs: 24725 to 25304, and SEQ ID NOs: 28053 to 28795. In some embodiments, any one of the peptides in the TP53 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 691 to 758, SEQ ID NOs: 24725 to 25304, or SEQ ID NOs: 28053 to 28795.

In some embodiments, the amino acid sequence for a MHC class II peptide vaccine for mutation in the RAS protein comprises one or more of the SEQ ID NOs: 554 to 645 and SEQ ID NO: 759. In some embodiments, any one of the peptides in the RAS vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 554 to 645 or SEQ ID NO: 759.

In some embodiments, the amino acid sequence for a MHC class II peptide vaccine for mutation in the RAS protein comprises one or more of the SEQ ID NOs: 554 to 645, SEQ ID NO: 759, SEQ ID NOs: 23632 to 24347, and SEQ ID NOs: 26615 to 27557. In some embodiments, any one of the peptides in the RAS vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 554 to 645, SEQ ID NO: 759, SEQ ID NOs: 23632 to 24347, or SEQ ID NOs: 26615 to 27557.

In some embodiments, the amino acid sequence for a MHC class II peptide vaccine for mutation in the RAS protein comprises two or more of the SEQ ID NOs: 554 to 645 and SEQ ID NO: 759. In some embodiments, any one of the peptides in the RAS vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 554 to 645 or SEQ ID NO: 759.

In some embodiments, the amino acid sequence for a MHC class II peptide vaccine for mutation in the RAS protein comprises two or more of the SEQ ID NOs: 554 to 645, SEQ ID NO: 759, SEQ ID NOs: 23632 to 24347, and SEQ ID NOs: 26615 to 27557. In some embodiments, any one of the peptides in the RAS vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 554 to 645, SEQ ID NO: 759, SEQ ID NOs: 23632 to 24347, or SEQ ID NOs: 26615 to 27557.

In some embodiments, the amino acid sequence for a MHC class II peptide vaccine for the BRAF V600E protein mutation comprises one or more of the SEQ ID NOs: 484 to 494. In some embodiments, any one of the peptides in the BRAF V600E vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 484 to 494.

In some embodiments, the amino acid sequence for a MHC class II peptide vaccine for the BRAF V600E protein mutation comprises one or more of the SEQ ID NOs: 484 to 494, SEQ ID NOs: 22839 to 22876, and SEQ ID NOs: 25489 to 25526. In some embodiments, any one of the peptides in the BRAF V600E vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 484 to 494, SEQ ID NOs: 22839 to 22876, or SEQ ID NOs: 25489 to 25526.

In some embodiments, the amino acid sequence for a MHC class II peptide vaccine for the BRAF V600E protein mutation comprises two or more of the SEQ ID NOs: 484 to 494. In some embodiments, any one of the peptides in the BRAF V600E vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 484 to 494.

In some embodiments, the amino acid sequence for a MHC class II peptide vaccine for the BRAF V600E protein mutation comprises two or more of the SEQ ID NOs: 484 to 494, SEQ ID NOs: 22839 to 22876, and SEQ ID NOs: 25489 to 25526. In some embodiments, any one of the peptides in the BRAF V600E vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 484 to 494, SEQ ID NOs: 22839 to 22876, or SEQ ID NOs: 25489 to 25526.

In some embodiments, the amino acid sequence for a MHC class II peptide vaccine for the BRAF V600M protein mutation comprises one or more of the SEQ ID NOs: 495 to 502. In some embodiments, any one of the peptides in the BRAF V600M vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 495 to 502.

In some embodiments, the amino acid sequence for a MHC class II peptide vaccine for the BRAF V600M protein mutation comprises one or more of the SEQ ID NOs: 495 to 502, SEQ ID NOs: 22877 to 22966, and SEQ ID NOs: 25527 to 25616. In some embodiments, any one of the peptides in the BRAF V600M vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 495 to 502, SEQ ID NOs: 22877 to 22966, or SEQ ID NOs: 25527 to 25616.

In some embodiments, the amino acid sequence for a MHC class II peptide vaccine for the BRAF V600M protein mutation comprises two or more of the SEQ ID NOs: 495 to 502. In some embodiments, any one of the peptides in the BRAF V600M vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 495 to 502.

In some embodiments, the amino acid sequence for a MHC class II peptide vaccine for the BRAF V600M protein mutation comprises two or more of the SEQ ID NOs: 495 to 502, SEQ ID NOs: 22877 to 22966, and SEQ ID NOs: 25527 to 25616. In some embodiments, any one of the peptides in the BRAF V600M vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 495 to 502, SEQ ID NOs: 22877 to 22966, or SEQ ID NOs: 25527 to 25616.

In some embodiments, the amino acid sequence for a MHC class II peptide vaccine for the EGFR A289V protein mutation comprises one or more of the SEQ ID NOs: 503 to 509. In some embodiments, any one of the peptides in the EGFR A289V vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 503 to 509.

In some embodiments, the amino acid sequence for a MHC class II peptide vaccine for the EGFR A289V protein mutation comprises one or more of the SEQ ID NOs: 503 to 509, SEQ ID NOs: 22967 to 23000, and SEQ ID NOs: 25617 to 25653. In some embodiments, any one of the peptides in the EGFR A289V vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 503 to 509, SEQ ID NOs: 22967 to 23000, or SEQ ID NOs: 25617 to 25653.

In some embodiments, the amino acid sequence for a MHC class II peptide vaccine for the EGFR A289V protein mutation comprises two or more of the SEQ ID NOs: 503 to 509. In some embodiments, any one of the peptides in the EGFR A289V vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 503 to 509.

In some embodiments, the amino acid sequence for a MHC class II peptide vaccine for the EGFR A289V protein mutation comprises two or more of the SEQ ID NOs: 503 to 509, SEQ ID NOs: 22967 to 23000, and SEQ ID NOs: 25617 to 25653. In some embodiments, any one of the peptides in the EGFR A289V vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 503 to 509, SEQ ID NOs: 22967 to 23000, or SEQ ID NOs: 25617 to 25653.

In some embodiments, the amino acid sequence for a MHC class II peptide vaccine for the EGFR G598V protein mutation comprises one or more of the SEQ ID NOs: 510 to 519. In some embodiments, any one of the peptides in the EGFR G598V vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 510 to 519.

In some embodiments, the amino acid sequence for a MHC class II peptide vaccine for the EGFR G598V protein mutation comprises one or more of the SEQ ID NOs: 510 to 519, SEQ ID NOs: 23001 to 23089, and SEQ ID NOs: 25654 to 25794. In some embodiments, any one of the peptides in the EGFR G598V vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 510 to 519, SEQ ID NOs: 23001 to 23089, or SEQ ID NOs: 25654 to 25794.

In some embodiments, the amino acid sequence for a MHC class II peptide vaccine for the EGFR G598V protein mutation comprises two or more of the SEQ ID NOs: 510 to 519. In some embodiments, any one of the peptides in the EGFR G598V vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 510 to 519.

In some embodiments, the amino acid sequence for a MHC class II peptide vaccine for the EGFR G598V protein mutation comprises two or more of the SEQ ID NOs: 510 to 519, SEQ ID NOs: 23001 to 23089, and SEQ ID NOs: 25654 to 25794. In some embodiments, any one of the peptides in the EGFR G598V vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 510 to 519, SEQ ID NOs: 23001 to 23089, or SEQ ID NOs: 25654 to 25794.

In some embodiments, the amino acid sequence for a MHC class II peptide vaccine for the EGFR L858R protein mutation comprises one or more of the SEQ ID NOs: 520 to 527. In some embodiments, any one of the peptides in the EGFR L858R vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 520 to 527.

In some embodiments, the amino acid sequence for a MHC class II peptide vaccine for the EGFR L858R protein mutation comprises one or more of the SEQ ID NOs: 520 to 527, SEQ ID NOs: 23090 to 23263, and SEQ ID NOs: 25795 to 26046. In some embodiments, any one of the peptides in the EGFR L858R vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 520 to 527, SEQ ID NOs: 23090 to 23263, or SEQ ID NOs: 25795 to 26046.

In some embodiments, the amino acid sequence for a MHC class II peptide vaccine for the EGFR L858R protein mutation comprises two or more of the SEQ ID NOs: 520 to 527. In some embodiments, any one of the peptides in the EGFR L858R vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 520 to 527.

In some embodiments, the amino acid sequence for a MHC class II peptide vaccine for the EGFR L858R protein mutation comprises two or more of the SEQ ID NOs: 520 to 527, SEQ ID NOs: 23090 to 23263, and SEQ ID NOs: 25795 to 26046. In some embodiments, any one of the peptides in the EGFR L858R vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 520 to 527, SEQ ID NOs: 23090 to 23263, or SEQ ID NOs: 25795 to 26046.

In some embodiments, the amino acid sequence for a MHC class II peptide vaccine for the IDH1 R132H protein mutation comprises one or more of the SEQ ID NOs: 543 to 553. In some embodiments, any one of the peptides in the IDH1 R132H vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 543 to 553.

In some embodiments, the amino acid sequence for a MHC class II peptide vaccine for the IDH1 R132H protein mutation comprises one or more of the SEQ ID NOs: 543 to 553, SEQ ID NOs: 23505 to 23631, and SEQ ID NOs: 26469 to 26614. In some embodiments, any one of the peptides in the IDH1 R132H vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 543 to 553, SEQ ID NOs: 23505 to 23631, or SEQ ID NOs: 26469 to 26614.

In some embodiments, the amino acid sequence for a MHC class II peptide vaccine for the IDH1 R132H protein mutation comprises two or more of the SEQ ID NOs: 543 to 553. In some embodiments, any one of the peptides in the IDH1 R132H vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 543 to 553.

In some embodiments, the amino acid sequence for a MHC class II peptide vaccine for the IDH1 R132H protein mutation comprises two or more of the SEQ ID NOs: 543 to 553, SEQ ID NOs: 23505 to 23631, and SEQ ID NOs: 26469 to 26614. In some embodiments, any one of the peptides in the IDH1 R132H vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 543 to 553, SEQ ID NOs: 23505 to 23631, or SEQ ID NOs: 26469 to 26614.

In some embodiments, the amino acid sequence for a MHC class II peptide vaccine for the IDH1 R132C protein mutation comprises one or more of the SEQ ID NOs: 535 to 542. In some embodiments, any one of the peptides in the IDH1 R132C vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 535 to 542.

In some embodiments, the amino acid sequence for a MHC class II peptide vaccine for the IDH1 R132C protein mutation comprises one or more of the SEQ ID NOs: 535 to 542, SEQ ID NOs: 23416 to 23504, and SEQ ID NOs: 26376 to 26468. In some embodiments, any one of the peptides in the IDH1 R132C vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 535 to 542, SEQ ID NOs: 23416 to 23504, or SEQ ID NOs: 26376 to 26468.

In some embodiments, the amino acid sequence for a MHC class II peptide vaccine for the IDH1 R132C protein mutation comprises two or more of the SEQ ID NOs: 535 to 542. In some embodiments, any one of the peptides in the IDH1 R132C vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 535 to 542.

In some embodiments, the amino acid sequence for a MHC class II peptide vaccine for the IDH1 R132C protein mutation comprises two or more of the SEQ ID NOs: 535 to 542, SEQ ID NOs: 23416 to 23504, and SEQ ID NOs: 26376 to 26468. In some embodiments, any one of the peptides in the IDH1 R132C vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 535 to 542, SEQ ID NOs: 23416 to 23504, or SEQ ID NOs: 26376 to 26468.

In some embodiments, the amino acid sequence for a MHC class II peptide vaccine for the KRAS G12D protein mutation comprises one or more of the SEQ ID NOs: 569 to 577. In some embodiments, any one of the peptides in the KRAS G12D vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 569 to 577.

In some embodiments, the amino acid sequence for a MHC class II peptide vaccine for the KRAS G12D protein mutation comprises one or more of the SEQ ID NOs: 569 to 577, SEQ ID NOs: 23750 to 23809, and SEQ ID NOs: 26757 to 26833. In some embodiments, any one of the peptides in the KRAS G12D vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 569 to 577, SEQ ID NOs: 23750 to 23809, or SEQ ID NOs: 26757 to 26833.

In some embodiments, the amino acid sequence for a MHC class II peptide vaccine for the KRAS G12D protein mutation comprises two or more of the SEQ ID NOs: 569 to 577. In some embodiments, any one of the peptides in the KRAS G12D vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 569 to 577.

In some embodiments, the amino acid sequence for a MHC class II peptide vaccine for the KRAS G12D protein mutation comprises two or more of the SEQ ID NOs: 569 to 577, SEQ ID NOs: 23750 to 23809, and SEQ ID NOs: 26757 to 26833. In some embodiments, any one of the peptides in the KRAS G12D vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 569 to 577, SEQ ID NOs: 23750 to 23809, or SEQ ID NOs: 26757 to 26833.

In some embodiments, the amino acid sequence for a MHC class II peptide vaccine for the KRAS G12V protein mutation comprises one or more of the SEQ ID NOs: 596 to 605. In some embodiments, any one of the peptides in the KRAS G12V vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 596 to 605.

In some embodiments, the amino acid sequence for a MHC class II peptide vaccine for the KRAS G12V protein mutation comprises one or more of the SEQ ID NOs: 596 to 605, SEQ ID NOs: 23958 to 24025, and SEQ ID NOs: 27057 to 27148. In some embodiments, any one of the peptides in the KRAS G12V vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 596 to 605, SEQ ID NOs: 23958 to 24025, or SEQ ID NOs: 27057 to 27148.

In some embodiments, the amino acid sequence for a MHC class II peptide vaccine for the KRAS G12V protein mutation comprises two or more of the SEQ ID NOs: 596 to 605. In some embodiments, any one of the peptides in the KRAS G12V vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 596 to 605.

In some embodiments, the amino acid sequence for a MHC class II peptide vaccine for the KRAS G12V protein mutation comprises two or more of the SEQ ID NOs: 596 to 605, SEQ ID NOs: 23958 to 24025, and SEQ ID NOs: 27057 to 27148. In some embodiments, any one of the peptides in the KRAS G12V vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 596 to 605, SEQ ID NOs: 23958 to 24025, or SEQ ID NOs: 27057 to 27148.

In some embodiments, the amino acid sequence for a MHC class II peptide vaccine for the KRAS G12R protein mutation comprises one or more of the SEQ ID NOs: 578 to 587. In some embodiments, any one of the peptides in the KRAS G12R vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 578 to 587.

In some embodiments, the amino acid sequence for a MHC class II peptide vaccine for the KRAS G12R protein mutation comprises one or more of the SEQ ID NOs: 578 to 587, SEQ ID NOs: 23810 to 23889, and SEQ ID NOs: 26834 to 26967. In some embodiments, any one of the peptides in the KRAS G12R vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 578 to 587, SEQ ID NOs: 23810 to 23889, or SEQ ID NOs: 26834 to 26967.

In some embodiments, the amino acid sequence for a MHC class II peptide vaccine for the KRAS G12R protein mutation comprises two or more of the SEQ ID NOs: 578 to 587. In some embodiments, any one of the peptides in the KRAS G12R vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 578 to 587.

In some embodiments, the amino acid sequence for a MHC class II peptide vaccine for the KRAS G12R protein mutation comprises two or more of the SEQ ID NOs: 578 to 587, SEQ ID NOs: 23810 to 23889, and SEQ ID NOs: 26834 to 26967. In some embodiments, any one of the peptides in the KRAS G12R vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 578 to 587, SEQ ID NOs: 23810 to 23889, or SEQ ID NOs: 26834 to 26967.

In some embodiments, the amino acid sequence for a MHC class II peptide vaccine for the KRAS G12C protein mutation comprises one or more of the SEQ ID NOs: 561 to 568. In some embodiments, any one of the peptides in the KRAS G12C vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 561 to 568.

In some embodiments, the amino acid sequence for a MHC class II peptide vaccine for the KRAS G12C protein mutation comprises one or more of the SEQ ID NOs: 561 to 568, SEQ ID NOs: 23700 to 23749, and SEQ ID NOs: 26702 to 26756. In some embodiments, any one of the peptides in the KRAS G12C vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 561 to 568, SEQ ID NOs: 23700 to 23749, or SEQ ID NOs: 26702 to 26756.

In some embodiments, the amino acid sequence for a MHC class II peptide vaccine for the KRAS G12C protein mutation comprises two or more of the SEQ ID NOs: 561 to 568. In some embodiments, any one of the peptides in the KRAS G12C vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 561 to 568.

In some embodiments, the amino acid sequence for a MHC class II peptide vaccine for the KRAS G12C protein mutation comprises two or more of the SEQ ID NOs: 561 to 568, SEQ ID NOs: 23700 to 23749, and SEQ ID NOs: 26702 to 26756. In some embodiments, any one of the peptides in the KRAS G12C vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 561 to 568, SEQ ID NOs: 23700 to 23749, or SEQ ID NOs: 26702 to 26756.

In some embodiments, the amino acid sequence for a MHC class II peptide vaccine for the KRAS G13D protein mutation comprises one or more of the SEQ ID NOs: 606 to 615 and SEQ ID NO: 759. In some embodiments, any one of the peptides in the KRAS G13D vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 606 to 615 or SEQ ID NO: 759.

In some embodiments, the amino acid sequence for a MHC class II peptide vaccine for the KRAS G13D protein mutation comprises one or more of the SEQ ID NOs: 606 to 615, SEQ ID NO: 759, SEQ ID NOs: 24026 to 24129, and SEQ ID NOs: 27149 to 27328. In some embodiments, any one of the peptides in the KRAS G13D vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 606 to 615, SEQ ID NO: 759, SEQ ID NOs: 24026 to 24129, or SEQ ID NOs: 27149 to 27328.

In some embodiments, the amino acid sequence for a MHC class II peptide vaccine for the KRAS G13D protein mutation comprises two or more of the SEQ ID NOs: 606 to 615 and SEQ ID NO: 759. In some embodiments, any one of the peptides in the KRAS G13D vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 606 to 615 or SEQ ID NO: 759.

In some embodiments, the amino acid sequence for a MHC class II peptide vaccine for the KRAS G13D protein mutation comprises two or more of the SEQ ID NOs: 606 to 615, SEQ ID NO: 759, SEQ ID NOs: 24026 to 24129, and SEQ ID NOs: 27149 to 27328. In some embodiments, any one of the peptides in the KRAS G13D vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 606 to 615, SEQ ID NO: 759, SEQ ID NOs: 24026 to 24129, or SEQ ID NOs: 27149 to 27328.

In some embodiments, the amino acid sequence for a MHC class II peptide vaccine for the KRAS G12A protein mutation comprises one or more of the SEQ ID NOs: 554 to 560. In some embodiments, any one of the peptides in the KRAS G12A vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 554 to 560.

In some embodiments, the amino acid sequence for a MHC class II peptide vaccine for the KRAS G12A protein mutation comprises one or more of the SEQ ID NOs: 554 to 560, SEQ ID NOs: 23632 to 23699, and SEQ ID NOs: 26615 to 26701. In some embodiments, any one of the peptides in the KRAS G12A vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 554 to 560, SEQ ID NOs: 23632 to 23699, or SEQ ID NOs: 26615 to 26701.

In some embodiments, the amino acid sequence for a MHC class II peptide vaccine for the KRAS G12A protein mutation comprises two or more of the SEQ ID NOs: 554 to 560. In some embodiments, any one of the peptides in the KRAS G12A vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 554 to 560.

In some embodiments, the amino acid sequence for a MHC class II peptide vaccine for the KRAS G12A protein mutation comprises two or more of the SEQ ID NOs: 554 to 560, SEQ ID NOs: 23632 to 23699, and SEQ ID NOs: 26615 to 26701. In some embodiments, any one of the peptides in the KRAS G12A vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 554 to 560, SEQ ID NOs: 23632 to 23699, or SEQ ID NOs: 26615 to 26701.

In some embodiments, the amino acid sequence for a MHC class II peptide vaccine for the KRAS G12S protein mutation comprises one or more of the SEQ ID NOs: 588 to 595. In some embodiments, any one of the peptides in the KRAS G12S vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 588 to 595.

In some embodiments, the amino acid sequence for a MHC class II peptide vaccine for the KRAS G12S protein mutation comprises one or more of the SEQ ID NOs: 588 to 595, SEQ ID NOs: 23890 to 23957, and SEQ ID NOs: 26968 to 27056. In some embodiments, any one of the peptides in the KRAS G12S vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 588 to 595, SEQ ID NOs: 23890 to 23957, or SEQ ID NOs: 26968 to 27056.

In some embodiments, the amino acid sequence for a MHC class II peptide vaccine for the KRAS G12S protein mutation comprises two or more of the SEQ ID NOs: 588 to 595. In some embodiments, any one of the peptides in the KRAS G12S vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 588 to 595.

In some embodiments, the amino acid sequence for a MHC class II peptide vaccine for the KRAS G12S protein mutation comprises two or more of the SEQ ID NOs: 588 to 595, SEQ ID NOs: 23890 to 23957, and SEQ ID NOs: 26968 to 27056. In some embodiments, any one of the peptides in the KRAS G12S vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 588 to 595, SEQ ID NOs: 23890 to 23957, or SEQ ID NOs: 26968 to 27056.

In some embodiments, the amino acid sequence for a MHC class II peptide vaccine for the NRAS Q61R protein mutation comprises one or more of the SEQ ID NOs: 634 to 645. In some embodiments, any one of the peptides in the NRAS Q61R vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 634 to 645.

In some embodiments, the amino acid sequence for a MHC class II peptide vaccine for the NRAS Q61R protein mutation comprises one or more of the SEQ ID NOs: 634 to 645, SEQ ID NOs: 24280 to 24347, and SEQ ID NOs: 27490 to 27557. In some embodiments, any one of the peptides in the NRAS Q61R vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 634 to 645, SEQ ID NOs: 24280 to 24347, or SEQ ID NOs: 27490 to 27557.

In some embodiments, the amino acid sequence for a MHC class II peptide vaccine for the NRAS Q61R protein mutation comprises two or more of the SEQ ID NOs: 634 to 645. In some embodiments, any one of the peptides in the NRAS Q61R vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 634 to 645.

In some embodiments, the amino acid sequence for a MHC class II peptide vaccine for the NRAS Q61R protein mutation comprises two or more of the SEQ ID NOs: 634 to 645, SEQ ID NOs: 24280 to 24347, and SEQ ID NOs: 27490 to 27557. In some embodiments, any one of the peptides in the NRAS Q61R vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 634 to 645, SEQ ID NOs: 24280 to 24347, or SEQ ID NOs: 27490 to 27557.

In some embodiments, the amino acid sequence for a MHC class II peptide vaccine for the NRAS Q61K protein mutation comprises one or more of the SEQ ID NOs: 616 to 624. In some embodiments, any one of the peptides in the NRAS Q61K vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 616 to 624.

In some embodiments, the amino acid sequence for a MHC class II peptide vaccine for the NRAS Q61K protein mutation comprises one or more of the SEQ ID NOs: 616 to 624, SEQ ID NOs: 24130 to 24194, and SEQ ID NOs: 27329 to 27396. In some embodiments, any one of the peptides in the NRAS Q61K vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 616 to 624, SEQ ID NOs: 24130 to 24194, or SEQ ID NOs: 27329 to 27396.

In some embodiments, the amino acid sequence for a MHC class II peptide vaccine for the NRAS Q61K protein mutation comprises two or more of the SEQ ID NOs: 616 to 624. In some embodiments, any one of the peptides in the NRAS Q61K vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 616 to 624.

In some embodiments, the amino acid sequence for a MHC class II peptide vaccine for the NRAS Q61K protein mutation comprises two or more of the SEQ ID NOs: 616 to 624, SEQ ID NOs: 24130 to 24194, and SEQ ID NOs: 27329 to 27396. In some embodiments, any one of the peptides in the NRAS Q61K vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 616 to 624, SEQ ID NOs: 24130 to 24194, or SEQ ID NOs: 27329 to 27396.

In some embodiments, the amino acid sequence for a MHC class II peptide vaccine for the NRAS Q61L protein mutation comprises one or more of the SEQ ID NOs: 625 to 633. In some embodiments, any one of the peptides in the NRAS Q61L vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 625 to 633.

In some embodiments, the amino acid sequence for a MHC class II peptide vaccine for the NRAS Q61L protein mutation comprises one or more of the SEQ ID NOs: 625 to 633, SEQ ID NOs: 24195 to 24279, and SEQ ID NOs: 27397 to 27489. In some embodiments, any one of the peptides in the NRAS Q61L vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 625 to 633, SEQ ID NOs: 24195 to 24279, or SEQ ID NOs: 27397 to 27489.

In some embodiments, the amino acid sequence for a MHC class II peptide vaccine for the NRAS Q61L protein mutation comprises two or more of the SEQ ID NOs: 625 to 633. In some embodiments, any one of the peptides in the NRAS Q61L vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 625 to 633.

In some embodiments, the amino acid sequence for a MHC class II peptide vaccine for the NRAS Q61L protein mutation comprises two or more of the SEQ ID NOs: 625 to 633, SEQ ID NOs: 24195 to 24279, and SEQ ID NOs: 27397 to 27489. In some embodiments, any one of the peptides in the NRAS Q61L vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 625 to 633, SEQ ID NOs: 24195 to 24279, or SEQ ID NOs: 27397 to 27489.

In some embodiments, the amino acid sequence for a MHC class II peptide vaccine for the PIK3CA E542K protein mutation comprises one or more of the SEQ ID NOs: 646 to 650. In some embodiments, any one of the peptides in the PIK3CA E542K vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 646 to 650.

In some embodiments, the amino acid sequence for a MHC class II peptide vaccine for the PIK3CA E542K protein mutation comprises one or more of the SEQ ID NOs: 646 to 650, SEQ ID NOs: 24348 to 24362, and SEQ ID NOs: 27558 to 27572. In some embodiments, any one of the peptides in the PIK3CA E542K vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 646 to 650, SEQ ID NOs: 24348 to 24362, or SEQ ID NOs: 27558 to 27572.

In some embodiments, the amino acid sequence for a MHC class II peptide vaccine for the PIK3CA E542K protein mutation comprises two or more of the SEQ ID NOs: 646 to 650. In some embodiments, any one of the peptides in the PIK3CA E542K vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 646 to 650.

In some embodiments, the amino acid sequence for a MHC class II peptide vaccine for the PIK3CA E542K protein mutation comprises two or more of the SEQ ID NOs: 646 to 650, SEQ ID NOs: 24348 to 24362, and SEQ ID NOs: 27558 to 27572. In some embodiments, any one of the peptides in the PIK3CA E542K vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 646 to 650, SEQ ID NOs: 24348 to 24362, or SEQ ID NOs: 27558 to 27572.

In some embodiments, the amino acid sequence for a MHC class II peptide vaccine for the PIK3CA E545K protein mutation comprises one or more of the SEQ ID NOs: 651 to 657. In some embodiments, any one of the peptides in the PIK3CA E545K vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 651 to 657.

In some embodiments, the amino acid sequence for a MHC class II peptide vaccine for the PIK3CA E545K protein mutation comprises one or more of the SEQ ID NOs: 651 to 657, SEQ ID NOs: 24363 to 24388, and SEQ ID NOs: 27573 to 27599. In some embodiments, any one of the peptides in the PIK3CA E545K vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 651 to 657, SEQ ID NOs: 24363 to 24388, or SEQ ID NOs: 27573 to 27599.

In some embodiments, the amino acid sequence for a MHC class II peptide vaccine for the PIK3CA E545K protein mutation comprises two or more of the SEQ ID NOs: 651 to 657. In some embodiments, any one of the peptides in the PIK3CA E545K vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 651 to 657.

In some embodiments, the amino acid sequence for a MHC class II peptide vaccine for the PIK3CA E545K protein mutation comprises two or more of the SEQ ID NOs: 651 to 657, SEQ ID NOs: 24363 to 24388, and SEQ ID NOs: 27573 to 27599. In some embodiments, any one of the peptides in the PIK3CA E545K vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 651 to 657, SEQ ID NOs: 24363 to 24388, or SEQ ID NOs: 27573 to 27599.

In some embodiments, the amino acid sequence for a MHC class II peptide vaccine for the PIK3CA H1047R protein mutation comprises one or more of the SEQ ID NOs: 658 to 667. In some embodiments, any one of the peptides in the PIK3CA H1047R vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 658 to 667.

In some embodiments, the amino acid sequence for a MHC class II peptide vaccine for the PIK3CA H1047R protein mutation comprises one or more of the SEQ ID NOs: 658 to 667, SEQ ID NOs: 24389 to 24472, and SEQ ID NOs: 27600 to 27683. In some embodiments, any one of the peptides in the PIK3CA H1047R vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 658 to 667, SEQ ID NOs: 24389 to 24472, or SEQ ID NOs: 27600 to 27683.

In some embodiments, the amino acid sequence for a MHC class II peptide vaccine for the PIK3CA H1047R protein mutation comprises two or more of the SEQ ID NOs: 658 to 667. In some embodiments, any one of the peptides in the PIK3CA H1047R vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 658 to 667.

In some embodiments, the amino acid sequence for a MHC class II peptide vaccine for the PIK3CA H1047R protein mutation comprises two or more of the SEQ ID NOs: 658 to 667, SEQ ID NOs: 24389 to 24472, and SEQ ID NOs: 27600 to 27683. In some embodiments, any one of the peptides in the PIK3CA H1047R vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 658 to 667, SEQ ID NOs: 24389 to 24472, or SEQ ID NOs: 27600 to 27683.

In some embodiments, the amino acid sequence for a MHC class II peptide vaccine for the TP53 R158L protein mutation comprises one or more of the SEQ ID NOs: 700 to 707. In some embodiments, any one of the peptides in the TP53 R158L vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 700 to 707.

In some embodiments, the amino acid sequence for a MHC class II peptide vaccine for the TP53 R158L protein mutation comprises one or more of the SEQ ID NOs: 700 to 707, SEQ ID NOs: 24784 to 24927, and SEQ ID NOs: 28132 to 28372. In some embodiments, any one of the peptides in the TP53 R158L vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 700 to 707, SEQ ID NOs: 24784 to 24927, or SEQ ID NOs: 28132 to 28372.

In some embodiments, the amino acid sequence for a MHC class II peptide vaccine for the TP53 R158L protein mutation comprises two or more of the SEQ ID NOs: 700 to 707. In some embodiments, any one of the peptides in the TP53 R158L vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 700 to 707.

In some embodiments, the amino acid sequence for a MHC class II peptide vaccine for the TP53 R158L protein mutation comprises two or more of the SEQ ID NOs: 700 to 707, SEQ ID NOs: 24784 to 24927, and SEQ ID NOs: 28132 to 28372. In some embodiments, any one of the peptides in the TP53 R158L vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 700 to 707, SEQ ID NOs: 24784 to 24927, or SEQ ID NOs: 28132 to 28372.

In some embodiments, the amino acid sequence for a MHC class II peptide vaccine for the TP53 R175H protein mutation comprises one or more of the SEQ ID NOs: 708 to 717. In some embodiments, any one of the peptides in the TP53 R175H vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 708 to 717.

In some embodiments, the amino acid sequence for a MHC class II peptide vaccine for the TP53 R175H protein mutation comprises one or more of the SEQ ID NOs: 708 to 717, SEQ ID NOs: 24928 to 24954, and SEQ ID NOs: 28373 to 28410. In some embodiments, any one of the peptides in the TP53 R175H vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 708 to 717, SEQ ID NOs: 24928 to 24954, or SEQ ID NOs: 28373 to 28410.

In some embodiments, the amino acid sequence for a MHC class II peptide vaccine for the TP53 R175H protein mutation comprises two or more of the SEQ ID NOs: 708 to 717. In some embodiments, any one of the peptides in the TP53 R175H vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 708 to 717.

In some embodiments, the amino acid sequence for a MHC class II peptide vaccine for the TP53 R175H protein mutation comprises two or more of the SEQ ID NOs: 708 to 717, SEQ ID NOs: 24928 to 24954, and SEQ ID NOs: 28373 to 28410. In some embodiments, any one of the peptides in the TP53 R175H vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 708 to 717, SEQ ID NOs: 24928 to 24954, or SEQ ID NOs: 28373 to 28410.

In some embodiments, the amino acid sequence for a MHC class II peptide vaccine for the TP53 R248Q protein mutation comprises one or more of the SEQ ID NOs: 718 to 723. In some embodiments, any one of the peptides in the TP53 R248Q vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 718 to 723.

In some embodiments, the amino acid sequence for a MHC class II peptide vaccine for the TP53 R248Q protein mutation comprises one or more of the SEQ ID NOs: 718 to 723, SEQ ID NOs: 24955 to 25010, and SEQ ID NOs: 28411 to 28468. In some embodiments, any one of the peptides in the TP53 R248Q vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 718 to 723, SEQ ID NOs: 24955 to 25010, or SEQ ID NOs: 28411 to 28468.

In some embodiments, the amino acid sequence for a MHC class II peptide vaccine for the TP53 R248Q protein mutation comprises two or more of the SEQ ID NOs: 718 to 723. In some embodiments, any one of the peptides in the TP53 R248Q vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 718 to 723.

In some embodiments, the amino acid sequence for a MHC class II peptide vaccine for the TP53 R248Q protein mutation comprises two or more of the SEQ ID NOs: 718 to 723, SEQ ID NOs: 24955 to 25010, and SEQ ID NOs: 28411 to 28468. In some embodiments, any one of the peptides in the TP53 R248Q vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 718 to 723, SEQ ID NOs: 24955 to 25010, or SEQ ID NOs: 28411 to 28468.

In some embodiments, the amino acid sequence for a MHC class II peptide vaccine for the TP53 R273C protein mutation comprises one or more of the SEQ ID NOs: 733 to 739. In some embodiments, any one of the peptides in the TP53 R273C vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 733 to 739.

In some embodiments, the amino acid sequence for a MHC class II peptide vaccine for the TP53 R273C protein mutation comprises one or more of the SEQ ID NOs: 733 to 739, SEQ ID NOs: 25109 to 25117, and SEQ ID NOs: 28572 to 28580. In some embodiments, any one of the peptides in the TP53 R273C vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 733 to 739, SEQ ID NOs: 25109 to 25117, or SEQ ID NOs: 28572 to 28580.

In some embodiments, the amino acid sequence for a MHC class II peptide vaccine for the TP53 R273C protein mutation comprises two or more of the SEQ ID NOs: 733 to 739. In some embodiments, any one of the peptides in the TP53 R273C vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 733 to 739.

In some embodiments, the amino acid sequence for a MHC class II peptide vaccine for the TP53 R273C protein mutation comprises two or more of the SEQ ID NOs: 733 to 739, SEQ ID NOs: 25109 to 25117, and SEQ ID NOs: 28572 to 28580. In some embodiments, any one of the peptides in the TP53 R273C vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 733 to 739, SEQ ID NOs: 25109 to 25117, or SEQ ID NOs: 28572 to 28580.

In some embodiments, the amino acid sequence for a MHC class II peptide vaccine for the TP53 R273H protein mutation comprises one or more of the SEQ ID NOs: 740 to 748. In some embodiments, any one of the peptides in the TP53 R273H vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 740 to 748.

In some embodiments, the amino acid sequence for a MHC class II peptide vaccine for the TP53 R273H protein mutation comprises one or more of the SEQ ID NOs: 740 to 748, SEQ ID NOs: 25118 to 25206, and SEQ ID NOs: 28581 to 28697. In some embodiments, any one of the peptides in the TP53 R273H vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 740 to 748, SEQ ID NOs: 25118 to 25206, or SEQ ID NOs: 28581 to 28697.

In some embodiments, the amino acid sequence for a MHC class II peptide vaccine for the TP53 R273H protein mutation comprises two or more of the SEQ ID NOs: 740 to 748. In some embodiments, any one of the peptides in the TP53 R273H vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 740 to 748.

In some embodiments, the amino acid sequence for a MHC class II peptide vaccine for the TP53 R273H protein mutation comprises two or more of the SEQ ID NOs: 740 to 748, SEQ ID NOs: 25118 to 25206, and SEQ ID NOs: 28581 to 28697. In some embodiments, any one of the peptides in the TP53 R273H vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 740 to 748, SEQ ID NOs: 25118 to 25206, or SEQ ID NOs: 28581 to 28697.

In some embodiments, the amino acid sequence for a MHC class II peptide vaccine for the TP53 R248W protein mutation comprises one or more of the SEQ ID NOs: 724 to 732. In some embodiments, any one of the peptides in the TP53 R248W vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 724 to 732.

In some embodiments, the amino acid sequence for a MHC class II peptide vaccine for the TP53 R248W protein mutation comprises one or more of the SEQ ID NOs: 724 to 732, SEQ ID NOs: 25011 to 25108, and SEQ ID NOs: 28469 to 28571. In some embodiments, any one of the peptides in the TP53 R248W vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 724 to 732, SEQ ID NOs: 25011 to 25108, or SEQ ID NOs: 28469 to 28571.

In some embodiments, the amino acid sequence for a MHC class II peptide vaccine for the TP53 R248W protein mutation comprises two or more of the SEQ ID NOs: 724 to 732. In some embodiments, any one of the peptides in the TP53 R248W vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 724 to 732.

In some embodiments, the amino acid sequence for a MHC class II peptide vaccine for the TP53 R248W protein mutation comprises two or more of the SEQ ID NOs: 724 to 732, SEQ ID NOs: 25011 to 25108, and SEQ ID NOs: 28469 to 28571. In some embodiments, any one of the peptides in the TP53 R248W vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 724 to 732, SEQ ID NOs: 25011 to 25108, or SEQ ID NOs: 28469 to 28571.

In some embodiments, the amino acid sequence for a MHC class II peptide vaccine for the TP53 R282W protein mutation comprises one or more of the SEQ ID NOs: 749 to 750. In some embodiments, any one of the peptides in the TP53 R282W vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 749 to 750.

In some embodiments, the amino acid sequence for a MHC class II peptide vaccine for the TP53 R282W protein mutation comprises one or more of the SEQ ID NOs: 749 to 750, SEQ ID NOs: 25207 to 25218, and SEQ ID NOs: 28698 to 28709. In some embodiments, any one of the peptides in the TP53 R282W vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 749 to 750, SEQ ID NOs: 25207 to 25218, or SEQ ID NOs: 28698 to 28709.

In some embodiments, the amino acid sequence for a MHC class II peptide vaccine for the TP53 R282W protein mutation comprises two or more of the SEQ ID NOs: 749 to 750. In some embodiments, any one of the peptides in the TP53 R282W vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 749 to 750.

In some embodiments, the amino acid sequence for a MHC class II peptide vaccine for the TP53 R282W protein mutation comprises two or more of the SEQ ID NOs: 749 to 750, SEQ ID NOs: 25207 to 25218, and SEQ ID NOs: 28698 to 28709. In some embodiments, any one of the peptides in the TP53 R282W vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 749 to 750, SEQ ID NOs: 25207 to 25218, or SEQ ID NOs: 28698 to 28709.

In some embodiments, the amino acid sequence for a MHC class II peptide vaccine for the TP53 Y220C protein mutation comprises one or more of the SEQ ID NOs: 751 to 758. In some embodiments, any one of the peptides in the TP53 Y220C vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 751 to 758.

In some embodiments, the amino acid sequence for a MHC class II peptide vaccine for the TP53 Y220C protein mutation comprises one or more of the SEQ ID NOs: 751 to 758, SEQ ID NOs: 25219 to 25304, and SEQ ID NOs: 28710 to 28795. In some embodiments, any one of the peptides in the TP53 Y220C vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 751 to 758, SEQ ID NOs: 25219 to 25304, or SEQ ID NOs: 28710 to 28795.

In some embodiments, the amino acid sequence for a MHC class II peptide vaccine for the TP53 Y220C protein mutation comprises two or more of the SEQ ID NOs: 751 to 758. In some embodiments, any one of the peptides in the TP53 Y220C vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 751 to 758.

In some embodiments, the amino acid sequence for a MHC class II peptide vaccine for the TP53 Y220C protein mutation comprises two or more of the SEQ ID NOs: 751 to 758, SEQ ID NOs: 25219 to 25304, and SEQ ID NOs: 28710 to 28795. In some embodiments, any one of the peptides in the TP53 Y220C vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 751 to 758, SEQ ID NOs: 25219 to 25304, or SEQ ID NOs: 28710 to 28795.

In some embodiments, the amino acid sequence for a MHC class II peptide vaccine for the PIK3CA R88Q protein mutation comprises one or more of the SEQ ID NOs: 668 to 675. In some embodiments, any one of the peptides in the PIK3CA R88Q vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 668 to 675.

In some embodiments, the amino acid sequence for a MHC class II peptide vaccine for the PIK3CA R88Q protein mutation comprises one or more of the SEQ ID NOs: 668 to 675, SEQ ID NOs: 24473 to 24571, and SEQ ID NOs: 27684 to 27889. In some embodiments, any one of the peptides in the PIK3CA R88Q vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 668 to 675, SEQ ID NOs: 24473 to 24571, or SEQ ID NOs: 27684 to 27889.

In some embodiments, the amino acid sequence for a MHC class II peptide vaccine for the PIK3CA R88Q protein mutation comprises two or more of the SEQ ID NOs: 668 to 675. In some embodiments, any one of the peptides in the PIK3CA R88Q vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 668 to 675.

In some embodiments, the amino acid sequence for a MHC class II peptide vaccine for the PIK3CA R88Q protein mutation comprises two or more of the SEQ ID NOs: 668 to 675, SEQ ID NOs: 24473 to 24571, and SEQ ID NOs: 27684 to 27889. In some embodiments, any one of the peptides in the PIK3CA R88Q vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 668 to 675, SEQ ID NOs: 24473 to 24571, or SEQ ID NOs: 27684 to 27889.

In some embodiments, the amino acid sequence for a MHC class II peptide vaccine for the GTF2I L424H protein mutation comprises one or more of the SEQ ID NOs: 528 to 534. In some embodiments, any one of the peptides in the GTF2I L424H vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 528 to 534.

In some embodiments, the amino acid sequence for a MHC class II peptide vaccine for the GTF2I L424H protein mutation comprises one or more of the SEQ ID NOs: 528 to 534, SEQ ID NOs: 23264 to 23415, and SEQ ID NOs: 26047 to 26375. In some embodiments, any one of the peptides in the GTF2I L424H vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 528 to 534, SEQ ID NOs: 23264 to 23415, or SEQ ID NOs: 26047 to 26375.

In some embodiments, the amino acid sequence for a MHC class II peptide vaccine for the GTF2I L424H protein mutation comprises two or more of the SEQ ID NOs: 528 to 534. In some embodiments, any one of the peptides in the GTF2I L424H vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 528 to 534.

In some embodiments, the amino acid sequence for a MHC class II peptide vaccine for the GTF2I L424H protein mutation comprises two or more of the SEQ ID NOs: 528 to 534, SEQ ID NOs: 23264 to 23415, and SEQ ID NOs: 26047 to 26375. In some embodiments, any one of the peptides in the GTF2I L424H vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 528 to 534, SEQ ID NOs: 23264 to 23415, or SEQ ID NOs: 26047 to 26375.

In some embodiments, the amino acid sequence for a MHC class II peptide vaccine for the PTEN R130Q protein mutation comprises one or more of the SEQ ID NOs: 681 to 690. In some embodiments, any one of the peptides in the PTEN R130Q vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 681 to 690.

In some embodiments, the amino acid sequence for a MHC class II peptide vaccine for the PTEN R130Q protein mutation comprises one or more of the SEQ ID NOs: 681 to 690, SEQ ID NOs: 24659 to 24724, and SEQ ID NOs: 27980 to 28052. In some embodiments, any one of the peptides in the PTEN R130Q vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 681 to 690, SEQ ID NOs: 24659 to 24724, or SEQ ID NOs: 27980 to 28052.

In some embodiments, the amino acid sequence for a MHC class II peptide vaccine for the PTEN R130Q protein mutation comprises two or more of the SEQ ID NOs: 681 to 690. In some embodiments, any one of the peptides in the PTEN R130Q vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 681 to 690.

In some embodiments, the amino acid sequence for a MHC class II peptide vaccine for the PTEN R130Q protein mutation comprises two or more of the SEQ ID NOs: 681 to 690, SEQ ID NOs: 24659 to 24724, and SEQ ID NOs: 27980 to 28052. In some embodiments, any one of the peptides in the PTEN R130Q vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 681 to 690, SEQ ID NOs: 24659 to 24724, or SEQ ID NOs: 27980 to 28052.

In some embodiments, the amino acid sequence for a MHC class II peptide vaccine for the AKT1 E17K protein mutation comprises one or more of the SEQ ID NOs: 475 to 483. In some embodiments, any one of the peptides in the AKT1 E17K vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 475 to 483.

In some embodiments, the amino acid sequence for a MHC class II peptide vaccine for the AKT1 E17K protein mutation comprises one or more of the SEQ ID NOs: 475 to 483, SEQ ID NOs: 22728 to 22838, and SEQ ID NOs: 25305 to 25488. In some embodiments, any one of the peptides in the AKT1 E17K vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 475 to 483, SEQ ID NOs: 22728 to 22838, or SEQ ID NOs: 25305 to 25488.

In some embodiments, the amino acid sequence for a MHC class II peptide vaccine for the AKT1 E17K protein mutation comprises two or more of the SEQ ID NOs: 475 to 483. In some embodiments, any one of the peptides in the AKT1 E17K vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 475 to 483.

In some embodiments, the amino acid sequence for a MHC class II peptide vaccine for the AKT1 E17K protein mutation comprises two or more of the SEQ ID NOs: 475 to 483, SEQ ID NOs: 22728 to 22838, and SEQ ID NOs: 25305 to 25488. In some embodiments, any one of the peptides in the AKT1 E17K vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 475 to 483, SEQ ID NOs: 22728 to 22838, or SEQ ID NOs: 25305 to 25488.

In some embodiments, the amino acid sequence for a MHC class II peptide vaccine for the PTEN R130G protein mutation comprises one or more of the SEQ ID NOs: 676 to 680. In some embodiments, any one of the peptides in the PTEN R130G vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 676 to 680.

In some embodiments, the amino acid sequence for a MHC class II peptide vaccine for the PTEN R130G protein mutation comprises one or more of the SEQ ID NOs: 676 to 680, SEQ ID NOs: 24572 to 24658, and SEQ ID NOs: 27890 to 27979. In some embodiments, any one of the peptides in the PTEN R130G vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 676 to 680, SEQ ID NOs: 24572 to 24658, or SEQ ID NOs: 27890 to 27979.

In some embodiments, the amino acid sequence for a MHC class II peptide vaccine for the PTEN R130G protein mutation comprises two or more of the SEQ ID NOs: 676 to 680. In some embodiments, any one of the peptides in the PTEN R130G vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 676 to 680.

In some embodiments, the amino acid sequence for a MHC class II peptide vaccine for the PTEN R130G protein mutation comprises two or more of the SEQ ID NOs: 676 to 680, SEQ ID NOs: 24572 to 24658, and SEQ ID NOs: 27890 to 27979. In some embodiments, any one of the peptides in the PTEN R130G vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 676 to 680, SEQ ID NOs: 24572 to 24658, or SEQ ID NOs: 27890 to 27979.

In some embodiments, the amino acid sequence for a MHC class II peptide vaccine for the TP53 H179R protein mutation comprises one or more of the SEQ ID NOs: 691 to 699. In some embodiments, any one of the peptides in the TP53 H179R vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 691 to 699.

In some embodiments, the amino acid sequence for a MHC class II peptide vaccine for the TP53 H179R protein mutation comprises one or more of the SEQ ID NOs: 691 to 699, SEQ ID NOs: 24725 to 24783, and SEQ ID NOs: 28053 to 28131. In some embodiments, any one of the peptides in the TP53 H179R vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 691 to 699, SEQ ID NOs: 24725 to 24783, or SEQ ID NOs: 28053 to 28131.

In some embodiments, the amino acid sequence for a MHC class II peptide vaccine for the TP53 H179R protein mutation comprises two or more of the SEQ ID NOs: 691 to 699. In some embodiments, any one of the peptides in the TP53 H179R vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 691 to 699.

In some embodiments, the amino acid sequence for a MHC class II peptide vaccine for the TP53 H179R protein mutation comprises two or more of the SEQ ID NOs: 691 to 699, SEQ ID NOs: 24725 to 24783, and SEQ ID NOs: 28053 to 28131. In some embodiments, any one of the peptides in the TP53 H179R vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 691 to 699, SEQ ID NOs: 24725 to 24783, or SEQ ID NOs: 28053 to 28131.

In some embodiments, the amino acid sequence vaccine for a MHC class II vaccine for pancreatic cancer comprises one or more of the SEQ ID NOs: 569 to 574, SEQ ID NOs: 578 to 584, SEQ ID NOs: 596 to 599, and SEQ ID NOs: 601 to 603. In some embodiments, any one of the peptides in the pancreatic cancer vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 569 to 574, SEQ ID NOs: 578 to 584, SEQ ID NOs: 596 to 599, or SEQ ID NOs: 601 to 603.

In some embodiments, the amino acid sequence vaccine for a MHC class II vaccine for pancreatic cancer comprises two or more of the SEQ ID NOs: 569 to 574, SEQ ID NOs: 578 to 584, SEQ ID NOs: 596 to 599, and SEQ ID NOs: 601 to 603. In some embodiments, any one of the peptides in the pancreatic cancer vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 569 to 574, SEQ ID NOs: 578 to 584, SEQ ID NOs: 596 to 599, or SEQ ID NOs: 601 to 603.

In some embodiments, the amino acid sequence vaccine for a MHC class II vaccine for skin cancer comprises one or more of the SEQ ID NOs: 484 to 485, SEQ ID NOs: 488 to 489, SEQ ID NOs: 495 to 499, SEQ ID NO: 616, SEQ ID NOs: 619 to 620, SEQ ID NOs: 625 to 628, SEQ ID NO: 634, SEQ ID NO: 637, and SEQ ID NOs: 639 to 640. In some embodiments, any one of the peptides in the skin cancer vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 484 to 485, SEQ ID NOs: 488 to 489, SEQ ID NOs: 495 to 499, SEQ ID NO: 616, SEQ ID NOs: 619 to 620, SEQ ID NOs: 625 to 628, SEQ ID NO: 634, SEQ ID NO: 637, or SEQ ID NOs: 639 to 640.

In some embodiments, the amino acid sequence vaccine for a MHC class II vaccine for skin cancer comprises two or more of the SEQ ID NOs: 484 to 485, SEQ ID NOs: 488 to 489, SEQ ID NOs: 495 to 499, SEQ ID NO: 616, SEQ ID NOs: 619 to 620, SEQ ID NOs: 625 to 628, SEQ ID NO: 634, SEQ ID NO: 637, and SEQ ID NOs: 639 to 640. In some embodiments, any one of the peptides in the skin cancer vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 484 to 485, SEQ ID NOs: 488 to 489, SEQ ID NOs: 495 to 499, SEQ ID NO: 616, SEQ ID NOs: 619 to 620, SEQ ID NOs: 625 to 628, SEQ ID NO: 634, SEQ ID NO: 637, or SEQ ID NOs: 639 to 640.

In some embodiments, the amino acid sequence vaccine for a MHC class II vaccine for thyroid cancer comprises one or more of the SEQ ID NOs: 484 to 485, SEQ ID NOs: 488 to 489, SEQ ID NO: 616, SEQ ID NOs: 619 to 620, SEQ ID NO: 634, SEQ ID NO: 637, and SEQ ID NO: 640. In some embodiments, any one of the peptides in the thyroid cancer vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 484 to 485, SEQ ID NOs: 488 to 489, SEQ ID NO: 616, SEQ ID NOs: 619 to 620, SEQ ID NO: 634, SEQ ID NO: 637, or SEQ ID NO: 640.

In some embodiments, the amino acid sequence vaccine for a MHC class II vaccine for thyroid cancer comprises two or more of the SEQ ID NOs: 484 to 485, SEQ ID NOs: 488 to 489, SEQ ID NO: 616, SEQ ID NOs: 619 to 620, SEQ ID NO: 634, SEQ ID NO: 637, and SEQ ID NO: 640. In some embodiments, any one of the peptides in the thyroid cancer vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 484 to 485, SEQ ID NOs: 488 to 489, SEQ ID NO: 616, SEQ ID NOs: 619 to 620, SEQ ID NO: 634, SEQ ID NO: 637, or SEQ ID NO: 640.

In some embodiments, the amino acid sequence vaccine for a MHC class II vaccine for brain cancer comprises one or more of the SEQ ID NO: 508, SEQ ID NO: 510, SEQ ID NO: 512, SEQ ID NO: 514, SEQ ID NOs: 535 to 537, SEQ ID NO: 539, SEQ ID NOs: 543 to 551, SEQ ID NO: 708, SEQ ID NO: 712, and SEQ ID NO: 738. In some embodiments, any one of the peptides in the brain cancer vaccine comprise an amino acid sequence 80, 81, 82, 83, 84, 85, 86, 87, 88, 89, 90, 91, 92, 93, 94, 95, 96, 97, 98 or 99% identical to SEQ ID NO: 508, SEQ ID NO: 510, SEQ ID NO: 512, SEQ ID NO: 514, SEQ ID NOs: 535 to 537, SEQ ID NO: 539, SEQ ID NOs: 543 to 551, SEQ ID NO: 708, SEQ ID NO: 712, or SEQ ID NO: 738.

In some embodiments, the amino acid sequence vaccine for a MHC class II vaccine for brain cancer comprises two or more of the SEQ ID NO: 508, SEQ ID NO: 510, SEQ ID NO: 512, SEQ ID NO: 514, SEQ ID NOs: 535 to 537, SEQ ID NO: 539, SEQ ID NOs: 543 to 551, SEQ ID NO: 708, SEQ ID NO: 712, and SEQ ID NO: 738. In some embodiments, any one of the peptides in the brain cancer vaccine comprise an amino acid sequence 80, 81, 82, 83, 84, 85, 86, 87, 88, 89, 90, 91, 92, 93, 94, 95, 96, 97, 98 or 99% identical to SEQ ID NO: 508, SEQ ID NO: 510, SEQ ID NO: 512, SEQ ID NO: 514, SEQ ID NOs: 535 to 537, SEQ ID NO: 539, SEQ ID NOs: 543 to 551, SEQ ID NO: 708, SEQ ID NO: 712, or SEQ ID NO: 738.

In some embodiments, the amino acid sequence vaccine for a MHC class II vaccine for colorectal cancer comprises one or more of the SEQ ID NOs: 484 to 485, SEQ ID NOs: 488 to 489, SEQ ID NOs: 569 to 575, SEQ ID NOs: 596 to 599, SEQ ID NOs: 601 to 604, SEQ ID NOs: 606 to 612, SEQ ID NO: 656, SEQ ID NO: 708, SEQ ID NO: 712, and SEQ ID NO: 759. In some embodiments, any one of the peptides in the colorectal cancer vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 484 to 485, SEQ ID NOs: 488 to 489, SEQ ID NOs: 569 to 575, SEQ ID NOs: 596 to 599, SEQ ID NOs: 601 to 604, SEQ ID NOs: 606 to 612, SEQ ID NO: 656, SEQ ID NO: 708, SEQ ID NO: 712, or SEQ ID NO: 759.

In some embodiments, the amino acid sequence vaccine for a MHC class II vaccine for colorectal cancer comprises two or more of the SEQ ID NOs: 484 to 485, SEQ ID NOs: 488 to 489, SEQ ID NOs: 569 to 575, SEQ ID NOs: 596 to 599, SEQ ID NOs: 601 to 604, SEQ ID NOs: 606 to 612, SEQ ID NO: 656, SEQ ID NO: 708, SEQ ID NO: 712, and SEQ ID NO: 759. In some embodiments, any one of the peptides in the colorectal cancer vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 484 to 485, SEQ ID NOs: 488 to 489, SEQ ID NOs: 569 to 575, SEQ ID NOs: 596 to 599, SEQ ID NOs: 601 to 604, SEQ ID NOs: 606 to 612, SEQ ID NO: 656, SEQ ID NO: 708, SEQ ID NO: 712, or SEQ ID NO: 759.

In some embodiments, the amino acid sequence vaccine for a MHC class II vaccine for bronchus and lung cancer comprises one or more of the SEQ ID NOs: 520 to 521, SEQ ID NOs: 523 to 524, SEQ ID NOs: 554 to 556, SEQ ID NO: 558, SEQ ID NO: 561, SEQ ID NOs: 563 to 565, SEQ ID NOs: 569 to 573, SEQ ID NOs: 596 to 600, SEQ ID NO: 650, SEQ ID NO: 656, and SEQ ID NOs: 700 to 705. In some embodiments, any one of the peptides in the bronchus and lung cancer vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 520 to 521, SEQ ID NOs: 523 to 524, SEQ ID NOs: 554 to 556, SEQ ID NO: 558, SEQ ID NO: 561, SEQ ID NOs: 563 to 565, SEQ ID NOs: 569 to 573, SEQ ID NOs: 596 to 600, SEQ ID NO: 650, SEQ ID NO: 656, or SEQ ID NOs: 700 to 705.

In some embodiments, the amino acid sequence vaccine for a MHC class II vaccine for bronchus and lung cancer comprises two or more of the SEQ ID NOs: 520 to 521, SEQ ID NOs: 523 to 524, SEQ ID NOs: 554 to 556, SEQ ID NO: 558, SEQ ID NO: 561, SEQ ID NOs: 563 to 565, SEQ ID NOs: 569 to 573, SEQ ID NOs: 596 to 600, SEQ ID NO: 650, SEQ ID NO: 656, and SEQ ID NOs: 700 to 705. In some embodiments, any one of the peptides in the bronchus and lung cancer vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 520 to 521, SEQ ID NOs: 523 to 524, SEQ ID NOs: 554 to 556, SEQ ID NO: 558, SEQ ID NO: 561, SEQ ID NOs: 563 to 565, SEQ ID NOs: 569 to 573, SEQ ID NOs: 596 to 600, SEQ ID NO: 650, SEQ ID NO: 656, or SEQ ID NOs: 700 to 705.

In some embodiments, the amino acid sequence vaccine for a MHC class II vaccine for breast cancer comprises one or more of the SEQ ID NOs: 646 to 667, SEQ ID NOs: 708 to 717, and SEQ ID NOs: 733 to 748. In some embodiments, any one of the peptides in the breast cancer vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 646 to 667, SEQ ID NOs: 708 to 717, or SEQ ID NOs: 733 to 748.

In some embodiments, the amino acid sequence vaccine for a MHC class II vaccine for breast cancer comprises two or more of the SEQ ID NOs: 646 to 667, SEQ ID NOs: 708 to 717, and SEQ ID NOs: 733 to 748. In some embodiments, any one of the peptides in the breast cancer vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 646 to 667, SEQ ID NOs: 708 to 717, or SEQ ID NOs: 733 to 748.

In some embodiments, the amino acid sequence vaccine for a MHC class II vaccine for ovarian cancer comprises one or more of the SEQ ID NOs: 646 to 667, SEQ ID NOs: 708 to 717, and SEQ ID NOs: 733 to 748. In some embodiments, any one of the peptides in the ovarian cancer vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 646 to 667, SEQ ID NOs: 708 to 717, or SEQ ID NOs: 733 to 748.

In some embodiments, the amino acid sequence vaccine for a MHC class II vaccine for ovarian cancer comprises two or more of the SEQ ID NOs: 646 to 667, SEQ ID NOs: 708 to 717, and SEQ ID NOs: 733 to 748. In some embodiments, any one of the peptides in the ovarian cancer vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 646 to 667, SEQ ID NOs: 708 to 717, or SEQ ID NOs: 733 to 748.

Table 2 summarizes MHC class II peptide sequences described herein including the respective SEQ ID NO, amino acid sequence corresponding to the SEQ ID NO, the amino acid sequence corresponding to the peptide's binding core, the protein target (with specific mutation), the seed amino acid sequence (i.e., the amino acid sequence of the wild type KRAS fragment), the seed amino acid sequence of the binding core, and the amino acid substitution (if any) for heteroclitic peptides at positions 1, 4, 6, and 9. Table 2 includes peptide sequences comprising SEQ ID NOs: 475 to 759. SEQ ID NOs: 475 to 759 (Table 2) encode for recombinant peptides. In some embodiments, any combination of peptides listed in Table 2 (SEQ ID NOs: 475 to 759) may be used to create a single target (individual) or combined peptide vaccine having between about 2 and about 40 peptides. In some embodiments, any one of the peptides (peptides 475 to 759; SEQ ID NOs: 475 to 759) in the combined vaccine comprises an amino acid sequence 80, 81, 82, 83, 84, 85, 86, 87, 88, 89, 90, 91, 92, 93, 94, 95, 96, 97, 98 or 99% identical to any of SEQ ID NOs: 475 to 759.

Additional amino acid sequences of MHC class II vaccine peptides are provided in Sequence Listings (SEQ ID NOs: 22728 to 28795). In some embodiments, any combination of MHC class II peptides disclosed herein (SEQ ID NOs: 475 to 759 and SEQ ID NOs: 22728 to 28795) may be used to create a combined peptide vaccine having between about 2 and about 40 peptides. In some embodiments, any one of the peptides (SEQ ID NOs: 475 to 759 and SEQ ID NOs: 22728 to 28795) in the combined vaccine comprises or contains an amino acid sequence 80, 81, 82, 83, 84, 85, 86, 87, 88, 89, 90, 91, 92, 93, 94, 95, 96, 97, 98 or 99% identical to any of SEQ ID NOs: 475 to 759 or SEQ ID NOs: 22728 to 28795.

In some embodiments, the amino acid sequence for a MHC class I and/or MHC class II peptides may be used to create a single target (individual) or combined peptide vaccine for mutation in the AKT1 protein having between about 2 and about 40 peptides. In some embodiments, any one of the peptides in the vaccine for mutation in the AKT1 protein comprises one or more of the SEQ ID NOs: 1 to 18, SEQ ID NO: 459, SEQ ID NOs: 475 to 483, SEQ ID NOs: 760 to 1768, SEQ ID NOs: 22386 to 22396, SEQ ID NOs: 22728 to 22838, and SEQ ID NOs: 25305 to 25488. In some embodiments, any one of the peptides in the AKT1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 1 to 18, SEQ ID NO: 459, SEQ ID NOs: 475 to 483, SEQ ID NOs: 760 to 1768, SEQ ID NOs: 22386 to 22396, SEQ ID NOs: 22728 to 22838, or SEQ ID NOs: 25305 to 25488.

In some embodiments, the amino acid sequence for a MHC class I and/or MHC class II peptides may be used to create a single target (individual) or combined peptide vaccine for mutation in the BRAF protein having between about 2 and about 40 peptides. In some embodiments, any one of the peptides in the vaccine for mutation in the BRAF protein comprises one or more of the SEQ ID NOs: 19 to 50, SEQ ID NOs: 484 to 502, SEQ ID NOs: 1769 to 3170, SEQ ID NOs: 22397 to 22417, SEQ ID NOs: 22839 to 22966, and SEQ ID NOs: 25489 to 25616. In some embodiments, any one of the peptides in the BRAF vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 19 to 50, SEQ ID NOs: 484 to 502, SEQ ID NOs: 1769 to 3170, SEQ ID NOs: 22397 to 22417, SEQ ID NOs: 22839 to 22966, or SEQ ID NOs: 25489 to 25616.

In some embodiments, the amino acid sequence for a MHC class I and/or MHC class II peptides may be used to create a single target (individual) or combined peptide vaccine for mutation in the EGFR protein having between about 2 and about 40 peptides. In some embodiments, any one of the peptides in the vaccine for mutation in the EGFR protein comprises one or more of the SEQ ID NOs: 51 to 98, SEQ ID NOs: 503 to 527, SEQ ID NOs: 3171 to 5756, SEQ ID NOs: 22418 to 22449, SEQ ID NOs: 22967 to 23263, and SEQ ID NOs: 25617 to 26046. In some embodiments, any one of the peptides in the EGFR vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 51 to 98, SEQ ID NOs: 503 to 527, SEQ ID NOs: 3171 to 5756, SEQ ID NOs: 22418 to 22449, SEQ ID NOs: 22967 to 23263, or SEQ ID NOs: 25617 to 26046.

In some embodiments, the amino acid sequence for a MHC class I and/or MHC class II peptides may be used to create a single target (individual) or combined peptide vaccine for mutation in the GTF2I protein having between about 2 and about 40 peptides. In some embodiments, any one of the peptides in the vaccine for mutation in the GTF2I protein comprises one or more of the SEQ ID NOs: 99 to 118, SEQ ID NOs: 528 to 534, SEQ ID NOs: 5757 to 6498, SEQ ID NOs: 22450 to 22466, SEQ ID NOs: 23264 to 23415, and SEQ ID NOs: 26047 to 26375. In some embodiments, any one of the peptides in the GTF2I vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 99 to 118, SEQ ID NOs: 528 to 534, SEQ ID NOs: 5757 to 6498, SEQ ID NOs: 22450 to 22466, SEQ ID NOs: 23264 to 23415, or SEQ ID NOs: 26047 to 26375.

In some embodiments, the amino acid sequence for a MHC class I and/or MHC class II peptides may be used to create a single target (individual) or combined peptide vaccine for mutation in the IDH1 protein having between about 2 and about 40 peptides. In some embodiments, any one of the peptides in the vaccine for mutation in the IDH1 protein comprises one or more of the SEQ ID NOs: 119 to 140, SEQ ID NOs: 460 to 461, SEQ ID NOs: 535 to 553, SEQ ID NOs: 6499 to 7098, SEQ ID NOs: 22467 to 22488, SEQ ID NOs: 23416 to 23631, and SEQ ID NOs: 26376 to 26614. In some embodiments, any one of the peptides in the IDH1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 119 to 140, SEQ ID NOs: 460 to 461, SEQ ID NOs: 535 to 553, SEQ ID NOs: 6499 to 7098, SEQ ID NOs: 22467 to 22488, SEQ ID NOs: 23416 to 23631, or SEQ ID NOs: 26376 to 26614.

In some embodiments, the amino acid sequence for a MHC class I and/or MHC class II peptides may be used to create a single target (individual) or combined peptide vaccine for mutation in the KRAS protein having between about 2 and about 40 peptides. In some embodiments, any one of the peptides in the vaccine for mutation in the KRAS protein comprises one or more of the SEQ ID NOs: 141 to 229, SEQ ID NOs: 462 to 466, SEQ ID NOs: 554 to 615, SEQ ID NO: 759, SEQ ID NOs: 7099 to 12814, SEQ ID NOs: 22489 to 22558, SEQ ID NOs: 23632 to 24129, and SEQ ID NOs: 26615 to 27328. In some embodiments, any one of the peptides in the KRAS vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 141 to 229, SEQ ID NOs: 462 to 466, SEQ ID NOs: 554 to 615, SEQ ID NO: 759, SEQ ID NOs: 7099 to 12814, SEQ ID NOs: 22489 to 22558, SEQ ID NOs: 23632 to 24129, or SEQ ID NOs: 26615 to 27328.

In some embodiments, the amino acid sequence for a MHC class I and/or MHC class II peptides may be used to create a single target (individual) or combined peptide vaccine for mutation in the NRAS protein having between about 2 and about 40 peptides. In some embodiments, any one of the peptides in the vaccine for mutation in the NRAS protein comprises one or more of the SEQ ID NOs: 230 to 272, SEQ ID NOs: 616 to 645, SEQ ID NOs: 12815 to 14836, SEQ ID NOs: 22559 to 22582, SEQ ID NOs: 24130 to 24347, and SEQ ID NOs: 27329 to 27557. In some embodiments, any one of the peptides in the NRAS vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 230 to 272, SEQ ID NOs: 616 to 645, SEQ ID NOs: 12815 to 14836, SEQ ID NOs: 22559 to 22582, SEQ ID NOs: 24130 to 24347, or SEQ ID NOs: 27329 to 27557.

In some embodiments, the amino acid sequence for a MHC class I and/or MHC class II peptides may be used to create a single target (individual) or combined peptide vaccine for mutation in the PIK3CA protein having between about 2 and about 40 peptides. In some embodiments, any one of the peptides in the vaccine for mutation in the PIK3CA protein comprises one or more of the SEQ ID NOs: 273 to 322, SEQ ID NOs: 467 to 468, SEQ ID NOs: 646 to 675, SEQ ID NOs: 14837 to 17342, SEQ ID NOs: 22583 to 22622, SEQ ID NOs: 24348 to 24571, and SEQ ID NOs: 27558 to 27889. In some embodiments, any one of the peptides in the PIK3CA vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 273 to 322, SEQ ID NOs: 467 to 468, SEQ ID NOs: 646 to 675, SEQ ID NOs: 14837 to 17342, SEQ ID NOs: 22583 to 22622, SEQ ID NOs: 24348 to 24571, or SEQ ID NOs: 27558 to 27889.

In some embodiments, the amino acid sequence for a MHC class I and/or MHC class II peptides may be used to create a single target (individual) or combined peptide vaccine for mutation in the PTEN protein having between about 2 and about 40 peptides. In some embodiments, any one of the peptides in the vaccine for mutation in the PTEN protein comprises one or more of the SEQ ID NOs: 323 to 353, SEQ ID NOs: 676 to 690, SEQ ID NOs: 17343 to 18205, SEQ ID NOs: 22623 to 22636, SEQ ID NOs: 24572 to 24724, and SEQ ID NOs: 27890 to 28052. In some embodiments, any one of the peptides in the PTEN vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 323 to 353, SEQ ID NOs: 676 to 690, SEQ ID NOs: 17343 to 18205, SEQ ID NOs: 22623 to 22636, SEQ ID NOs: 24572 to 24724, or SEQ ID NOs: 27890 to 28052.

In some embodiments, the amino acid sequence for a MHC class I and/or MHC class II peptides may be used to create a single target (individual) or combined peptide vaccine for mutation in the TP53 protein having between about 2 and about 40 peptides. In some embodiments, any one of the peptides in the vaccine for mutation in the TP53 protein comprises one or more of the SEQ ID NOs: 354 to 458, SEQ ID NOs: 469 to 474, SEQ ID NOs: 691 to 758, SEQ ID NOs: 18206 to 22385, SEQ ID NOs: 22637 to 22727, SEQ ID NOs: 24725 to 25304, and SEQ ID NOs: 28053 to 28795. In some embodiments, any one of the peptides in the TP53 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 354 to 458, SEQ ID NOs: 469 to 474, SEQ ID NOs: 691 to 758, SEQ ID NOs: 18206 to 22385, SEQ ID NOs: 22637 to 22727, SEQ ID NOs: 24725 to 25304, or SEQ ID NOs: 28053 to 28795.

In some embodiments, the amino acid sequence for a MHC class I and/or MHC class II peptides may be used to create a single target (individual) or combined peptide vaccine for mutation in the RAS protein having between about 2 and about 40 peptides. In some embodiments, any one of the peptides in the vaccine for mutation in the RAS protein comprises one or more of the SEQ ID NOs: 141 to 272, SEQ ID NOs: 462 to 466, SEQ ID NOs: 554 to 645, SEQ ID NO: 759, SEQ ID NOs: 7099 to 14836, SEQ ID NOs: 22489 to 22582, SEQ ID NOs: 23632 to 24347, and SEQ ID NOs: 26615 to 27557. In some embodiments, any one of the peptides in the RAS vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 141 to 272, SEQ ID NOs: 462 to 466, SEQ ID NOs: 554 to 645, SEQ ID NO: 759, SEQ ID NOs: 7099 to 14836, SEQ ID NOs: 22489 to 22582, SEQ ID NOs: 23632 to 24347, or SEQ ID NOs: 26615 to 27557.

In some embodiments, the amino acid sequence for a MHC class I and/or MHC class II peptides may be used to create a single target (individual) or combined peptide vaccine for the BRAF V600E protein mutation having between about 2 and about 40 peptides. In some embodiments, any one of the peptides in the vaccine for the BRAF V600E protein mutation comprises one or more of the SEQ ID NOs: 19 to 33, SEQ ID NOs: 484 to 494, SEQ ID NOs: 1769 to 2329, SEQ ID NOs: 22397 to 22405, SEQ ID NOs: 22839 to 22876, and SEQ ID NOs: 25489 to 25526. In some embodiments, any one of the peptides in the BRAF V600E vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 19 to 33, SEQ ID NOs: 484 to 494, SEQ ID NOs: 1769 to 2329, SEQ ID NOs: 22397 to 22405, SEQ ID NOs: 22839 to 22876, or SEQ ID NOs: 25489 to 25526.

In some embodiments, the amino acid sequence for a MHC class I and/or MHC class II peptides may be used to create a single target (individual) or combined peptide vaccine for the BRAF V600M protein mutation having between about 2 and about 40 peptides. In some embodiments, any one of the peptides in the vaccine for the BRAF V600M protein mutation comprises one or more of the SEQ ID NOs: 34 to 50, SEQ ID NOs: 495 to 502, SEQ ID NOs: 2330 to 3170, SEQ ID NOs: 22406 to 22417, SEQ ID NOs: 22877 to 22966, and SEQ ID NOs: 25527 to 25616. In some embodiments, any one of the peptides in the BRAF V600M vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 34 to 50, SEQ ID NOs: 495 to 502, SEQ ID NOs: 2330 to 3170, SEQ ID NOs: 22406 to 22417, SEQ ID NOs: 22877 to 22966, or SEQ ID NOs: 25527 to 25616.

In some embodiments, the amino acid sequence for a MHC class I and/or MHC class II peptides may be used to create a single target (individual) or combined peptide vaccine for the EGFR A289V protein mutation having between about 2 and about 40 peptides. In some embodiments, any one of the peptides in the vaccine for the EGFR A289V protein mutation comprises one or more of the SEQ ID NOs: 51 to 66, SEQ ID NOs: 503 to 509, SEQ ID NOs: 3171 to 4055, SEQ ID NOs: 22418 to 22430, SEQ ID NOs: 22967 to 23000, and SEQ ID NOs: 25617 to 25653. In some embodiments, any one of the peptides in the EGFR A289V vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 51 to 66, SEQ ID NOs: 503 to 509, SEQ ID NOs: 3171 to 4055, SEQ ID NOs: 22418 to 22430, SEQ ID NOs: 22967 to 23000, or SEQ ID NOs: 25617 to 25653.

In some embodiments, the amino acid sequence for a MHC class I and/or MHC class II peptides may be used to create a single target (individual) or combined peptide vaccine for the EGFR G598V protein mutation having between about 2 and about 40 peptides. In some embodiments, any one of the peptides in the vaccine for the EGFR G598V protein mutation comprises one or more of the SEQ ID NOs: 67 to 81, SEQ ID NOs: 510 to 519, SEQ ID NOs: 4056 to 4718, SEQ ID NOs: 22431 to 22437, SEQ ID NOs: 23001 to 23089, and SEQ ID NOs: 25654 to 25794. In some embodiments, any one of the peptides in the EGFR G598V vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 67 to 81, SEQ ID NOs: 510 to 519, SEQ ID NOs: 4056 to 4718, SEQ ID NOs: 22431 to 22437, SEQ ID NOs: 23001 to 23089, or SEQ ID NOs: 25654 to 25794.

In some embodiments, the amino acid sequence for a MHC class I and/or MHC class II peptides may be used to create a single target (individual) or combined peptide vaccine for the EGFR L858R protein mutation having between about 2 and about 40 peptides. In some embodiments, any one of the peptides in the vaccine for the EGFR L858R protein mutation comprises one or more of the SEQ ID NOs: 82 to 98, SEQ ID NOs: 520 to 527, SEQ ID NOs: 4719 to 5756, SEQ ID NOs: 22438 to 22449, SEQ ID NOs: 23090 to 23263, and SEQ ID NOs: 25795 to 26046. In some embodiments, any one of the peptides in the EGFR L858R vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 82 to 98, SEQ ID NOs: 520 to 527, SEQ ID NOs: 4719 to 5756, SEQ ID NOs: 22438 to 22449, SEQ ID NOs: 23090 to 23263, or SEQ ID NOs: 25795 to 26046.

In some embodiments, the amino acid sequence for a MHC class I and/or MHC class II peptides may be used to create a single target (individual) or combined peptide vaccine for the IDH1 R132H protein mutation having between about 2 and about 40 peptides. In some embodiments, any one of the peptides in the vaccine for the IDH1 R132H protein mutation comprises one or more of the SEQ ID NOs: 125 to 140, SEQ ID NO: 461, SEQ ID NOs: 543 to 553, SEQ ID NOs: 6738 to 7098, SEQ ID NOs: 22477 to 22488, SEQ ID NOs: 23505 to 23631, and SEQ ID NOs: 26469 to 26614. In some embodiments, any one of the peptides in the IDH1 R132H vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 125 to 140, SEQ ID NO: 461, SEQ ID NOs: 543 to 553, SEQ ID NOs: 6738 to 7098, SEQ ID NOs: 22477 to 22488, SEQ ID NOs: 23505 to 23631, or SEQ ID NOs: 26469 to 26614.

In some embodiments, the amino acid sequence for a MHC class I and/or MHC class II peptides may be used to create a single target (individual) or combined peptide vaccine for the IDH1 R132C protein mutation having between about 2 and about 40 peptides. In some embodiments, any one of the peptides in the vaccine for the IDH1 R132C protein mutation comprises one or more of the SEQ ID NOs: 119 to 124, SEQ ID NO: 460, SEQ ID NOs: 535 to 542, SEQ ID NOs: 6499 to 6737, SEQ ID NOs: 22467 to 22476, SEQ ID NOs: 23416 to 23504, and SEQ ID NOs: 26376 to 26468. In some embodiments, any one of the peptides in the IDH1 R132C vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 119 to 124, SEQ ID NO: 460, SEQ ID NOs: 535 to 542, SEQ ID NOs: 6499 to 6737, SEQ ID NOs: 22467 to 22476, SEQ ID NOs: 23416 to 23504, or SEQ ID NOs: 26376 to 26468.

In some embodiments, the amino acid sequence for a MHC class I and/or MHC class II peptides may be used to create a single target (individual) or combined peptide vaccine for the KRAS G12D protein mutation having between about 2 and about 40 peptides. In some embodiments, any one of the peptides in the vaccine for the KRAS G12D protein mutation comprises one or more of the SEQ ID NOs: 167 to 178, SEQ ID NO: 464, SEQ ID NOs: 569 to 577, SEQ ID NOs: 8432 to 9733, SEQ ID NOs: 22507 to 22518, SEQ ID NOs: 23750 to 23809, and SEQ ID NOs: 26757 to 26833. In some embodiments, any one of the peptides in the KRAS G12D vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 167 to 178, SEQ ID NO: 464, SEQ ID NOs: 569 to 577, SEQ ID NOs: 8432 to 9733, SEQ ID NOs: 22507 to 22518, SEQ ID NOs: 23750 to 23809, or SEQ ID NOs: 26757 to 26833.

In some embodiments, the amino acid sequence for a MHC class I and/or MHC class II peptides may be used to create a single target (individual) or combined peptide vaccine for the KRAS G12V protein mutation having between about 2 and about 40 peptides. In some embodiments, any one of the peptides in the vaccine for the KRAS G12V protein mutation comprises one or more of the SEQ ID NOs: 203 to 213, SEQ ID NOs: 596 to 605, SEQ ID NOs: 11009 to 11744, SEQ ID NOs: 22537 to 22546, SEQ ID NOs: 23958 to 24025, and SEQ ID NOs: 27057 to 27148. In some embodiments, any one of the peptides in the KRAS G12V vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 203 to 213, SEQ ID NOs: 596 to 605, SEQ ID NOs: 11009 to 11744, SEQ ID NOs: 22537 to 22546, SEQ ID NOs: 23958 to 24025, or SEQ ID NOs: 27057 to 27148.

In some embodiments, the amino acid sequence for a MHC class I and/or MHC class II peptides may be used to create a single target (individual) or combined peptide vaccine for the KRAS G12R protein mutation having between about 2 and about 40 peptides. In some embodiments, any one of the peptides in the vaccine for the KRAS G12R protein mutation comprises one or more of the SEQ ID NOs: 179 to 191, SEQ ID NO: 465, SEQ ID NOs: 578 to 587, SEQ ID NOs: 9734 to 10236, SEQ ID NOs: 22519 to 22527, SEQ ID NOs: 23810 to 23889, and SEQ ID NOs: 26834 to 26967. In some embodiments, any one of the peptides in the KRAS G12R vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 179 to 191, SEQ ID NO: 465, SEQ ID NOs: 578 to 587, SEQ ID NOs: 9734 to 10236, SEQ ID NOs: 22519 to 22527, SEQ ID NOs: 23810 to 23889, or SEQ ID NOs: 26834 to 26967.

In some embodiments, the amino acid sequence for a MHC class I and/or MHC class II peptides may be used to create a single target (individual) or combined peptide vaccine for the KRAS G12C protein mutation having between about 2 and about 40 peptides. In some embodiments, any one of the peptides in the vaccine for the KRAS G12C protein mutation comprises one or more of the SEQ ID NOs: 154 to 166, SEQ ID NO: 463, SEQ ID NOs: 561 to 568, SEQ ID NOs: 7881 to 8431, SEQ ID NOs: 22498 to 22506, SEQ ID NOs: 23700 to 23749, and SEQ ID NOs: 26702 to 26756. In some embodiments, any one of the peptides in the KRAS G12C vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 154 to 166, SEQ ID NO: 463, SEQ ID NOs: 561 to 568, SEQ ID NOs: 7881 to 8431, SEQ ID NOs: 22498 to 22506, SEQ ID NOs: 23700 to 23749, or SEQ ID NOs: 26702 to 26756.

In some embodiments, the amino acid sequence for a MHC class I and/or MHC class II peptides may be used to create a single target (individual) or combined peptide vaccine for the KRAS G13D protein mutation having between about 2 and about 40 peptides. In some embodiments, any one of the peptides in the vaccine for the KRAS G13D protein mutation comprises one or more of the SEQ ID NOs: 214 to 229, SEQ ID NO: 466, SEQ ID NOs: 606 to 615, SEQ ID NO: 759, SEQ ID NOs: 11745 to 12814, SEQ ID NOs: 22547 to 22558, SEQ ID NOs: 24026 to 24129, and SEQ ID NOs: 27149 to 27328. In some embodiments, any one of the peptides in the KRAS G13D vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 214 to 229, SEQ ID NO: 466, SEQ ID NOs: 606 to 615, SEQ ID NO: 759, SEQ ID NOs: 11745 to 12814, SEQ ID NOs: 22547 to 22558, SEQ ID NOs: 24026 to 24129, or SEQ ID NOs: 27149 to 27328.

In some embodiments, the amino acid sequence for a MHC class I and/or MHC class II peptides may be used to create a single target (individual) or combined peptide vaccine for the KRAS G12A protein mutation having between about 2 and about 40 peptides. In some embodiments, any one of the peptides in the vaccine for the KRAS G12A protein mutation comprises one or more of the SEQ ID NOs: 141 to 153, SEQ ID NO: 462, SEQ ID NOs: 554 to 560, SEQ ID NOs: 7099 to 7880, SEQ ID NOs: 22489 to 22497, SEQ ID NOs: 23632 to 23699, and SEQ ID NOs: 26615 to 26701. In some embodiments, any one of the peptides in the KRAS G12A vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 141 to 153, SEQ ID NO: 462, SEQ ID NOs: 554 to 560, SEQ ID NOs: 7099 to 7880, SEQ ID NOs: 22489 to 22497, SEQ ID NOs: 23632 to 23699, or SEQ ID NOs: 26615 to 26701.

In some embodiments, the amino acid sequence for a MHC class I and/or MHC class II peptides may be used to create a single target (individual) or combined peptide vaccine for the KRAS G12S protein mutation having between about 2 and about 40 peptides. In some embodiments, any one of the peptides in the vaccine for the KRAS G12S protein mutation comprises one or more of the SEQ ID NOs: 192 to 202, SEQ ID NOs: 588 to 595, SEQ ID NOs: 10237 to 11008, SEQ ID NOs: 22528 to 22536, SEQ ID NOs: 23890 to 23957, and SEQ ID NOs: 26968 to 27056. In some embodiments, any one of the peptides in the KRAS G12S vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 192 to 202, SEQ ID NOs: 588 to 595, SEQ ID NOs: 10237 to 11008, SEQ ID NOs: 22528 to 22536, SEQ ID NOs: 23890 to 23957, or SEQ ID NOs: 26968 to 27056.

In some embodiments, the amino acid sequence for a MHC class I and/or MHC class II peptides may be used to create a single target (individual) or combined peptide vaccine for the NRAS Q61R protein mutation having between about 2 and about 40 peptides. In some embodiments, any one of the peptides in the vaccine for the NRAS Q61R protein mutation comprises one or more of the SEQ ID NOs: 256 to 272, SEQ ID NOs: 634 to 645, SEQ ID NOs: 14315 to 14836, SEQ ID NOs: 22577 to 22582, SEQ ID NOs: 24280 to 24347, and SEQ ID NOs: 27490 to 27557. In some embodiments, any one of the peptides in the NRAS Q61R vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 256 to 272, SEQ ID NOs: 634 to 645, SEQ ID NOs: 14315 to 14836, SEQ ID NOs: 22577 to 22582, SEQ ID NOs: 24280 to 24347, or SEQ ID NOs: 27490 to 27557.

In some embodiments, the amino acid sequence for a MHC class I and/or MHC class II peptides may be used to create a single target (individual) or combined peptide vaccine for the NRAS Q61K protein mutation having between about 2 and about 40 peptides. In some embodiments, any one of the peptides in the vaccine for the NRAS Q61K protein mutation comprises one or more of the SEQ ID NOs: 230 to 238, SEQ ID NOs: 616 to 624, SEQ ID NOs: 12815 to 13434, SEQ ID NOs: 22559 to 22567, SEQ ID NOs: 24130 to 24194, and SEQ ID NOs: 27329 to 27396. In some embodiments, any one of the peptides in the NRAS Q61K vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 230 to 238, SEQ ID NOs: 616 to 624, SEQ ID NOs: 12815 to 13434, SEQ ID NOs: 22559 to 22567, SEQ ID NOs: 24130 to 24194, or SEQ ID NOs: 27329 to 27396.

In some embodiments, the amino acid sequence for a MHC class I and/or MHC class II peptides may be used to create a single target (individual) or combined peptide vaccine for the NRAS Q61L protein mutation having between about 2 and about 40 peptides. In some embodiments, any one of the peptides in the vaccine for the NRAS Q61L protein mutation comprises one or more of the SEQ ID NOs: 239 to 255, SEQ ID NOs: 625 to 633, SEQ ID NOs: 13435 to 14314, SEQ ID NOs: 22568 to 22576, SEQ ID NOs: 24195 to 24279, and SEQ ID NOs: 27397 to 27489. In some embodiments, any one of the peptides in the NRAS Q61L vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 239 to 255, SEQ ID NOs: 625 to 633, SEQ ID NOs: 13435 to 14314, SEQ ID NOs: 22568 to 22576, SEQ ID NOs: 24195 to 24279, or SEQ ID NOs: 27397 to 27489.

In some embodiments, the amino acid sequence for a MHC class I and/or MHC class II peptides may be used to create a single target (individual) or combined peptide vaccine for the PIK3CA E542K protein mutation having between about 2 and about 40 peptides. In some embodiments, any one of the peptides in the vaccine for the PIK3CA E542K protein mutation comprises one or more of the SEQ ID NOs: 273 to 285, SEQ ID NOs: 646 to 650, SEQ ID NOs: 14837 to 15625, SEQ ID NOs: 22583 to 22592, SEQ ID NOs: 24348 to 24362, and SEQ ID NOs: 27558 to 27572. In some embodiments, any one of the peptides in the PIK3CA E542K vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 273 to 285, SEQ ID NOs: 646 to 650, SEQ ID NOs: 14837 to 15625, SEQ ID NOs: 22583 to 22592, SEQ ID NOs: 24348 to 24362, or SEQ ID NOs: 27558 to 27572.

In some embodiments, the amino acid sequence for a MHC class I and/or MHC class II peptides may be used to create a single target (individual) or combined peptide vaccine for the PIK3CA E545K protein mutation having between about 2 and about 40 peptides. In some embodiments, any one of the peptides in the vaccine for the PIK3CA E545K protein mutation comprises one or more of the SEQ ID NOs: 286 to 293, SEQ ID NO: 467, SEQ ID NOs: 651 to 657, SEQ ID NOs: 15626 to 15907, SEQ ID NOs: 22593 to 22602, SEQ ID NOs: 24363 to 24388, and SEQ ID NOs: 27573 to 27599. In some embodiments, any one of the peptides in the PIK3CA E545K vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 286 to 293, SEQ ID NO: 467, SEQ ID NOs: 651 to 657, SEQ ID NOs: 15626 to 15907, SEQ ID NOs: 22593 to 22602, SEQ ID NOs: 24363 to 24388, or SEQ ID NOs: 27573 to 27599.

In some embodiments, the amino acid sequence for a MHC class I and/or MHC class II peptides may be used to create a single target (individual) or combined peptide vaccine for the PIK3CA H1047R protein mutation having between about 2 and about 40 peptides. In some embodiments, any one of the peptides in the vaccine for the PIK3CA H1047R protein mutation comprises one or more of the SEQ ID NOs: 294 to 309, SEQ ID NOs: 658 to 667, SEQ ID NOs: 15908 to 16276, SEQ ID NOs: 22603 to 22608, SEQ ID NOs: 24389 to 24472, and SEQ ID NOs: 27600 to 27683. In some embodiments, any one of the peptides in the PIK3CA H1047R vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 294 to 309, SEQ ID NOs: 658 to 667, SEQ ID NOs: 15908 to 16276, SEQ ID NOs: 22603 to 22608, SEQ ID NOs: 24389 to 24472, or SEQ ID NOs: 27600 to 27683.

In some embodiments, the amino acid sequence for a MHC class I and/or MHC class II peptides may be used to create a single target (individual) or combined peptide vaccine for the TP53 R158L protein mutation having between about 2 and about 40 peptides. In some embodiments, any one of the peptides in the vaccine for the TP53 R158L protein mutation comprises one or more of the SEQ ID NOs: 359 to 374, SEQ ID NOs: 469 to 470, SEQ ID NOs: 700 to 707, SEQ ID NOs: 18414 to 19404, SEQ ID NOs: 22644 to 22657, SEQ ID NOs: 24784 to 24927, and SEQ ID NOs: 28132 to 28372. In some embodiments, any one of the peptides in the TP53 R158L vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 359 to 374, SEQ ID NOs: 469 to 470, SEQ ID NOs: 700 to 707, SEQ ID NOs: 18414 to 19404, SEQ ID NOs: 22644 to 22657, SEQ ID NOs: 24784 to 24927, or SEQ ID NOs: 28132 to 28372.

In some embodiments, the amino acid sequence for a MHC class I and/or MHC class II peptides may be used to create a single target (individual) or combined peptide vaccine for the TP53 R175H protein mutation having between about 2 and about 40 peptides. In some embodiments, any one of the peptides in the vaccine for the TP53 R175H protein mutation comprises one or more of the SEQ ID NOs: 375 to 386, SEQ ID NOs: 471 to 472, SEQ ID NOs: 708 to 717, SEQ ID NOs: 19405 to 19752, SEQ ID NOs: 22658 to 22665, SEQ ID NOs: 24928 to 24954, and SEQ ID NOs: 28373 to 28410. In some embodiments, any one of the peptides in the TP53 R175H vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 375 to 386, SEQ ID NOs: 471 to 472, SEQ ID NOs: 708 to 717, SEQ ID NOs: 19405 to 19752, SEQ ID NOs: 22658 to 22665, SEQ ID NOs: 24928 to 24954, or SEQ ID NOs: 28373 to 28410.

In some embodiments, the amino acid sequence for a MHC class I and/or MHC class II peptides may be used to create a single target (individual) or combined peptide vaccine for the TP53 R248Q protein mutation having between about 2 and about 40 peptides. In some embodiments, any one of the peptides in the vaccine for the TP53 R248Q protein mutation comprises one or more of the SEQ ID NOs: 387 to 401, SEQ ID NOs: 718 to 723, SEQ ID NOs: 19753 to 20608, SEQ ID NOs: 22666 to 22678, SEQ ID NOs: 24955 to 25010, and SEQ ID NOs: 28411 to 28468. In some embodiments, any one of the peptides in the TP53 R248Q vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 387 to 401, SEQ ID NOs: 718 to 723, SEQ ID NOs: 19753 to 20608, SEQ ID NOs: 22666 to 22678, SEQ ID NOs: 24955 to 25010, or SEQ ID NOs: 28411 to 28468.

In some embodiments, the amino acid sequence for a MHC class I and/or MHC class II peptides may be used to create a single target (individual) or combined peptide vaccine for the TP53 R273C protein mutation having between about 2 and about 40 peptides. In some embodiments, any one of the peptides in the vaccine for the TP53 R273C protein mutation comprises one or more of the SEQ ID NOs: 422 to 432, SEQ ID NO: 473, SEQ ID NOs: 733 to 739, SEQ ID NOs: 21192 to 21462, SEQ ID NOs: 22690 to 22701, SEQ ID NOs: 25109 to 25117, and SEQ ID NOs: 28572 to 28580. In some embodiments, any one of the peptides in the TP53 R273C vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 422 to 432, SEQ ID NO: 473, SEQ ID NOs: 733 to 739, SEQ ID NOs: 21192 to 21462, SEQ ID NOs: 22690 to 22701, SEQ ID NOs: 25109 to 25117, or SEQ ID NOs: 28572 to 28580.

In some embodiments, the amino acid sequence for a MHC class I and/or MHC class II peptides may be used to create a single target (individual) or combined peptide vaccine for the TP53 R273H protein mutation having between about 2 and about 40 peptides. In some embodiments, any one of the peptides in the vaccine for the TP53 R273H protein mutation comprises one or more of the SEQ ID NOs: 433 to 446, SEQ ID NO: 474, SEQ ID NOs: 740 to 748, SEQ ID NOs: 21463 to 21845, SEQ ID NOs: 22702 to 22713, SEQ ID NOs: 25118 to 25206, and SEQ ID NOs: 28581 to 28697. In some embodiments, any one of the peptides in the TP53 R273H vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 433 to 446, SEQ ID NO: 474, SEQ ID NOs: 740 to 748, SEQ ID NOs: 21463 to 21845, SEQ ID NOs: 22702 to 22713, SEQ ID NOs: 25118 to 25206, or SEQ ID NOs: 28581 to 28697.

In some embodiments, the amino acid sequence for a MHC class I and/or MHC class II peptides may be used to create a single target (individual) or combined peptide vaccine for the TP53 R248W protein mutation having between about 2 and about 40 peptides. In some embodiments, any one of the peptides in the vaccine for the TP53 R248W protein mutation comprises one or more of the SEQ ID NOs: 402 to 421, SEQ ID NOs: 724 to 732, SEQ ID NOs: 20609 to 21191, SEQ ID NOs: 22679 to 22689, SEQ ID NOs: 25011 to 25108, and SEQ ID NOs: 28469 to 28571. In some embodiments, any one of the peptides in the TP53 R248W vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 402 to 421, SEQ ID NOs: 724 to 732, SEQ ID NOs: 20609 to 21191, SEQ ID NOs: 22679 to 22689, SEQ ID NOs: 25011 to 25108, or SEQ ID NOs: 28469 to 28571.

In some embodiments, the amino acid sequence for a MHC class I and/or MHC class II peptides may be used to create a single target (individual) or combined peptide vaccine for the TP53 R282W protein mutation having between about 2 and about 40 peptides. In some embodiments, any one of the peptides in the vaccine for the TP53 R282W protein mutation comprises one or more of the SEQ ID NOs: 447 to 449, SEQ ID NOs: 749 to 750, SEQ ID NOs: 21846 to 21940, SEQ ID NOs: 22714 to 22720, SEQ ID NOs: 25207 to 25218, and SEQ ID NOs: 28698 to 28709. In some embodiments, any one of the peptides in the TP53 R282W vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 447 to 449, SEQ ID NOs: 749 to 750, SEQ ID NOs: 21846 to 21940, SEQ ID NOs: 22714 to 22720, SEQ ID NOs: 25207 to 25218, or SEQ ID NOs: 28698 to 28709.

In some embodiments, the amino acid sequence for a MHC class I and/or MHC class II peptides may be used to create a single target (individual) or combined peptide vaccine for the TP53 Y220C protein mutation having between about 2 and about 40 peptides. In some embodiments, any one of the peptides in the vaccine for the TP53 Y220C protein mutation comprises one or more of the SEQ ID NOs: 450 to 458, SEQ ID NOs: 751 to 758, SEQ ID NOs: 21941 to 22385, SEQ ID NOs: 22721 to 22727, SEQ ID NOs: 25219 to 25304, and SEQ ID NOs: 28710 to 28795. In some embodiments, any one of the peptides in the TP53

Y220C vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 450 to 458, SEQ ID NOs: 751 to 758, SEQ ID NOs: 21941 to 22385, SEQ ID NOs: 22721 to 22727, SEQ ID NOs: 25219 to 25304, or SEQ ID NOs: 28710 to 28795.

In some embodiments, the amino acid sequence for a MHC class I and/or MHC class II peptides may be used to create a single target (individual) or combined peptide vaccine for the PIK3CA R88Q protein mutation having between about 2 and about 40 peptides. In some embodiments, any one of the peptides in the vaccine for the PIK3CA R88Q protein mutation comprises one or more of the SEQ ID NOs: 310 to 322, SEQ ID NO: 468, SEQ ID NOs: 668 to 675, SEQ ID NOs: 16277 to 17342, SEQ ID NOs: 22609 to 22622, SEQ ID NOs: 24473 to 24571, and SEQ ID NOs: 27684 to 27889. In some embodiments, any one of the peptides in the PIK3CA R88Q vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 310 to 322, SEQ ID NO: 468, SEQ ID NOs: 668 to 675, SEQ ID NOs: 16277 to 17342, SEQ ID NOs: 22609 to 22622, SEQ ID NOs: 24473 to 24571, or SEQ ID NOs: 27684 to 27889.

In some embodiments, the amino acid sequence for a MHC class I and/or MHC class II peptides may be used to create a single target (individual) or combined peptide vaccine for the GTF2I L424H protein mutation having between about 2 and about 40 peptides. In some embodiments, any one of the peptides in the vaccine for the GTF2I L424H protein mutation comprises one or more of the SEQ ID NOs: 99 to 118, SEQ ID NOs: 528 to 534, SEQ ID NOs: 5757 to 6498, SEQ ID NOs: 22450 to 22466, SEQ ID NOs: 23264 to 23415, and SEQ ID NOs: 26047 to 26375. In some embodiments, any one of the peptides in the GTF2I L424H vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 99 to 118, SEQ ID NOs: 528 to 534, SEQ ID NOs: 5757 to 6498, SEQ ID NOs: 22450 to 22466, SEQ ID NOs: 23264 to 23415, or SEQ ID NOs: 26047 to 26375.

In some embodiments, the amino acid sequence for a MHC class I and/or MHC class II peptides may be used to create a single target (individual) or combined peptide vaccine for the PTEN R130Q protein mutation having between about 2 and about 40 peptides. In some embodiments, any one of the peptides in the vaccine for the PTEN R130Q protein mutation comprises one or more of the SEQ ID NOs: 338 to 353, SEQ ID NOs: 681 to 690, SEQ ID NOs: 17869 to 18205, SEQ ID NOs: 22630 to 22636, SEQ ID NOs: 24659 to 24724, and SEQ ID NOs: 27980 to 28052. In some embodiments, any one of the peptides in the PTEN R130Q vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 338 to 353, SEQ ID NOs: 681 to 690, SEQ ID NOs: 17869 to 18205, SEQ ID NOs: 22630 to 22636, SEQ ID NOs: 24659 to 24724, or SEQ ID NOs: 27980 to 28052.

In some embodiments, the amino acid sequence for a MHC class I and/or MHC class II peptides may be used to create a single target (individual) or combined peptide vaccine for the AKT1 E17K protein mutation having between about 2 and about 40 peptides. In some embodiments, any one of the peptides in the vaccine for the AKT1 E17K protein mutation comprises one or more of the SEQ ID NOs: 1 to 18, SEQ ID NO: 459, SEQ ID NOs: 475 to 483, SEQ ID NOs: 760 to 1768, SEQ ID NOs: 22386 to 22396, SEQ ID NOs: 22728 to 22838, and SEQ ID NOs: 25305 to 25488. In some embodiments, any one of the peptides in the AKT1 E17K vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 1 to 18, SEQ ID NO: 459, SEQ ID NOs: 475 to 483, SEQ ID NOs: 760 to 1768, SEQ ID NOs: 22386 to 22396, SEQ ID NOs: 22728 to 22838, or SEQ ID NOs: 25305 to 25488.

In some embodiments, the amino acid sequence for a MHC class I and/or MHC class II peptides may be used to create a single target (individual) or combined peptide vaccine for the PTEN R130G protein mutation having between about 2 and about 40 peptides. In some embodiments, any one of the peptides in the vaccine for the PTEN R130G protein mutation comprises one or more of the SEQ ID NOs: 323 to 337, SEQ ID NOs: 676 to 680, SEQ ID NOs: 17343 to 17868, SEQ ID NOs: 22623 to 22629, SEQ ID NOs: 24572 to 24658, and SEQ ID NOs: 27890 to 27979. In some embodiments, any one of the peptides in the PTEN R130G vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 323 to 337, SEQ ID NOs: 676 to 680, SEQ ID NOs: 17343 to 17868, SEQ ID NOs: 22623 to 22629, SEQ ID NOs: 24572 to 24658, or SEQ ID NOs: 27890 to 27979.

In some embodiments, the amino acid sequence for a MHC class I and/or MHC class II peptides may be used to create a single target (individual) or combined peptide vaccine for the TP53 H179R protein mutation having between about 2 and about 40 peptides. In some embodiments, any one of the peptides in the vaccine for the TP53 H179R protein mutation comprises one or more of the SEQ ID NOs: 354 to 358, SEQ ID NOs: 691 to 699, SEQ ID NOs: 18206 to 18413, SEQ ID NOs: 22637 to 22643, SEQ ID NOs: 24725 to 24783, and SEQ ID NOs: 28053 to 28131. In some embodiments, any one of the peptides in the TP53 H179R vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 354 to 358, SEQ ID NOs: 691 to 699, SEQ ID NOs: 18206 to 18413, SEQ ID NOs: 22637 to 22643, SEQ ID NOs: 24725 to 24783, or SEQ ID NOs: 28053 to 28131.

In some embodiments, any combination of MHC class I and/or MHC class II peptides disclosed herein (SEQ ID NOs: 1 to 28795) may be used to create a single target (individual) or combined peptide vaccine having between about 2 and about 40 peptides. In some embodiments, any one of the peptides (peptides 1 to 28795; SEQ ID NOs: 1 to 28795) in the combined vaccine comprises an amino acid sequence 80, 81, 82, 83, 84, 85, 86, 87, 88, 89, 90, 91, 92, 93, 94, 95, 96, 97, 98 or 99% identical to any of SEQ ID NOs: 1 to 28795.

Vaccines for CT Antigens

MHC Class I Peptide Sequences

In some embodiments, a peptide vaccine (single target or combined multiple target vaccine) comprises about 1 to 40 MHC class I peptides with each peptide consisting of 8 or more amino acids. In some embodiments, an MHC class I peptide vaccine is intended for one or more of the CTG1B, KKLC1, MAGA1, MAGA3, MAGA4, MAGC1, MAGC3, MAR1, PMEL, PRAME, SSX2, TYRP1, or TYRP2 protein targets. In some embodiments, an MHC class I peptide vaccine is intended for one or more of the pancreatic cancer, skin cancer, thyroid cancer, brain cancer, colorectal cancer, bronchus and lung cancer, breast cancer, or ovarian cancer indications.

In some embodiments, the amino acid sequence for a MHC class I peptide vaccine for the CTG1B protein comprises one or more of the SEQ ID NOs: 28796 to 28864. In some embodiments, any one of the peptides in the CTG1B vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 28796 to 28864.

In some embodiments, the amino acid sequence for a MHC class I peptide vaccine for the CTG1B protein comprises one or more of the SEQ ID NOs: 28796 to 34168. In some embodiments, any one of the peptides in the CTG1B vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 28796 to 34168.

In some embodiments, the amino acid sequence for a MHC class I peptide vaccine for the CTG1B protein comprises two or more of the SEQ ID NOs: 28796 to 28864. In some embodiments, any one of the peptides in the CTG1B vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 28796 to 28864.

In some embodiments, the amino acid sequence for a MHC class I peptide vaccine for the CTG1B protein comprises two or more of the SEQ ID NOs: 28796 to 34168. In some embodiments, any one of the peptides in the CTG1B vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 28796 to 34168.

In some embodiments, the amino acid sequence for a MHC class I peptide vaccine for the MAGA1 protein comprises one or more of the SEQ ID NOs: 41321 to 41397. In some embodiments, any one of the peptides in the MAGA1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 41321 to 41397.

In some embodiments, the amino acid sequence for a MHC class I peptide vaccine for the MAGA1 protein comprises one or more of the SEQ ID NOs: 41321 to 51433. In some embodiments, any one of the peptides in the MAGA1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 41321 to 51433.

In some embodiments, the amino acid sequence for a MHC class I peptide vaccine for the MAGA1 protein comprises two or more of the SEQ ID NOs: 41321 to 41397. In some embodiments, any one of the peptides in the MAGA1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 41321 to 41397.

In some embodiments, the amino acid sequence for a MHC class I peptide vaccine for the MAGA1 protein comprises two or more of the SEQ ID NOs: 41321 to 51433. In some embodiments, any one of the peptides in the MAGA1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 41321 to 51433.

In some embodiments, the amino acid sequence for a MHC class I peptide vaccine for the MAGA3 protein comprises one or more of the SEQ ID NO: 41383, SEQ ID NO: 41396, SEQ ID NO: 41770, SEQ ID NO: 49004, and SEQ ID NOs: 51434 to 51510. In some embodiments, any one of the peptides in the MAGA3 vaccine comprise an amino acid sequence 80, 81, 82, 83, 84, 85, 86, 87, 88, 89, 90, 91, 92, 93, 94, 95, 96, 97, 98 or 99% identical to SEQ ID NO: 41383, SEQ ID NO: 41396, SEQ ID NO: 41770, SEQ ID NO: 49004, or SEQ ID NOs: 51434 to 51510.

In some embodiments, the amino acid sequence for a MHC class I peptide vaccine for the MAGA3 protein comprises one or more of the SEQ ID NOs: 41351 to 41352, SEQ ID NO: 41383, SEQ ID NO: 41396, SEQ ID NO: 41410, SEQ ID NO: 41414, SEQ ID NO: 41435, SEQ ID NO: 41450, SEQ ID NO: 41463, SEQ ID NO: 41478, SEQ ID NO: 41489, SEQ ID NO: 41495, SEQ ID NO: 41503, SEQ ID NO: 41513, SEQ ID NO: 41520, SEQ ID NO: 41535, SEQ ID NO: 41541, SEQ ID NO: 41545, SEQ ID NO: 41577, SEQ ID NO: 41588, SEQ ID NO: 41598, SEQ ID NO: 41605, SEQ ID NO: 41617, SEQ ID NO: 41620, SEQ ID NO: 41622, SEQ ID NO: 41627, SEQ ID NO: 41630, SEQ ID NO: 41638, SEQ ID NO: 41647, SEQ ID NO: 41673, SEQ ID NO: 41696, SEQ ID NO: 41703, SEQ ID NO: 41708, SEQ ID NO: 41728, SEQ ID NOs: 41732 to 41733, SEQ ID NO: 41749, SEQ ID NO: 41760, SEQ ID NO: 41766, SEQ ID NO: 41770, SEQ ID NO: 41788, SEQ ID NO: 41791, SEQ ID NO: 41809, SEQ ID NO: 41813, SEQ ID NO: 41817, SEQ ID NO: 41829, SEQ ID NOs: 41847 to 41848, SEQ ID NO: 41853, SEQ ID NO: 41859, SEQ ID NO: 41889, SEQ ID NO: 41894, SEQ ID NO: 41897, SEQ ID NO: 41909, SEQ ID NO: 41923, SEQ ID NO: 41934, SEQ ID NO: 41939, SEQ ID NOs: 41953 to 41954, SEQ ID NO: 41959, SEQ ID NO: 41967, SEQ ID NO: 41970, SEQ ID NO: 41976, SEQ ID NOs: 41984 to 41985, SEQ ID NO: 42007, SEQ ID NO: 42017, SEQ ID NO: 42034, SEQ ID NO: 42044, SEQ ID NO: 42046, SEQ ID NO: 42048, SEQ ID NO: 42056, SEQ ID NO: 42067, SEQ ID NO: 42080, SEQ ID NO: 42088, SEQ ID NO: 42091, SEQ ID NOs: 42119 to 42120, SEQ ID NO: 42129, SEQ ID NO: 42135, SEQ ID NOs: 42140 to 42141, SEQ ID NO: 42155, SEQ ID NO: 42158, SEQ ID NO: 42164, SEQ ID NO: 42170, SEQ ID NO: 42174, SEQ ID NO: 42186, SEQ ID NO: 42209, SEQ ID NO: 42218, SEQ ID NO: 42224, SEQ ID NO: 42229, SEQ ID NO: 42232, SEQ ID NO: 42235, SEQ ID NOs: 42237 to 42238, SEQ ID NO: 42265, SEQ ID NO: 42272, SEQ ID NO: 42278, SEQ ID NO: 42293, SEQ ID NO: 42314, SEQ ID NOs: 42336 to 42337, SEQ ID NO: 42339, SEQ ID NOs: 42372 to 42373, SEQ ID NO: 42376, SEQ ID NO: 42382, SEQ ID NO: 42386, SEQ ID NO: 42408, SEQ ID NO: 42414, SEQ ID NO: 42423, SEQ ID NO: 42429, SEQ ID NOs: 42447 to 42448, SEQ ID NO: 42461, SEQ ID NO: 42466, SEQ ID NO: 42475, SEQ ID NO: 42513, SEQ ID NO: 42540, SEQ ID NO: 42545, SEQ ID NO: 42550, SEQ ID NO: 42553, SEQ ID NOs: 42567 to 42568, SEQ ID NO: 42580, SEQ ID NO: 42585, SEQ ID NO: 42605, SEQ ID NO: 42612, SEQ ID NO: 42627, SEQ ID NO: 42675, SEQ ID NO: 42680, SEQ ID NO: 42685, SEQ ID NO: 42690, SEQ ID NO: 42702, SEQ ID NO: 42711, SEQ ID NO: 42719, SEQ ID NO: 42738, SEQ ID NO: 42743, SEQ ID NO: 42750, SEQ ID NO: 42755, SEQ ID NO: 42777, SEQ ID NO: 42788, SEQ ID NO: 42793, SEQ ID NO: 42851, SEQ ID NO: 42858, SEQ ID NO: 42866, SEQ ID NO: 42903, SEQ ID NO: 42927, SEQ ID NOs: 42936 to 42937, SEQ ID NOs: 42940 to 42941, SEQ ID NO: 42957, SEQ ID NO: 42962, SEQ ID NO: 42966, SEQ ID NO: 42968, SEQ ID NO: 42986, SEQ ID NO: 43002, SEQ ID NO: 43013, SEQ ID NO: 43037, SEQ ID NO: 43052, SEQ ID NOs: 43055 to 43056, SEQ ID NOs: 43063 to 43064, SEQ ID NO: 43096, SEQ ID NO: 43133, SEQ ID NO: 43138, SEQ ID NO: 43156, SEQ ID NO: 43161, SEQ ID NO: 43186, SEQ ID NO: 43199, SEQ ID NO: 43205, SEQ ID NO: 43245, SEQ ID NO: 43251, SEQ ID NO: 43275, SEQ ID NO: 43312, SEQ ID NO: 43327, SEQ ID NO: 43333, SEQ ID NO: 43339, SEQ ID NO: 43342, SEQ ID NO: 43348, SEQ ID NO: 43365, SEQ ID NO: 43371, SEQ ID NO: 43400, SEQ ID NO: 43440, SEQ ID NO: 43451, SEQ ID NO: 43462, SEQ ID NO: 43467, SEQ ID NO: 43487, SEQ ID NOs: 43498 to 43499, SEQ ID NO: 43507, SEQ ID NO: 43522, SEQ ID NO: 43529, SEQ ID NO: 43533, SEQ ID NO: 43545, SEQ ID NO: 43558, SEQ ID NO: 43560, SEQ ID NO: 43583, SEQ ID NO: 43597, SEQ ID NO: 43599, SEQ ID NO: 43610, SEQ ID NO: 43614, SEQ ID NO: 43627, SEQ ID NO: 43697, SEQ ID NO: 43715, SEQ ID NO: 43718, SEQ ID NO: 43768, SEQ ID NO: 43777, SEQ ID NOs: 43825 to 43826, SEQ ID NO: 43836, SEQ ID NO: 43840, SEQ ID NO: 43856, SEQ ID NO: 43860, SEQ ID NO: 43870, SEQ ID NO: 43878, SEQ ID NOs: 43881 to 43882, SEQ ID NO: 43905, SEQ ID NO: 43922, SEQ ID NO: 43930, SEQ ID NO: 43943, SEQ ID NO: 43953, SEQ ID NO: 43958, SEQ ID NO: 43979, SEQ ID NO: 43986, SEQ ID NO: 44002, SEQ ID NO: 44033, SEQ ID NO: 44037, SEQ ID NO: 44048, SEQ ID NO: 44050, SEQ ID NO: 44052, SEQ ID NOs: 44080 to 44081, SEQ ID NOs: 44093 to 44094, SEQ ID NOs: 44114 to 44115, SEQ ID NO: 44120, SEQ ID NO: 44142, SEQ ID NO: 44152, SEQ ID NOs: 44164 to 44166, SEQ ID NO: 44181, SEQ ID NO: 44222, SEQ ID NO: 44244, SEQ ID NO: 44246, SEQ ID NO: 44255, SEQ ID NO: 44261, SEQ ID NO: 44276, SEQ ID NOs: 44286 to 44287, SEQ ID NO: 44296, SEQ ID NO: 44315, SEQ ID NO: 44322, SEQ ID NO: 44324, SEQ ID NO: 44328, SEQ ID NO: 44332, SEQ ID NO: 44339, SEQ ID NO: 44401, SEQ ID NO: 44413, SEQ ID NO: 44435, SEQ ID NO: 44452, SEQ ID NO: 44454, SEQ ID NO: 44463, SEQ ID NO: 44467, SEQ ID NO: 44485, SEQ ID NO: 44504, SEQ ID NO: 44512, SEQ ID NO: 44523, SEQ ID NOs: 44526 to 44527, SEQ ID NO: 44536, SEQ ID NO: 44564, SEQ ID NO: 44605, SEQ ID NO: 44607, SEQ ID NO: 44612, SEQ ID NO: 44629, SEQ ID NOs: 44635 to 44636, SEQ ID NO: 44647, SEQ ID NO: 44650, SEQ ID NO: 44674, SEQ ID NO: 44691, SEQ ID NO: 44696, SEQ ID NO: 44702, SEQ ID NO: 44710, SEQ ID NO: 44713, SEQ ID NO: 44715, SEQ ID NO: 44722, SEQ ID NO: 44730, SEQ ID NO: 44733, SEQ ID NO: 44755, SEQ ID NO: 44770, SEQ ID NO: 44773, SEQ ID NO: 44781, SEQ ID NO: 44783, SEQ ID NO: 44797, SEQ ID NO: 44805, SEQ ID NO: 44822, SEQ ID NO: 44828, SEQ ID NO: 44830, SEQ ID NO: 44832, SEQ ID NO: 44850, SEQ ID NO: 44852, SEQ ID NO: 44854, SEQ ID NO: 44860, SEQ ID NO: 44866, SEQ ID NO: 44898, SEQ ID NO: 44900, SEQ ID NO: 44907, SEQ ID NO: 44933, SEQ ID NO: 44947, SEQ ID NO: 44986, SEQ ID NO: 45003, SEQ ID NO: 45007, SEQ ID NO: 45009, SEQ ID NO: 45012, SEQ ID NO: 45016, SEQ ID NO: 45018, SEQ ID NO: 45027, SEQ ID NO: 45031, SEQ ID NO: 45036, SEQ ID NO: 45044, SEQ ID NO: 45060, SEQ ID NO: 45071, SEQ ID NO: 45077, SEQ ID NO: 45095, SEQ ID NO: 45126, SEQ ID NO: 45132, SEQ ID NO: 45135, SEQ ID NO: 45139, SEQ ID NO: 45143, SEQ ID NO: 45159, SEQ ID NO: 45177, SEQ ID NO: 45197, SEQ ID NO: 45200, SEQ ID NO: 45219, SEQ ID NO: 45228, SEQ ID NO: 45323, SEQ ID NO: 45329, SEQ ID NO: 45351, SEQ ID NO: 45378, SEQ ID NO: 45380, SEQ ID NO: 45389, SEQ ID NO: 45413, SEQ ID NO: 45417, SEQ ID NO: 45438, SEQ ID NO: 45455, SEQ ID NO: 45457, SEQ ID NO: 45467, SEQ ID NO: 45478, SEQ ID NO: 45530, SEQ ID NO: 45562, SEQ ID NO: 45565, SEQ ID NOs: 45583 to 45584, SEQ ID NOs: 45595 to 45596, SEQ ID NO: 45608, SEQ ID NO: 45612, SEQ ID NO: 45616, SEQ ID NO: 45627, SEQ ID NO: 45653, SEQ ID NOs: 45666 to 45667, SEQ ID NO: 45680, SEQ ID NO: 45697, SEQ ID NO: 45705, SEQ ID NO: 45710, SEQ ID NO: 45722, SEQ ID NO: 45736, SEQ ID NO: 45742, SEQ ID NO: 45746, SEQ ID NO: 45765, SEQ ID NO: 45808, SEQ ID NO: 45830, SEQ ID NOs: 45840 to 45841, SEQ ID NO: 45896, SEQ ID NOs: 45904 to 45905, SEQ ID NO: 45913, SEQ ID NO: 45915, SEQ ID NOs: 45940 to 45943, SEQ ID NO: 45945, SEQ ID NOs: 45958 to 45959, SEQ ID NO: 45977, SEQ ID NO: 45983, SEQ ID NO: 45992, SEQ ID NO: 46006, SEQ ID NO: 46012, SEQ ID NO: 46018, SEQ ID NO: 46021, SEQ ID NOs: 46037 to 46038, SEQ ID NO: 46044, SEQ ID NO: 46058, SEQ ID NO: 46071, SEQ ID NO: 46082, SEQ ID NO: 46094, SEQ ID NO: 46096, SEQ ID NO: 46102, SEQ ID NOs: 46108 to 46109, SEQ ID NO: 46122, SEQ ID NO: 46125, SEQ ID NOs: 46133 to 46134, SEQ ID NO: 46146, SEQ ID NO: 46159, SEQ ID NO: 46177, SEQ ID NO: 46182, SEQ ID NO: 46188, SEQ ID NO: 46202, SEQ ID NO: 46219, SEQ ID NO: 46246, SEQ ID NO: 46249, SEQ ID NO: 46270, SEQ ID NO: 46279, SEQ ID NO: 46312, SEQ ID NO: 46339, SEQ ID NO: 46378, SEQ ID NO: 46433, SEQ ID NO: 46442, SEQ ID NO: 46446, SEQ ID NO: 46452, SEQ ID NO: 46454, SEQ ID NO: 46457, SEQ ID NO: 46478, SEQ ID NO: 46484, SEQ ID NO: 46486, SEQ ID NO: 46491, SEQ ID NO: 46506, SEQ ID NO: 46512, SEQ ID NO: 46517, SEQ ID NO: 46530, SEQ ID NO: 46534, SEQ ID NO: 46556, SEQ ID NO: 46560, SEQ ID NO: 46564, SEQ ID NO: 46596, SEQ ID NO: 46602, SEQ ID NO: 46616, SEQ ID NO: 46635, SEQ ID NO: 46656, SEQ ID NO: 46658, SEQ ID NO: 46666, SEQ ID NO: 46676, SEQ ID NO: 46679, SEQ ID NO: 46689, SEQ ID NO: 46705, SEQ ID NO: 46724, SEQ ID NO: 46738, SEQ ID NO: 46767, SEQ ID NO: 46770, SEQ ID NO: 46794, SEQ ID NO: 46810, SEQ ID NO: 46819, SEQ ID NO: 46824, SEQ ID NO: 46831, SEQ ID NO: 46849, SEQ ID NO: 46854, SEQ ID NO: 46870, SEQ ID NO: 46880, SEQ ID NO: 46916, SEQ ID NO: 46935, SEQ ID NO: 46939, SEQ ID NO: 46944, SEQ ID NO: 46958, SEQ ID NO: 46964, SEQ ID NO: 46967, SEQ ID NO: 46978, SEQ ID NO: 46987, SEQ ID NO: 46989, SEQ ID NO: 46991, SEQ ID NO: 46993, SEQ ID NO: 47007, SEQ ID NO: 47034, SEQ ID NO: 47037, SEQ ID NO: 47047, SEQ ID NO: 47057, SEQ ID NO: 47066, SEQ ID NO: 47096, SEQ ID NO: 47098, SEQ ID NO: 47119, SEQ ID NO: 47123, SEQ ID NO: 47137, SEQ ID NO: 47139, SEQ ID NO: 47143, SEQ ID NO: 47150, SEQ ID NO: 47158, SEQ ID NO: 47161, SEQ ID NO: 47170, SEQ ID NO: 47181, SEQ ID NO: 47197, SEQ ID NO: 47209, SEQ ID NO: 47254, SEQ ID NO: 47266, SEQ ID NO: 47272, SEQ ID NO: 47291, SEQ ID NO: 47298, SEQ ID NO: 47300, SEQ ID NO: 47319, SEQ ID NO: 47324, SEQ ID NOs: 47331 to 47332, SEQ ID NO: 47358, SEQ ID NO: 47361, SEQ ID NO: 47393, SEQ ID NO: 47414, SEQ ID NO: 47416, SEQ ID NO: 47422, SEQ ID NO: 47425, SEQ ID NOs: 47432 to 47433, SEQ ID NO: 47445, SEQ ID NO: 47453, SEQ ID NOs: 47460 to 47461, SEQ ID NO: 47477, SEQ ID NO: 47492, SEQ ID NO: 47507, SEQ ID NO: 47509, SEQ ID NO: 47516, SEQ ID NO: 47535, SEQ ID NOs: 47556 to 47557, SEQ ID NOs: 47578 to 47579, SEQ ID NOs: 47591 to 47592, SEQ ID NO: 47597, SEQ ID NO: 47600, SEQ ID NO: 47614, SEQ ID NO: 47626, SEQ ID NO: 47629, SEQ ID NO: 47637, SEQ ID NO: 47639, SEQ ID NO: 47649, SEQ ID NOs: 47689 to 47690, SEQ ID NO: 47713, SEQ ID NO: 47766, SEQ ID NOs: 47814 to 47815, SEQ ID NO: 47827, SEQ ID NO: 47834, SEQ ID NOs: 47852 to 47853, SEQ ID NO: 47855, SEQ ID NO: 47871, SEQ ID NOs: 47875 to 47876, SEQ ID NO: 47891, SEQ ID NO: 47896, SEQ ID NO: 47902, SEQ ID NO: 47923, SEQ ID NO: 47925, SEQ ID NO: 47927, SEQ ID NO: 47929, SEQ ID NO: 47932, SEQ ID NOs: 47962 to 47964, SEQ ID NO: 47972, SEQ ID NO: 47999, SEQ ID NO: 48008, SEQ ID NO: 48028, SEQ ID NOs: 48034 to 48035, SEQ ID NO: 48038, SEQ ID NO: 48056, SEQ ID NO: 48061, SEQ ID NO: 48066, SEQ ID NO: 48118, SEQ ID NO: 48120, SEQ ID NO: 48129, SEQ ID NO: 48140, SEQ ID NO: 48148, SEQ ID NO: 48153, SEQ ID NOs: 48159 to 48160, SEQ ID NO: 48163, SEQ ID NO: 48167, SEQ ID NO: 48178, SEQ ID NO: 48180, SEQ ID NO: 48186, SEQ ID NO: 48218, SEQ ID NO: 48220, SEQ ID NO: 48263, SEQ ID NO: 48286, SEQ ID NO: 48300, SEQ ID NO: 48307, SEQ ID NO: 48315, SEQ ID NO: 48321, SEQ ID NO: 48338, SEQ ID NO: 48341, SEQ ID NO: 48343, SEQ ID NO: 48358, SEQ ID NO: 48362, SEQ ID NO: 48366, SEQ ID NO: 48368, SEQ ID NO: 48418, SEQ ID NO: 48431, SEQ ID NO: 48436, SEQ ID NOs: 48438 to 48439, SEQ ID NOs: 48443 to 48444, SEQ ID NO: 48450, SEQ ID NOs: 48452 to 48453, SEQ ID NO: 48458, SEQ ID NOs: 48461 to 48462, SEQ ID NO: 48507, SEQ ID NO: 48516, SEQ ID NO: 48527, SEQ ID NO: 48537, SEQ ID NO: 48548, SEQ ID NO: 48567, SEQ ID NO: 48574, SEQ ID NO: 48576, SEQ ID NO: 48578, SEQ ID NO: 48594, SEQ ID NO: 48599, SEQ ID NO: 48612, SEQ ID NO: 48614, SEQ ID NO: 48623, SEQ ID NO: 48626, SEQ ID NO: 48630, SEQ ID NO: 48642, SEQ ID NO: 48648, SEQ ID NO: 48656, SEQ ID NOs: 48704 to 48705, SEQ ID NO: 48708, SEQ ID NO: 48739, SEQ ID NO: 48749, SEQ ID NO: 48752, SEQ ID NO: 48754, SEQ ID NO: 48756, SEQ ID NO: 48802, SEQ ID NO: 48832, SEQ ID NO: 48845, SEQ ID NO: 48850, SEQ ID NO: 48852, SEQ ID NO: 48856, SEQ ID NO: 48870, SEQ ID NO: 48888, SEQ ID NO: 48902, SEQ ID NO: 48904, SEQ ID NOs: 48912 to 48913, SEQ ID NO: 48921, SEQ ID NO: 48970, SEQ ID NO: 48974, SEQ ID NO: 48993, SEQ ID NO: 48997, SEQ ID NO: 49004, SEQ ID NO: 49019, SEQ ID NO: 49025, SEQ ID NOs: 49045 to 49046, SEQ ID NO: 49052, SEQ ID NO: 49083, SEQ ID NO: 49086, SEQ ID NOs: 49091 to 49092, SEQ ID NO: 49102, SEQ ID NO: 49106, SEQ ID NO: 49111, SEQ ID NO: 49127, SEQ ID NO: 49152, SEQ ID NO: 49159, SEQ ID NO: 49173, SEQ ID NO: 49197, SEQ ID NO: 49201, SEQ ID NO: 49203, SEQ ID NO: 49207, SEQ ID NO: 49220, SEQ ID NO: 49227, SEQ ID NO: 49230, SEQ ID NO: 49234, SEQ ID NO: 49242, SEQ ID NO: 49256, SEQ ID NO: 49263, SEQ ID NOs: 49273 to 49274, SEQ ID NO: 49278, SEQ ID NO: 49280, SEQ ID NO: 49288, SEQ ID NO: 49290, SEQ ID NOs: 49294 to 49295, SEQ ID NO: 49326, SEQ ID NO: 49362, SEQ ID NOs: 49384 to 49385, SEQ ID NO: 49387, SEQ ID NO: 49393, SEQ ID NO: 49395, SEQ ID NOs: 49427 to 49428, SEQ ID NO: 49444, SEQ ID NO: 49458, SEQ ID NO: 49483, SEQ ID NO: 49487, SEQ ID NO: 49497, SEQ ID NO: 49501, SEQ ID NO: 49517, SEQ ID NO: 49525, SEQ ID NO: 49535, SEQ ID NO: 49537, SEQ ID NO: 49544, SEQ ID NO: 49557, SEQ ID NO: 49569, SEQ ID NO: 49572, SEQ ID NO: 49587, SEQ ID NO: 49594, SEQ ID NO: 49596, SEQ ID NO: 49598, SEQ ID NO: 49606, SEQ ID NO: 49617, SEQ ID NO: 49629, SEQ ID NO: 49646, SEQ ID NO: 49658, SEQ ID NO: 49693, SEQ ID NOs: 49702 to 49703, SEQ ID NO: 49710, SEQ ID NO: 49712, SEQ ID NO: 49719, SEQ ID NO: 49727, SEQ ID NO: 49737, SEQ ID NO: 49740, SEQ ID NO: 49743, SEQ ID NO: 49767, SEQ ID NO: 49778, SEQ ID NO: 49788, SEQ ID NO: 49811, SEQ ID NO: 49848, SEQ ID NO: 49860, SEQ ID NO: 49888, SEQ ID NO: 49908, SEQ ID NO: 49973, SEQ ID NO: 49977, SEQ ID NO: 49980, SEQ ID NOs: 49996 to 49997, SEQ ID NO: 50000, SEQ ID NO: 50012, SEQ ID NOs: 50017 to 50018, SEQ ID NO: 50051, SEQ ID NO: 50056, SEQ ID NO: 50062, SEQ ID NO: 50090, SEQ ID NO: 50093, SEQ ID NO: 50107, SEQ ID NO: 50129, SEQ ID NO: 50132, SEQ ID NO: 50138, SEQ ID NO: 50144, SEQ ID NO: 50167, SEQ ID NO: 50191, SEQ ID NO: 50194, SEQ ID NO: 50196, SEQ ID NO: 50228, SEQ ID NO: 50239, SEQ ID NO: 50263, SEQ ID NO: 50271, SEQ ID NO: 50297, SEQ ID NO: 50305, SEQ ID NO: 50320, SEQ ID NO: 50322, SEQ ID NO: 50326, SEQ ID NO: 50334, SEQ ID NO: 50349, SEQ ID NO: 50375, SEQ ID NO: 50394, SEQ ID NO: 50401, SEQ ID NO: 50414, SEQ ID NO: 50421, SEQ ID NO: 50423, SEQ ID NO: 50435, SEQ ID NOs: 50440 to 50441, SEQ ID NO: 50443, SEQ ID NO: 50510, SEQ ID NO: 50556, SEQ ID NO: 50564, SEQ ID NO: 50591, SEQ ID NO: 50605, SEQ ID NO: 50607, SEQ ID NO: 50611, SEQ ID NO: 50622, SEQ ID NO: 50625, SEQ ID NO: 50627, SEQ ID NO: 50632, SEQ ID NO: 50644, SEQ ID NOs: 50652 to 50653, SEQ ID NOs: 50668 to 50669, SEQ ID NO: 50677, SEQ ID NO: 50696, SEQ ID NO: 50699, SEQ ID NO: 50705, SEQ ID NO: 50709, SEQ ID NO: 50711, SEQ ID NO: 50729, SEQ ID NO: 50731, SEQ ID NO: 50741, SEQ ID NO: 50743, SEQ ID NO: 50748, SEQ ID NO: 50762, SEQ ID NO: 50765, SEQ ID NO: 50767, SEQ ID NO: 50800, SEQ ID NO: 50803, SEQ ID NO: 50807, SEQ ID NO: 50841, SEQ ID NO: 50865, SEQ ID NO: 50872, SEQ ID NO: 50905, SEQ ID NOs: 50955 to 50956, SEQ ID NOs: 50975 to 50977, SEQ ID NO: 50986, SEQ ID NO: 51021, SEQ ID NOs: 51039 to 51040, SEQ ID NOs: 51066 to 51068, SEQ ID NO: 51084, SEQ ID NOs: 51099 to 51100, SEQ ID NOs: 51165 to 51167, SEQ ID NO: 51169, SEQ ID NO: 51190, SEQ ID NOs: 51194 to 51198, SEQ ID NOs: 51267 to 51270, SEQ ID NOs: 51281 to 51282, SEQ ID NO: 51324, SEQ ID NO: 51349, SEQ ID NO: 51379, SEQ ID NOs: 51413 to 51415, SEQ ID NOs: 51420 to 51421, and SEQ ID NOs: 51434 to 60455. In some embodiments, any one of the peptides in the MAGA3 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 41351 to 41352, SEQ ID NO: 41383, SEQ ID NO: 41396, SEQ ID NO: 41410, SEQ ID NO: 41414, SEQ ID NO: 41435, SEQ ID NO: 41450, SEQ ID NO: 41463, SEQ ID NO: 41478, SEQ ID NO: 41489, SEQ ID NO: 41495, SEQ ID NO: 41503, SEQ ID NO: 41513, SEQ ID NO: 41520, SEQ ID NO: 41535, SEQ ID NO: 41541, SEQ ID NO: 41545, SEQ ID NO: 41577, SEQ ID NO: 41588, SEQ ID NO: 41598, SEQ ID NO: 41605, SEQ ID NO: 41617, SEQ ID NO: 41620, SEQ ID NO: 41622, SEQ ID NO: 41627, SEQ ID NO: 41630, SEQ ID NO: 41638, SEQ ID NO: 41647, SEQ ID NO: 41673, SEQ ID NO: 41696, SEQ ID NO: 41703, SEQ ID NO: 41708, SEQ ID NO: 41728, SEQ ID NOs: 41732 to 41733, SEQ ID NO: 41749, SEQ ID NO: 41760, SEQ ID NO: 41766, SEQ ID NO: 41770, SEQ ID NO: 41788, SEQ ID NO: 41791, SEQ ID NO: 41809, SEQ ID NO: 41813, SEQ ID NO: 41817, SEQ ID NO: 41829, SEQ ID NOs: 41847 to 41848, SEQ ID NO: 41853, SEQ ID NO: 41859, SEQ ID NO: 41889, SEQ ID NO: 41894, SEQ ID NO: 41897, SEQ ID NO: 41909, SEQ ID NO: 41923, SEQ ID NO: 41934, SEQ ID NO: 41939, SEQ ID NOs: 41953 to 41954, SEQ ID NO: 41959, SEQ ID NO: 41967, SEQ ID NO: 41970, SEQ ID NO: 41976, SEQ ID NOs: 41984 to 41985, SEQ ID NO: 42007, SEQ ID NO: 42017, SEQ ID NO: 42034, SEQ ID NO: 42044, SEQ ID NO: 42046, SEQ ID NO: 42048, SEQ ID NO: 42056, SEQ ID NO: 42067, SEQ ID NO: 42080, SEQ ID NO: 42088, SEQ ID NO: 42091, SEQ ID NOs: 42119 to 42120, SEQ ID NO: 42129, SEQ ID NO: 42135, SEQ ID NOs: 42140 to 42141, SEQ ID NO: 42155, SEQ ID NO: 42158, SEQ ID NO: 42164, SEQ ID NO: 42170, SEQ ID NO: 42174, SEQ ID NO: 42186, SEQ ID NO: 42209, SEQ ID NO: 42218, SEQ ID NO: 42224, SEQ ID NO:

42229, SEQ ID NO: 42232, SEQ ID NO: 42235, SEQ ID NOs: 42237 to 42238, SEQ ID NO: 42265, SEQ ID NO: 42272, SEQ ID NO: 42278, SEQ ID NO: 42293, SEQ ID NO: 42314, SEQ ID NOs: 42336 to 42337, SEQ ID NO: 42339, SEQ ID NOs: 42372 to 42373, SEQ ID NO: 42376, SEQ ID NO: 42382, SEQ ID NO: 42386, SEQ ID NO: 42408, SEQ ID NO: 42414, SEQ ID NO: 42423, SEQ ID NO: 42429, SEQ ID NOs: 42447 to 42448, SEQ ID NO: 42461, SEQ ID NO: 42466, SEQ ID NO: 42475, SEQ ID NO: 42513, SEQ ID NO: 42540, SEQ ID NO: 42545, SEQ ID NO: 42550, SEQ ID NO: 42553, SEQ ID NOs: 42567 to 42568, SEQ ID NO: 42580, SEQ ID NO: 42585, SEQ ID NO: 42605, SEQ ID NO: 42612, SEQ ID NO: 42627, SEQ ID NO: 42675, SEQ ID NO: 42680, SEQ ID NO: 42685, SEQ ID NO: 42690, SEQ ID NO: 42702, SEQ ID NO: 42711, SEQ ID NO: 42719, SEQ ID NO: 42738, SEQ ID NO: 42743, SEQ ID NO: 42750, SEQ ID NO: 42755, SEQ ID NO: 42777, SEQ ID NO: 42788, SEQ ID NO: 42793, SEQ ID NO: 42851, SEQ ID NO: 42858, SEQ ID NO: 42866, SEQ ID NO: 42903, SEQ ID NO: 42927, SEQ ID NOs: 42936 to 42937, SEQ ID NOs: 42940 to 42941, SEQ ID NO: 42957, SEQ ID NO: 42962, SEQ ID NO: 42966, SEQ ID NO: 42968, SEQ ID NO: 42986, SEQ ID NO: 43002, SEQ ID NO: 43013, SEQ ID NO: 43037, SEQ ID NO: 43052, SEQ ID NOs: 43055 to 43056, SEQ ID NOs: 43063 to 43064, SEQ ID NO: 43096, SEQ ID NO: 43133, SEQ ID NO: 43138, SEQ ID NO: 43156, SEQ ID NO: 43161, SEQ ID NO: 43186, SEQ ID NO: 43199, SEQ ID NO: 43205, SEQ ID NO: 43245, SEQ ID NO: 43251, SEQ ID NO: 43275, SEQ ID NO: 43312, SEQ ID NO: 43327, SEQ ID NO: 43333, SEQ ID NO: 43339, SEQ ID NO: 43342, SEQ ID NO: 43348, SEQ ID NO: 43365, SEQ ID NO: 43371, SEQ ID NO: 43400, SEQ ID NO: 43440, SEQ ID NO: 43451, SEQ ID NO: 43462, SEQ ID NO: 43467, SEQ ID NO: 43487, SEQ ID NOs: 43498 to 43499, SEQ ID NO: 43507, SEQ ID NO: 43522, SEQ ID NO: 43529, SEQ ID NO: 43533, SEQ ID NO: 43545, SEQ ID NO: 43558, SEQ ID NO: 43560, SEQ ID NO: 43583, SEQ ID NO: 43597, SEQ ID NO: 43599, SEQ ID NO: 43610, SEQ ID NO: 43614, SEQ ID NO: 43627, SEQ ID NO: 43697, SEQ ID NO: 43715, SEQ ID NO: 43718, SEQ ID NO: 43768, SEQ ID NO: 43777, SEQ ID NOs: 43825 to 43826, SEQ ID NO: 43836, SEQ ID NO: 43840, SEQ ID NO: 43856, SEQ ID NO: 43860, SEQ ID NO: 43870, SEQ ID NO: 43878, SEQ ID NOs: 43881 to 43882, SEQ ID NO: 43905, SEQ ID NO: 43922, SEQ ID NO: 43930, SEQ ID NO: 43943, SEQ ID NO: 43953, SEQ ID NO: 43958, SEQ ID NO: 43979, SEQ ID NO: 43986, SEQ ID NO: 44002, SEQ ID NO: 44033, SEQ ID NO: 44037, SEQ ID NO: 44048, SEQ ID NO: 44050, SEQ ID NO: 44052, SEQ ID NOs: 44080 to 44081, SEQ ID NOs: 44093 to 44094, SEQ ID NOs: 44114 to 44115, SEQ ID NO: 44120, SEQ ID NO: 44142, SEQ ID NO: 44152, SEQ ID NOs: 44164 to 44166, SEQ ID NO: 44181, SEQ ID NO: 44222, SEQ ID NO: 44244, SEQ ID NO: 44246, SEQ ID NO: 44255, SEQ ID NO: 44261, SEQ ID NO: 44276, SEQ ID NOs: 44286 to 44287, SEQ ID NO: 44296, SEQ ID NO: 44315, SEQ ID NO: 44322, SEQ ID NO: 44324, SEQ ID NO: 44328, SEQ ID NO: 44332, SEQ ID NO: 44339, SEQ ID NO: 44401, SEQ ID NO: 44413, SEQ ID NO: 44435, SEQ ID NO: 44452, SEQ ID NO: 44454, SEQ ID NO: 44463, SEQ ID NO: 44467, SEQ ID NO: 44485, SEQ ID NO: 44504, SEQ ID NO: 44512, SEQ ID NO: 44523, SEQ ID NOs: 44526 to 44527, SEQ ID NO: 44536, SEQ ID NO: 44564, SEQ ID NO: 44605, SEQ ID NO: 44607, SEQ ID NO: 44612, SEQ ID NO: 44629, SEQ ID NOs: 44635 to 44636, SEQ ID NO: 44647, SEQ ID NO: 44650, SEQ ID NO: 44674, SEQ ID NO: 44691, SEQ ID NO: 44696, SEQ ID NO: 44702, SEQ ID NO: 44710, SEQ ID NO: 44713, SEQ ID NO: 44715, SEQ ID NO: 44722, SEQ ID NO: 44730, SEQ ID NO: 44733, SEQ ID NO: 44755, SEQ ID NO: 44770, SEQ ID NO: 44773, SEQ ID NO: 44781, SEQ ID NO: 44783, SEQ ID NO: 44797, SEQ ID NO: 44805, SEQ ID NO: 44822, SEQ ID NO: 44828, SEQ ID NO: 44830, SEQ ID NO: 44832, SEQ ID NO: 44850, SEQ ID NO: 44852, SEQ ID NO: 44854, SEQ ID NO: 44860, SEQ ID NO: 44866, SEQ ID NO: 44898, SEQ ID NO: 44900, SEQ ID NO: 44907, SEQ ID NO: 44933, SEQ ID NO: 44947, SEQ ID NO: 44986, SEQ ID NO: 45003, SEQ ID NO: 45007, SEQ ID NO: 45009, SEQ ID NO: 45012, SEQ ID NO: 45016, SEQ ID NO: 45018, SEQ ID NO: 45027, SEQ ID NO: 45031, SEQ ID NO: 45036, SEQ ID NO: 45044, SEQ ID NO: 45060, SEQ ID NO: 45071, SEQ ID NO: 45077, SEQ ID NO: 45095, SEQ ID NO: 45126, SEQ ID NO: 45132, SEQ ID NO: 45135, SEQ ID NO: 45139, SEQ ID NO: 45143, SEQ ID NO: 45159, SEQ ID NO: 45177, SEQ ID NO: 45197, SEQ ID NO: 45200, SEQ ID NO: 45219, SEQ ID NO: 45228, SEQ ID NO: 45323, SEQ ID NO: 45329, SEQ ID NO: 45351, SEQ ID NO: 45378, SEQ ID NO: 45380, SEQ ID NO: 45389, SEQ ID NO: 45413, SEQ ID NO: 45417, SEQ ID NO: 45438, SEQ ID NO: 45455, SEQ ID NO: 45457, SEQ ID NO: 45467, SEQ ID NO: 45478, SEQ ID NO: 45530, SEQ ID NO: 45562, SEQ ID NO: 45565, SEQ ID NOs: 45583 to 45584, SEQ ID NOs: 45595 to 45596, SEQ ID NO: 45608, SEQ ID NO: 45612, SEQ ID NO: 45616, SEQ ID NO: 45627, SEQ ID NO: 45653, SEQ ID NOs: 45666 to 45667, SEQ ID NO: 45680, SEQ ID NO: 45697, SEQ ID NO: 45705, SEQ ID NO: 45710, SEQ ID NO: 45722, SEQ ID NO: 45736, SEQ ID NO: 45742, SEQ ID NO: 45746, SEQ ID NO: 45765, SEQ ID NO: 45808, SEQ ID NO: 45830, SEQ ID NOs: 45840 to 45841, SEQ ID NO: 45896, SEQ ID NOs: 45904 to 45905, SEQ ID NO: 45913, SEQ ID NO: 45915, SEQ ID NOs: 45940 to 45943, SEQ ID NO: 45945, SEQ ID NOs: 45958 to 45959, SEQ ID NO: 45977, SEQ ID NO: 45983, SEQ ID NO: 45992, SEQ ID NO: 46006, SEQ ID NO: 46012, SEQ ID NO: 46018, SEQ ID NO: 46021, SEQ ID NOs: 46037 to 46038, SEQ ID NO: 46044, SEQ ID NO: 46058, SEQ ID NO: 46071, SEQ ID NO: 46082, SEQ ID NO: 46094, SEQ ID NO: 46096, SEQ ID NO: 46102, SEQ ID NOs: 46108 to 46109, SEQ ID NO: 46122, SEQ ID NO: 46125, SEQ ID NOs: 46133 to 46134, SEQ ID NO: 46146, SEQ ID NO: 46159, SEQ ID NO: 46177, SEQ ID NO: 46182, SEQ ID NO: 46188, SEQ ID NO: 46202, SEQ ID NO: 46219, SEQ ID NO: 46246, SEQ ID NO: 46249, SEQ ID NO: 46270, SEQ ID NO: 46279, SEQ ID NO: 46312, SEQ ID NO: 46339, SEQ ID NO: 46378, SEQ ID NO: 46433, SEQ ID NO: 46442, SEQ ID NO: 46446, SEQ ID NO: 46452, SEQ ID NO: 46454, SEQ ID NO: 46457, SEQ ID NO: 46478, SEQ ID NO: 46484, SEQ ID NO: 46486, SEQ ID NO: 46491, SEQ ID NO: 46506, SEQ ID NO: 46512, SEQ ID NO: 46517, SEQ ID NO: 46530, SEQ ID NO: 46534, SEQ ID NO: 46556, SEQ ID NO: 46560, SEQ ID NO: 46564, SEQ ID NO: 46596, SEQ ID NO: 46602, SEQ ID NO: 46616, SEQ ID NO: 46635, SEQ ID NO: 46656, SEQ ID NO: 46658, SEQ ID NO: 46666, SEQ ID NO: 46676, SEQ ID NO: 46679, SEQ ID NO: 46689, SEQ ID NO: 46705, SEQ ID NO: 46724, SEQ ID NO: 46738, SEQ ID NO: 46767, SEQ ID NO: 46770, SEQ ID NO: 46794, SEQ ID NO: 46810, SEQ ID NO: 46819, SEQ ID NO: 46824, SEQ ID NO: 46831, SEQ ID NO: 46849, SEQ ID NO: 46854, SEQ ID NO: 46870, SEQ ID NO: 46880, SEQ ID NO: 46916, SEQ ID NO: 46935, SEQ ID NO: 46939, SEQ ID NO: 46944, SEQ ID NO: 46958, SEQ ID NO: 46964, SEQ ID NO: 46967, SEQ ID NO: 46978,

SEQ ID NO: 46987, SEQ ID NO: 46989, SEQ ID NO: 46991, SEQ ID NO: 46993, SEQ ID NO: 47007, SEQ ID NO: 47034, SEQ ID NO: 47037, SEQ ID NO: 47047, SEQ ID NO: 47057, SEQ ID NO: 47066, SEQ ID NO: 47096, SEQ ID NO: 47098, SEQ ID NO: 47119, SEQ ID NO: 47123, SEQ ID NO: 47137, SEQ ID NO: 47139, SEQ ID NO: 47143, SEQ ID NO: 47150, SEQ ID NO: 47158, SEQ ID NO: 47161, SEQ ID NO: 47170, SEQ ID NO: 47181, SEQ ID NO: 47197, SEQ ID NO: 47209, SEQ ID NO: 47254, SEQ ID NO: 47266, SEQ ID NO: 47272, SEQ ID NO: 47291, SEQ ID NO: 47298, SEQ ID NO: 47300, SEQ ID NO: 47319, SEQ ID NO: 47324, SEQ ID NOs: 47331 to 47332, SEQ ID NO: 47358, SEQ ID NO: 47361, SEQ ID NO: 47393, SEQ ID NO: 47414, SEQ ID NO: 47416, SEQ ID NO: 47422, SEQ ID NO: 47425, SEQ ID NOs: 47432 to 47433, SEQ ID NO: 47445, SEQ ID NO: 47453, SEQ ID NOs: 47460 to 47461, SEQ ID NO: 47477, SEQ ID NO: 47492, SEQ ID NO: 47507, SEQ ID NO: 47509, SEQ ID NO: 47516, SEQ ID NO: 47535, SEQ ID NOs: 47556 to 47557, SEQ ID NOs: 47578 to 47579, SEQ ID NOs: 47591 to 47592, SEQ ID NO: 47597, SEQ ID NO: 47600, SEQ ID NO: 47614, SEQ ID NO: 47626, SEQ ID NO: 47629, SEQ ID NO: 47637, SEQ ID NO: 47639, SEQ ID NO: 47649, SEQ ID NOs: 47689 to 47690, SEQ ID NO: 47713, SEQ ID NO: 47766, SEQ ID NOs: 47814 to 47815, SEQ ID NO: 47827, SEQ ID NO: 47834, SEQ ID NOs: 47852 to 47853, SEQ ID NO: 47855, SEQ ID NO: 47871, SEQ ID NOs: 47875 to 47876, SEQ ID NO: 47891, SEQ ID NO: 47896, SEQ ID NO: 47902, SEQ ID NO: 47923, SEQ ID NO: 47925, SEQ ID NO: 47927, SEQ ID NO: 47929, SEQ ID NO: 47932, SEQ ID NOs: 47962 to 47964, SEQ ID NO: 47972, SEQ ID NO: 47999, SEQ ID NO: 48008, SEQ ID NO: 48028, SEQ ID NOs: 48034 to 48035, SEQ ID NO: 48038, SEQ ID NO: 48056, SEQ ID NO: 48061, SEQ ID NO: 48066, SEQ ID NO: 48118, SEQ ID NO: 48120, SEQ ID NO: 48129, SEQ ID NO: 48140, SEQ ID NO: 48148, SEQ ID NO: 48153, SEQ ID NOs: 48159 to 48160, SEQ ID NO: 48163, SEQ ID NO: 48167, SEQ ID NO: 48178, SEQ ID NO: 48180, SEQ ID NO: 48186, SEQ ID NO: 48218, SEQ ID NO: 48220, SEQ ID NO: 48263, SEQ ID NO: 48286, SEQ ID NO: 48300, SEQ ID NO: 48307, SEQ ID NO: 48315, SEQ ID NO: 48321, SEQ ID NO: 48338, SEQ ID NO: 48341, SEQ ID NO: 48343, SEQ ID NO: 48358, SEQ ID NO: 48362, SEQ ID NO: 48366, SEQ ID NO: 48368, SEQ ID NO: 48418, SEQ ID NO: 48431, SEQ ID NO: 48436, SEQ ID NOs: 48438 to 48439, SEQ ID NOs: 48443 to 48444, SEQ ID NO: 48450, SEQ ID NOs: 48452 to 48453, SEQ ID NO: 48458, SEQ ID NOs: 48461 to 48462, SEQ ID NO: 48507, SEQ ID NO: 48516, SEQ ID NO: 48527, SEQ ID NO: 48537, SEQ ID NO: 48548, SEQ ID NO: 48567, SEQ ID NO: 48574, SEQ ID NO: 48576, SEQ ID NO: 48578, SEQ ID NO: 48594, SEQ ID NO: 48599, SEQ ID NO: 48612, SEQ ID NO: 48614, SEQ ID NO: 48623, SEQ ID NO: 48626, SEQ ID NO: 48630, SEQ ID NO: 48642, SEQ ID NO: 48648, SEQ ID NO: 48656, SEQ ID NOs: 48704 to 48705, SEQ ID NO: 48708, SEQ ID NO: 48739, SEQ ID NO: 48749, SEQ ID NO: 48752, SEQ ID NO: 48754, SEQ ID NO: 48756, SEQ ID NO: 48802, SEQ ID NO: 48832, SEQ ID NO: 48845, SEQ ID NO: 48850, SEQ ID NO: 48852, SEQ ID NO: 48856, SEQ ID NO: 48870, SEQ ID NO: 48888, SEQ ID NO: 48902, SEQ ID NO: 48904, SEQ ID NOs: 48912 to 48913, SEQ ID NO: 48921, SEQ ID NO: 48970, SEQ ID NO: 48974, SEQ ID NO: 48993, SEQ ID NO: 48997, SEQ ID NO: 49004, SEQ ID NO: 49019, SEQ ID NO: 49025, SEQ ID NOs: 49045 to 49046, SEQ ID NO: 49052, SEQ ID NO: 49083, SEQ ID NO: 49086, SEQ ID NOs: 49091 to 49092, SEQ ID NO: 49102, SEQ ID NO: 49106, SEQ ID NO: 49111, SEQ ID NO: 49127, SEQ ID NO: 49152, SEQ ID NO: 49159, SEQ ID NO: 49173, SEQ ID NO: 49197, SEQ ID NO: 49201, SEQ ID NO: 49203, SEQ ID NO: 49207, SEQ ID NO: 49220, SEQ ID NO: 49227, SEQ ID NO: 49230, SEQ ID NO: 49234, SEQ ID NO: 49242, SEQ ID NO: 49256, SEQ ID NO: 49263, SEQ ID NOs: 49273 to 49274, SEQ ID NO: 49278, SEQ ID NO: 49280, SEQ ID NO: 49288, SEQ ID NO: 49290, SEQ ID NOs: 49294 to 49295, SEQ ID NO: 49326, SEQ ID NO: 49362, SEQ ID NOs: 49384 to 49385, SEQ ID NO: 49387, SEQ ID NO: 49393, SEQ ID NO: 49395, SEQ ID NOs: 49427 to 49428, SEQ ID NO: 49444, SEQ ID NO: 49458, SEQ ID NO: 49483, SEQ ID NO: 49487, SEQ ID NO: 49497, SEQ ID NO: 49501, SEQ ID NO: 49517, SEQ ID NO: 49525, SEQ ID NO: 49535, SEQ ID NO: 49537, SEQ ID NO: 49544, SEQ ID NO: 49557, SEQ ID NO: 49569, SEQ ID NO: 49572, SEQ ID NO: 49587, SEQ ID NO: 49594, SEQ ID NO: 49596, SEQ ID NO: 49598, SEQ ID NO: 49606, SEQ ID NO: 49617, SEQ ID NO: 49629, SEQ ID NO: 49646, SEQ ID NO: 49658, SEQ ID NO: 49693, SEQ ID NOs: 49702 to 49703, SEQ ID NO: 49710, SEQ ID NO: 49712, SEQ ID NO: 49719, SEQ ID NO: 49727, SEQ ID NO: 49737, SEQ ID NO: 49740, SEQ ID NO: 49743, SEQ ID NO: 49767, SEQ ID NO: 49778, SEQ ID NO: 49788, SEQ ID NO: 49811, SEQ ID NO: 49848, SEQ ID NO: 49860, SEQ ID NO: 49888, SEQ ID NO: 49908, SEQ ID NO: 49973, SEQ ID NO: 49977, SEQ ID NO: 49980, SEQ ID NOs: 49996 to 49997, SEQ ID NO: 50000, SEQ ID NO: 50012, SEQ ID NOs: 50017 to 50018, SEQ ID NO: 50051, SEQ ID NO: 50056, SEQ ID NO: 50062, SEQ ID NO: 50090, SEQ ID NO: 50093, SEQ ID NO: 50107, SEQ ID NO: 50129, SEQ ID NO: 50132, SEQ ID NO: 50138, SEQ ID NO: 50144, SEQ ID NO: 50167, SEQ ID NO: 50191, SEQ ID NO: 50194, SEQ ID NO: 50196, SEQ ID NO: 50228, SEQ ID NO: 50239, SEQ ID NO: 50263, SEQ ID NO: 50271, SEQ ID NO: 50297, SEQ ID NO: 50305, SEQ ID NO: 50320, SEQ ID NO: 50322, SEQ ID NO: 50326, SEQ ID NO: 50334, SEQ ID NO: 50349, SEQ ID NO: 50375, SEQ ID NO: 50394, SEQ ID NO: 50401, SEQ ID NO: 50414, SEQ ID NO: 50421, SEQ ID NO: 50423, SEQ ID NO: 50435, SEQ ID NOs: 50440 to 50441, SEQ ID NO: 50443, SEQ ID NO: 50510, SEQ ID NO: 50556, SEQ ID NO: 50564, SEQ ID NO: 50591, SEQ ID NO: 50605, SEQ ID NO: 50607, SEQ ID NO: 50611, SEQ ID NO: 50622, SEQ ID NO: 50625, SEQ ID NO: 50627, SEQ ID NO: 50632, SEQ ID NO: 50644, SEQ ID NOs: 50652 to 50653, SEQ ID NOs: 50668 to 50669, SEQ ID NO: 50677, SEQ ID NO: 50696, SEQ ID NO: 50699, SEQ ID NO: 50705, SEQ ID NO: 50709, SEQ ID NO: 50711, SEQ ID NO: 50729, SEQ ID NO: 50731, SEQ ID NO: 50741, SEQ ID NO: 50743, SEQ ID NO: 50748, SEQ ID NO: 50762, SEQ ID NO: 50765, SEQ ID NO: 50767, SEQ ID NO: 50800, SEQ ID NO: 50803, SEQ ID NO: 50807, SEQ ID NO: 50841, SEQ ID NO: 50865, SEQ ID NO: 50872, SEQ ID NO: 50905, SEQ ID NOs: 50955 to 50956, SEQ ID NOs: 50975 to 50977, SEQ ID NO: 50986, SEQ ID NO: 51021, SEQ ID NOs: 51039 to 51040, SEQ ID NOs: 51066 to 51068, SEQ ID NO: 51084, SEQ ID NOs: 51099 to 51100, SEQ ID NOs: 51165 to 51167, SEQ ID NO: 51169, SEQ ID NO: 51190, SEQ ID NOs: 51194 to 51198, SEQ ID NOs: 51267 to 51270, SEQ ID NOs: 51281 to 51282, SEQ ID NO: 51324, SEQ ID NO: 51349, SEQ ID NO: 51379, SEQ ID NOs: 51413 to 51415, SEQ ID NOs: 51420 to 51421, or SEQ ID NOs: 51434 to 60455.

In some embodiments, the amino acid sequence for a MHC class I peptide vaccine for the MAGA3 protein comprises two or more of the SEQ ID NO: 41383, SEQ ID NO: 41396, SEQ ID NO: 41770, SEQ ID NO: 49004, and SEQ ID NOs: 51434 to 51510. In some embodiments, any one of the peptides in the MAGA3 vaccine comprise an amino acid sequence 80, 81, 82, 83, 84, 85, 86, 87, 88, 89, 90, 91, 92, 93, 94, 95, 96, 97, 98 or 99% identical to SEQ ID NO: 41383, SEQ ID NO: 41396, SEQ ID NO: 41770, SEQ ID NO: 49004, or SEQ ID NOs: 51434 to 51510.

In some embodiments, the amino acid sequence for a MHC class I peptide vaccine for the MAGA3 protein comprises two or more of the SEQ ID NOs: 41351 to 41352, SEQ ID NO: 41383, SEQ ID NO: 41396, SEQ ID NO: 41410, SEQ ID NO: 41414, SEQ ID NO: 41435, SEQ ID NO: 41450, SEQ ID NO: 41463, SEQ ID NO: 41478, SEQ ID NO: 41489, SEQ ID NO: 41495, SEQ ID NO: 41503, SEQ ID NO: 41513, SEQ ID NO: 41520, SEQ ID NO: 41535, SEQ ID NO: 41541, SEQ ID NO: 41545, SEQ ID NO: 41577, SEQ ID NO: 41588, SEQ ID NO: 41598, SEQ ID NO: 41605, SEQ ID NO: 41617, SEQ ID NO: 41620, SEQ ID NO: 41622, SEQ ID NO: 41627, SEQ ID NO: 41630, SEQ ID NO: 41638, SEQ ID NO: 41647, SEQ ID NO: 41673, SEQ ID NO: 41696, SEQ ID NO: 41703, SEQ ID NO: 41708, SEQ ID NO: 41728, SEQ ID NOs: 41732 to 41733, SEQ ID NO: 41749, SEQ ID NO: 41760, SEQ ID NO: 41766, SEQ ID NO: 41770, SEQ ID NO: 41788, SEQ ID NO: 41791, SEQ ID NO: 41809, SEQ ID NO: 41813, SEQ ID NO: 41817, SEQ ID NO: 41829, SEQ ID NOs: 41847 to 41848, SEQ ID NO: 41853, SEQ ID NO: 41859, SEQ ID NO: 41889, SEQ ID NO: 41894, SEQ ID NO: 41897, SEQ ID NO: 41909, SEQ ID NO: 41923, SEQ ID NO: 41934, SEQ ID NO: 41939, SEQ ID NOs: 41953 to 41954, SEQ ID NO: 41959, SEQ ID NO: 41967, SEQ ID NO: 41970, SEQ ID NO: 41976, SEQ ID NOs: 41984 to 41985, SEQ ID NO: 42007, SEQ ID NO: 42017, SEQ ID NO: 42034, SEQ ID NO: 42044, SEQ ID NO: 42046, SEQ ID NO: 42048, SEQ ID NO: 42056, SEQ ID NO: 42067, SEQ ID NO: 42080, SEQ ID NO: 42088, SEQ ID NO: 42091, SEQ ID NOs: 42119 to 42120, SEQ ID NO: 42129, SEQ ID NO: 42135, SEQ ID NOs: 42140 to 42141, SEQ ID NO: 42155, SEQ ID NO: 42158, SEQ ID NO: 42164, SEQ ID NO: 42170, SEQ ID NO: 42174, SEQ ID NO: 42186, SEQ ID NO: 42209, SEQ ID NO: 42218, SEQ ID NO: 42224, SEQ ID NO: 42229, SEQ ID NO: 42232, SEQ ID NO: 42235, SEQ ID NOs: 42237 to 42238, SEQ ID NO: 42265, SEQ ID NO: 42272, SEQ ID NO: 42278, SEQ ID NO: 42293, SEQ ID NO: 42314, SEQ ID NOs: 42336 to 42337, SEQ ID NO: 42339, SEQ ID NOs: 42372 to 42373, SEQ ID NO: 42376, SEQ ID NO: 42382, SEQ ID NO: 42386, SEQ ID NO: 42408, SEQ ID NO: 42414, SEQ ID NO: 42423, SEQ ID NO: 42429, SEQ ID NOs: 42447 to 42448, SEQ ID NO: 42461, SEQ ID NO: 42466, SEQ ID NO: 42475, SEQ ID NO: 42513, SEQ ID NO: 42540, SEQ ID NO: 42545, SEQ ID NO: 42550, SEQ ID NO: 42553, SEQ ID NOs: 42567 to 42568, SEQ ID NO: 42580, SEQ ID NO: 42585, SEQ ID NO: 42605, SEQ ID NO: 42612, SEQ ID NO: 42627, SEQ ID NO: 42675, SEQ ID NO: 42680, SEQ ID NO: 42685, SEQ ID NO: 42690, SEQ ID NO: 42702, SEQ ID NO: 42711, SEQ ID NO: 42719, SEQ ID NO: 42738, SEQ ID NO: 42743, SEQ ID NO: 42750, SEQ ID NO: 42755, SEQ ID NO: 42777, SEQ ID NO: 42788, SEQ ID NO: 42793, SEQ ID NO: 42851, SEQ ID NO: 42858, SEQ ID NO: 42866, SEQ ID NO: 42903, SEQ ID NO: 42927, SEQ ID NOs: 42936 to 42937, SEQ ID NOs: 42940 to 42941, SEQ ID NO: 42957, SEQ ID NO: 42962, SEQ ID NO: 42966, SEQ ID NO: 42968, SEQ ID NO: 42986, SEQ ID NO: 43002, SEQ ID NO: 43013, SEQ ID NO: 43037, SEQ ID NO: 43052, SEQ ID NOs: 43055 to 43056, SEQ ID NOs: 43063 to 43064, SEQ ID NO: 43096, SEQ ID NO: 43133, SEQ ID NO: 43138, SEQ ID NO: 43156, SEQ ID NO: 43161, SEQ ID NO: 43186, SEQ ID NO: 43199, SEQ ID NO: 43205, SEQ ID NO: 43245, SEQ ID NO: 43251, SEQ ID NO: 43275, SEQ ID NO: 43312, SEQ ID NO: 43327, SEQ ID NO: 43333, SEQ ID NO: 43339, SEQ ID NO: 43342, SEQ ID NO: 43348, SEQ ID NO: 43365, SEQ ID NO: 43371, SEQ ID NO: 43400, SEQ ID NO: 43440, SEQ ID NO: 43451, SEQ ID NO: 43462, SEQ ID NO: 43467, SEQ ID NO: 43487, SEQ ID NOs: 43498 to 43499, SEQ ID NO: 43507, SEQ ID NO: 43522, SEQ ID NO: 43529, SEQ ID NO: 43533, SEQ ID NO: 43545, SEQ ID NO: 43558, SEQ ID NO: 43560, SEQ ID NO: 43583, SEQ ID NO: 43597, SEQ ID NO: 43599, SEQ ID NO: 43610, SEQ ID NO: 43614, SEQ ID NO: 43627, SEQ ID NO: 43697, SEQ ID NO: 43715, SEQ ID NO: 43718, SEQ ID NO: 43768, SEQ ID NO: 43777, SEQ ID NOs: 43825 to 43826, SEQ ID NO: 43836, SEQ ID NO: 43840, SEQ ID NO: 43856, SEQ ID NO: 43860, SEQ ID NO: 43870, SEQ ID NO: 43878, SEQ ID NOs: 43881 to 43882, SEQ ID NO: 43905, SEQ ID NO: 43922, SEQ ID NO: 43930, SEQ ID NO: 43943, SEQ ID NO: 43953, SEQ ID NO: 43958, SEQ ID NO: 43979, SEQ ID NO: 43986, SEQ ID NO: 44002, SEQ ID NO: 44033, SEQ ID NO: 44037, SEQ ID NO: 44048, SEQ ID NO: 44050, SEQ ID NO: 44052, SEQ ID NOs: 44080 to 44081, SEQ ID NOs: 44093 to 44094, SEQ ID NOs: 44114 to 44115, SEQ ID NO: 44120, SEQ ID NO: 44142, SEQ ID NO: 44152, SEQ ID NOs: 44164 to 44166, SEQ ID NO: 44181, SEQ ID NO: 44222, SEQ ID NO: 44244, SEQ ID NO: 44246, SEQ ID NO: 44255, SEQ ID NO: 44261, SEQ ID NO: 44276, SEQ ID NOs: 44286 to 44287, SEQ ID NO: 44296, SEQ ID NO: 44315, SEQ ID NO: 44322, SEQ ID NO: 44324, SEQ ID NO: 44328, SEQ ID NO: 44332, SEQ ID NO: 44339, SEQ ID NO: 44401, SEQ ID NO: 44413, SEQ ID NO: 44435, SEQ ID NO: 44452, SEQ ID NO: 44454, SEQ ID NO: 44463, SEQ ID NO: 44467, SEQ ID NO: 44485, SEQ ID NO: 44504, SEQ ID NO: 44512, SEQ ID NO: 44523, SEQ ID NOs: 44526 to 44527, SEQ ID NO: 44536, SEQ ID NO: 44564, SEQ ID NO: 44605, SEQ ID NO: 44607, SEQ ID NO: 44612, SEQ ID NO: 44629, SEQ ID NOs: 44635 to 44636, SEQ ID NO: 44647, SEQ ID NO: 44650, SEQ ID NO: 44674, SEQ ID NO: 44691, SEQ ID NO: 44696, SEQ ID NO: 44702, SEQ ID NO: 44710, SEQ ID NO: 44713, SEQ ID NO: 44715, SEQ ID NO: 44722, SEQ ID NO: 44730, SEQ ID NO: 44733, SEQ ID NO: 44755, SEQ ID NO: 44770, SEQ ID NO: 44773, SEQ ID NO: 44781, SEQ ID NO: 44783, SEQ ID NO: 44797, SEQ ID NO: 44805, SEQ ID NO: 44822, SEQ ID NO: 44828, SEQ ID NO: 44830, SEQ ID NO: 44832, SEQ ID NO: 44850, SEQ ID NO: 44852, SEQ ID NO: 44854, SEQ ID NO: 44860, SEQ ID NO: 44866, SEQ ID NO: 44898, SEQ ID NO: 44900, SEQ ID NO: 44907, SEQ ID NO: 44933, SEQ ID NO: 44947, SEQ ID NO: 44986, SEQ ID NO: 45003, SEQ ID NO: 45007, SEQ ID NO: 45009, SEQ ID NO: 45012, SEQ ID NO: 45016, SEQ ID NO: 45018, SEQ ID NO: 45027, SEQ ID NO: 45031, SEQ ID NO: 45036, SEQ ID NO: 45044, SEQ ID NO: 45060, SEQ ID NO: 45071, SEQ ID NO: 45077, SEQ ID NO: 45095, SEQ ID NO: 45126, SEQ ID NO: 45132, SEQ ID NO: 45135, SEQ ID NO: 45139, SEQ ID NO: 45143, SEQ ID NO: 45159, SEQ ID NO: 45177, SEQ ID NO: 45197, SEQ ID NO: 45200, SEQ ID NO: 45219, SEQ ID NO: 45228, SEQ ID NO: 45323, SEQ ID NO: 45329, SEQ ID NO: 45351, SEQ ID NO: 45378, SEQ ID NO: 45380, SEQ ID NO: 45389, SEQ ID NO: 45413, SEQ ID NO: 45417, SEQ ID NO: 45438, SEQ ID NO: 45455, SEQ ID NO: 45457, SEQ ID NO: 45467, SEQ ID NO: 45478, SEQ ID NO: 45530, SEQ ID NO: 45562, SEQ ID NO: 45565, SEQ ID NOs: 45583 to 45584, SEQ ID NOs: 45595 to 45596, SEQ ID NO: 45608, SEQ ID NO: 45612, SEQ ID NO: 45616, SEQ ID NO: 45627, SEQ ID NO: 45653, SEQ ID NOs: 45666 to 45667, SEQ ID NO: 45680, SEQ ID NO: 45697, SEQ ID NO: 45705, SEQ ID NO: 45710, SEQ ID NO: 45722, SEQ ID NO: 45736, SEQ ID NO: 45742, SEQ ID NO: 45746, SEQ ID NO: 45765, SEQ ID NO: 45808, SEQ ID NO: 45830, SEQ ID NOs: 45840 to 45841, SEQ ID NO: 45896, SEQ ID NOs: 45904 to 45905, SEQ ID NO: 45913, SEQ ID NO: 45915, SEQ ID NOs: 45940 to 45943, SEQ ID NO: 45945, SEQ ID NOs: 45958 to 45959, SEQ ID NO: 45977, SEQ ID NO: 45983, SEQ ID NO: 45992, SEQ ID NO: 46006, SEQ ID NO: 46012, SEQ ID NO: 46018, SEQ ID NO: 46021, SEQ ID NOs: 46037 to 46038, SEQ ID NO: 46044, SEQ ID NO: 46058, SEQ ID NO: 46071, SEQ ID NO: 46082, SEQ ID NO: 46094, SEQ ID NO: 46096, SEQ ID NO: 46102, SEQ ID NOs: 46108 to 46109, SEQ ID NO: 46122, SEQ ID NO: 46125, SEQ ID NOs: 46133 to 46134, SEQ ID NO: 46146, SEQ ID NO: 46159, SEQ ID NO: 46177, SEQ ID NO: 46182, SEQ ID NO: 46188, SEQ ID NO: 46202, SEQ ID NO: 46219, SEQ ID NO: 46246, SEQ ID NO: 46249, SEQ ID NO: 46270, SEQ ID NO: 46279, SEQ ID NO: 46312, SEQ ID NO: 46339, SEQ ID NO: 46378, SEQ ID NO: 46433, SEQ ID NO: 46442, SEQ ID NO: 46446, SEQ ID NO: 46452, SEQ ID NO: 46454, SEQ ID NO: 46457, SEQ ID NO: 46478, SEQ ID NO: 46484, SEQ ID NO: 46486, SEQ ID NO: 46491, SEQ ID NO: 46506, SEQ ID NO: 46512, SEQ ID NO: 46517, SEQ ID NO: 46530, SEQ ID NO: 46534, SEQ ID NO: 46556, SEQ ID NO: 46560, SEQ ID NO: 46564, SEQ ID NO: 46596, SEQ ID NO: 46602, SEQ ID NO: 46616, SEQ ID NO: 46635, SEQ ID NO: 46656, SEQ ID NO: 46658, SEQ ID NO: 46666, SEQ ID NO: 46676, SEQ ID NO: 46679, SEQ ID NO: 46689, SEQ ID NO: 46705, SEQ ID NO: 46724, SEQ ID NO: 46738, SEQ ID NO: 46767, SEQ ID NO: 46770, SEQ ID NO: 46794, SEQ ID NO: 46810, SEQ ID NO: 46819, SEQ ID NO: 46824, SEQ ID NO: 46831, SEQ ID NO: 46849, SEQ ID NO: 46854, SEQ ID NO: 46870, SEQ ID NO: 46880, SEQ ID NO: 46916, SEQ ID NO: 46935, SEQ ID NO: 46939, SEQ ID NO: 46944, SEQ ID NO: 46958, SEQ ID NO: 46964, SEQ ID NO: 46967, SEQ ID NO: 46978, SEQ ID NO: 46987, SEQ ID NO: 46989, SEQ ID NO: 46991, SEQ ID NO: 46993, SEQ ID NO: 47007, SEQ ID NO: 47034, SEQ ID NO: 47037, SEQ ID NO: 47047, SEQ ID NO: 47057, SEQ ID NO: 47066, SEQ ID NO: 47096, SEQ ID NO: 47098, SEQ ID NO: 47119, SEQ ID NO: 47123, SEQ ID NO: 47137, SEQ ID NO: 47139, SEQ ID NO: 47143, SEQ ID NO: 47150, SEQ ID NO: 47158, SEQ ID NO: 47161, SEQ ID NO: 47170, SEQ ID NO: 47181, SEQ ID NO: 47197, SEQ ID NO: 47209, SEQ ID NO: 47254, SEQ ID NO: 47266, SEQ ID NO: 47272, SEQ ID NO: 47291, SEQ ID NO: 47298, SEQ ID NO: 47300, SEQ ID NO: 47319, SEQ ID NO: 47324, SEQ ID NOs: 47331 to 47332, SEQ ID NO: 47358, SEQ ID NO: 47361, SEQ ID NO: 47393, SEQ ID NO: 47414, SEQ ID NO: 47416, SEQ ID NO: 47422, SEQ ID NO: 47425, SEQ ID NOs: 47432 to 47433, SEQ ID NO: 47445, SEQ ID NO: 47453, SEQ ID NOs: 47460 to 47461, SEQ ID NO: 47477, SEQ ID NO: 47492, SEQ ID NO: 47507, SEQ ID NO: 47509, SEQ ID NO: 47516, SEQ ID NO: 47535, SEQ ID NOs: 47556 to 47557, SEQ ID NOs: 47578 to 47579, SEQ ID NOs: 47591 to 47592, SEQ ID NO: 47597, SEQ ID NO: 47600, SEQ ID NO: 47614, SEQ ID NO: 47626, SEQ ID NO: 47629, SEQ ID NO: 47637, SEQ ID NO: 47639, SEQ ID NO: 47649, SEQ ID NOs: 47689 to 47690, SEQ ID NO: 47713, SEQ ID NO: 47766, SEQ ID NOs: 47814 to 47815, SEQ ID NO: 47827, SEQ ID NO: 47834, SEQ ID NOs: 47852 to 47853, SEQ ID NO: 47855, SEQ ID NO: 47871, SEQ ID NOs: 47875 to 47876, SEQ ID NO: 47891, SEQ ID NO: 47896, SEQ ID NO: 47902, SEQ ID NO: 47923, SEQ ID NO: 47925, SEQ ID NO: 47927, SEQ ID NO: 47929, SEQ ID NO: 47932, SEQ ID NOs: 47962 to 47964, SEQ ID NO: 47972, SEQ ID NO: 47999, SEQ ID NO: 48008, SEQ ID NO: 48028, SEQ ID NOs: 48034 to 48035, SEQ ID NO: 48038, SEQ ID NO: 48056, SEQ ID NO: 48061, SEQ ID NO: 48066, SEQ ID NO: 48118, SEQ ID NO: 48120, SEQ ID NO: 48129, SEQ ID NO: 48140, SEQ ID NO: 48148, SEQ ID NO: 48153, SEQ ID NOs: 48159 to 48160, SEQ ID NO: 48163, SEQ ID NO: 48167, SEQ ID NO: 48178, SEQ ID NO: 48180, SEQ ID NO: 48186, SEQ ID NO: 48218, SEQ ID NO: 48220, SEQ ID NO: 48263, SEQ ID NO: 48286, SEQ ID NO: 48300, SEQ ID NO: 48307, SEQ ID NO: 48315, SEQ ID NO: 48321, SEQ ID NO: 48338, SEQ ID NO: 48341, SEQ ID NO: 48343, SEQ ID NO: 48358, SEQ ID NO: 48362, SEQ ID NO: 48366, SEQ ID NO: 48368, SEQ ID NO: 48418, SEQ ID NO: 48431, SEQ ID NO: 48436, SEQ ID NOs: 48438 to 48439, SEQ ID NOs: 48443 to 48444, SEQ ID NO: 48450, SEQ ID NOs: 48452 to 48453, SEQ ID NO: 48458, SEQ ID NOs: 48461 to 48462, SEQ ID NO: 48507, SEQ ID NO: 48516, SEQ ID NO: 48527, SEQ ID NO: 48537, SEQ ID NO: 48548, SEQ ID NO: 48567, SEQ ID NO: 48574, SEQ ID NO: 48576, SEQ ID NO: 48578, SEQ ID NO: 48594, SEQ ID NO: 48599, SEQ ID NO: 48612, SEQ ID NO: 48614, SEQ ID NO: 48623, SEQ ID NO: 48626, SEQ ID NO: 48630, SEQ ID NO: 48642, SEQ ID NO: 48648, SEQ ID NO: 48656, SEQ ID NOs: 48704 to 48705, SEQ ID NO: 48708, SEQ ID NO: 48739, SEQ ID NO: 48749, SEQ ID NO: 48752, SEQ ID NO: 48754, SEQ ID NO: 48756, SEQ ID NO: 48802, SEQ ID NO: 48832, SEQ ID NO: 48845, SEQ ID NO: 48850, SEQ ID NO: 48852, SEQ ID NO: 48856, SEQ ID NO: 48870, SEQ ID NO: 48888, SEQ ID NO: 48902, SEQ ID NO: 48904, SEQ ID NOs: 48912 to 48913, SEQ ID NO: 48921, SEQ ID NO: 48970, SEQ ID NO: 48974, SEQ ID NO: 48993, SEQ ID NO: 48997, SEQ ID NO: 49004, SEQ ID NO: 49019, SEQ ID NO: 49025, SEQ ID NOs: 49045 to 49046, SEQ ID NO: 49052, SEQ ID NO: 49083, SEQ ID NO: 49086, SEQ ID NOs: 49091 to 49092, SEQ ID NO: 49102, SEQ ID NO: 49106, SEQ ID NO: 49111, SEQ ID NO: 49127, SEQ ID NO: 49152, SEQ ID NO: 49159, SEQ ID NO: 49173, SEQ ID NO: 49197, SEQ ID NO: 49201, SEQ ID NO: 49203, SEQ ID NO: 49207, SEQ ID NO: 49220, SEQ ID NO: 49227, SEQ ID NO: 49230, SEQ ID NO: 49234, SEQ ID NO: 49242, SEQ ID NO: 49256, SEQ ID NO: 49263, SEQ ID NOs: 49273 to 49274, SEQ ID NO: 49278, SEQ ID NO: 49280, SEQ ID NO: 49288, SEQ ID NO: 49290, SEQ ID NOs: 49294 to 49295, SEQ ID NO: 49326, SEQ ID NO: 49362, SEQ ID NOs: 49384 to 49385, SEQ ID NO: 49387, SEQ ID NO: 49393, SEQ ID NO: 49395, SEQ ID NOs: 49427 to 49428, SEQ ID NO: 49444, SEQ ID NO: 49458, SEQ ID NO: 49483, SEQ ID NO: 49487, SEQ ID NO: 49497, SEQ ID NO: 49501, SEQ ID NO: 49517, SEQ ID NO: 49525, SEQ ID NO: 49535, SEQ ID NO: 49537, SEQ ID NO: 49544, SEQ ID NO: 49557, SEQ ID NO: 49569, SEQ ID NO: 49572, SEQ ID NO: 49587, SEQ ID NO: 49594, SEQ ID NO: 49596, SEQ ID NO: 49598, SEQ ID NO: 49606, SEQ ID NO: 49617, SEQ ID NO: 49629, SEQ ID NO: 49646, SEQ ID NO: 49658, SEQ ID NO: 49693, SEQ ID NOs: 49702 to 49703, SEQ ID NO: 49710, SEQ ID NO: 49712, SEQ ID NO: 49719, SEQ ID NO: 49727, SEQ ID NO: 49737, SEQ ID NO: 49740, SEQ ID NO: 49743, SEQ ID NO: 49767, SEQ ID NO: 49778, SEQ ID NO: 49788, SEQ ID NO: 49811, SEQ ID NO: 49848, SEQ ID NO: 49860, SEQ ID NO: 49888, SEQ ID NO: 49908, SEQ ID NO: 49973, SEQ ID NO: 49977, SEQ ID NO: 49980, SEQ ID NOs: 49996 to 49997, SEQ ID NO: 50000, SEQ ID NO: 50012, SEQ ID NOs: 50017 to 50018, SEQ ID NO: 50051, SEQ ID NO: 50056, SEQ ID NO: 50062, SEQ ID NO: 50090, SEQ ID NO: 50093, SEQ ID NO: 50107, SEQ ID NO: 50129, SEQ ID NO: 50132, SEQ ID NO: 50138, SEQ ID NO: 50144, SEQ ID NO: 50167, SEQ ID NO: 50191, SEQ ID NO: 50194, SEQ ID NO: 50196, SEQ ID NO: 50228, SEQ ID NO: 50239, SEQ ID NO: 50263, SEQ ID NO: 50271, SEQ ID NO: 50297, SEQ ID NO: 50305, SEQ ID NO: 50320, SEQ ID NO: 50322, SEQ ID NO: 50326, SEQ ID NO: 50334, SEQ ID NO: 50349, SEQ ID NO: 50375, SEQ ID NO: 50394, SEQ ID NO: 50401, SEQ ID NO: 50414, SEQ ID NO: 50421, SEQ ID NO: 50423, SEQ ID NO: 50435, SEQ ID NOs: 50440 to 50441, SEQ ID NO: 50443, SEQ ID NO: 50510, SEQ ID NO: 50556, SEQ ID NO: 50564, SEQ ID NO: 50591, SEQ ID NO: 50605, SEQ ID NO: 50607, SEQ ID NO: 50611, SEQ ID NO: 50622, SEQ ID NO: 50625, SEQ ID NO: 50627, SEQ ID NO: 50632, SEQ ID NO: 50644, SEQ ID NOs: 50652 to 50653, SEQ ID NOs: 50668 to 50669, SEQ ID NO: 50677, SEQ ID NO: 50696, SEQ ID NO: 50699, SEQ ID NO: 50705, SEQ ID NO: 50709, SEQ ID NO: 50711, SEQ ID NO: 50729, SEQ ID NO: 50731, SEQ ID NO: 50741, SEQ ID NO: 50743, SEQ ID NO: 50748, SEQ ID NO: 50762, SEQ ID NO: 50765, SEQ ID NO: 50767, SEQ ID NO: 50800, SEQ ID NO: 50803, SEQ ID NO: 50807, SEQ ID NO: 50841, SEQ ID NO: 50865, SEQ ID NO: 50872, SEQ ID NO: 50905, SEQ ID NOs: 50955 to 50956, SEQ ID NOs: 50975 to 50977, SEQ ID NO: 50986, SEQ ID NO: 51021, SEQ ID NOs: 51039 to 51040, SEQ ID NOs: 51066 to 51068, SEQ ID NO: 51084, SEQ ID NOs: 51099 to 51100, SEQ ID NOs: 51165 to 51167, SEQ ID NO: 51169, SEQ ID NO: 51190, SEQ ID NOs: 51194 to 51198, SEQ ID NOs: 51267 to 51270, SEQ ID NOs: 51281 to 51282, SEQ ID NO: 51324, SEQ ID NO: 51349, SEQ ID NO: 51379, SEQ ID NOs: 51413 to 51415, SEQ ID NOs: 51420 to 51421, and SEQ ID NOs: 51434 to 60455. In some embodiments, any one of the peptides in the MAGA3 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 41351 to 41352, SEQ ID NO: 41383, SEQ ID NO: 41396, SEQ ID NO: 41410, SEQ ID NO: 41414, SEQ ID NO: 41435, SEQ ID NO: 41450, SEQ ID NO: 41463, SEQ ID NO: 41478, SEQ ID NO: 41489, SEQ ID NO: 41495, SEQ ID NO: 41503, SEQ ID NO: 41513, SEQ ID NO: 41520, SEQ ID NO: 41535, SEQ ID NO: 41541, SEQ ID NO: 41545, SEQ ID NO: 41577, SEQ ID NO: 41588, SEQ ID NO: 41598, SEQ ID NO: 41605, SEQ ID NO: 41617, SEQ ID NO: 41620, SEQ ID NO: 41622, SEQ ID NO: 41627, SEQ ID NO: 41630, SEQ ID NO: 41638, SEQ ID NO: 41647, SEQ ID NO: 41673, SEQ ID NO: 41696, SEQ ID NO: 41703, SEQ ID NO: 41708, SEQ ID NO: 41728, SEQ ID NOs: 41732 to 41733, SEQ ID NO: 41749, SEQ ID NO: 41760, SEQ ID NO: 41766, SEQ ID NO: 41770, SEQ ID NO: 41788, SEQ ID NO: 41791, SEQ ID NO: 41809, SEQ ID NO: 41813, SEQ ID NO: 41817, SEQ ID NO: 41829, SEQ ID NOs: 41847 to 41848, SEQ ID NO: 41853, SEQ ID NO: 41859, SEQ ID NO: 41889, SEQ ID NO: 41894, SEQ ID NO: 41897, SEQ ID NO: 41909, SEQ ID NO: 41923, SEQ ID NO: 41934, SEQ ID NO: 41939, SEQ ID NOs: 41953 to 41954, SEQ ID NO: 41959, SEQ ID NO: 41967, SEQ ID NO: 41970, SEQ ID NO: 41976, SEQ ID NOs: 41984 to 41985, SEQ ID NO: 42007, SEQ ID NO: 42017, SEQ ID NO: 42034, SEQ ID NO: 42044, SEQ ID NO: 42046, SEQ ID NO: 42048, SEQ ID NO: 42056, SEQ ID NO: 42067, SEQ ID NO: 42080, SEQ ID NO: 42088, SEQ ID NO: 42091, SEQ ID NOs: 42119 to 42120, SEQ ID NO: 42129, SEQ ID NO: 42135, SEQ ID NOs: 42140 to 42141, SEQ ID NO: 42155, SEQ ID NO: 42158, SEQ ID NO: 42164, SEQ ID NO: 42170, SEQ ID NO: 42174, SEQ ID NO: 42186, SEQ ID NO: 42209, SEQ ID NO: 42218, SEQ ID NO: 42224, SEQ ID NO: 42229, SEQ ID NO: 42232, SEQ ID NO: 42235, SEQ ID NOs: 42237 to 42238, SEQ ID NO: 42265, SEQ ID NO: 42272, SEQ ID NO: 42278, SEQ ID NO: 42293, SEQ ID NO: 42314, SEQ ID NOs: 42336 to 42337, SEQ ID NO: 42339, SEQ ID NOs: 42372 to 42373, SEQ ID NO: 42376, SEQ ID NO: 42382, SEQ ID NO: 42386, SEQ ID NO: 42408, SEQ ID NO: 42414, SEQ ID NO: 42423, SEQ ID NO: 42429, SEQ ID NOs: 42447 to 42448, SEQ ID NO: 42461, SEQ ID NO: 42466, SEQ ID NO: 42475, SEQ ID NO: 42513, SEQ ID NO: 42540, SEQ ID NO: 42545, SEQ ID NO: 42550, SEQ ID NO: 42553, SEQ ID NOs: 42567 to 42568, SEQ ID NO: 42580, SEQ ID NO: 42585, SEQ ID NO: 42605, SEQ ID NO: 42612, SEQ ID NO: 42627, SEQ ID NO: 42675, SEQ ID NO: 42680, SEQ ID NO: 42685, SEQ ID NO: 42690, SEQ ID NO: 42702, SEQ ID NO: 42711, SEQ ID NO: 42719, SEQ ID NO: 42738, SEQ ID NO: 42743, SEQ ID NO: 42750, SEQ ID NO: 42755, SEQ ID NO: 42777, SEQ ID NO: 42788, SEQ ID NO: 42793, SEQ ID NO: 42851, SEQ ID NO: 42858, SEQ ID NO: 42866, SEQ ID NO: 42903, SEQ ID NO: 42927, SEQ ID NOs: 42936 to 42937, SEQ ID NOs: 42940 to 42941, SEQ ID NO: 42957, SEQ ID NO: 42962, SEQ ID NO: 42966, SEQ ID NO: 42968, SEQ ID NO: 42986, SEQ ID NO: 43002, SEQ ID NO: 43013, SEQ ID NO: 43037, SEQ ID NO: 43052, SEQ ID NOs: 43055 to 43056, SEQ ID NOs: 43063 to 43064, SEQ ID NO: 43096, SEQ ID NO: 43133, SEQ ID NO: 43138, SEQ ID NO: 43156, SEQ ID NO: 43161, SEQ ID NO: 43186, SEQ ID NO: 43199, SEQ ID NO: 43205, SEQ ID NO: 43245, SEQ ID NO: 43251, SEQ ID NO: 43275, SEQ ID NO: 43312, SEQ ID NO: 43327, SEQ ID NO: 43333, SEQ ID NO: 43339, SEQ ID NO: 43342, SEQ ID NO: 43348, SEQ ID NO: 43365, SEQ ID NO: 43371, SEQ ID NO: 43400, SEQ ID NO: 43440, SEQ ID NO: 43451, SEQ ID NO: 43462, SEQ ID NO: 43467, SEQ ID NO: 43487, SEQ ID NOs: 43498 to 43499, SEQ ID NO: 43507, SEQ ID NO: 43522, SEQ ID NO: 43529, SEQ ID NO: 43533, SEQ ID NO: 43545, SEQ ID NO: 43558, SEQ ID NO: 43560, SEQ ID NO: 43583, SEQ ID NO: 43597, SEQ ID NO: 43599, SEQ ID NO: 43610, SEQ ID NO: 43614, SEQ ID NO: 43627, SEQ ID NO: 43697, SEQ ID NO: 43715, SEQ ID NO: 43718, SEQ ID NO: 43768, SEQ ID NO: 43777, SEQ ID NOs: 43825 to 43826, SEQ ID NO: 43836, SEQ ID NO: 43840, SEQ ID NO: 43856, SEQ ID NO: 43860, SEQ ID NO: 43870, SEQ ID NO: 43878, SEQ ID NOs: 43881 to 43882, SEQ ID NO: 43905, SEQ ID NO: 43922, SEQ ID NO: 43930, SEQ ID NO: 43943, SEQ ID NO: 43953, SEQ ID NO: 43958, SEQ ID NO: 43979, SEQ ID NO: 43986, SEQ ID NO: 44002, SEQ ID NO: 44033, SEQ ID NO: 44037, SEQ ID NO: 44048, SEQ ID NO: 44050, SEQ ID NO: 44052, SEQ ID NOs: 44080 to 44081, SEQ ID NOs: 44093 to 44094, SEQ ID NOs: 44114 to 44115, SEQ ID NO: 44120, SEQ ID NO: 44142, SEQ ID NO: 44152, SEQ ID NOs: 44164 to 44166, SEQ ID NO: 44181, SEQ ID NO: 44222, SEQ ID NO: 44244, SEQ ID NO: 44246, SEQ ID NO: 44255, SEQ ID NO: 44261, SEQ ID NO: 44276, SEQ ID NOs: 44286 to 44287, SEQ ID NO: 44296, SEQ ID NO: 44315, SEQ ID NO: 44322, SEQ ID NO: 44324, SEQ ID NO: 44328, SEQ ID NO: 44332, SEQ ID NO: 44339, SEQ ID NO: 44401, SEQ ID NO: 44413, SEQ ID NO: 44435, SEQ ID NO: 44452, SEQ ID NO:

44454, SEQ ID NO: 44463, SEQ ID NO: 44467, SEQ ID NO: 44485, SEQ ID NO: 44504, SEQ ID NO: 44512, SEQ ID NO: 44523, SEQ ID NOs: 44526 to 44527, SEQ ID NO: 44536, SEQ ID NO: 44564, SEQ ID NO: 44605, SEQ ID NO: 44607, SEQ ID NO: 44612, SEQ ID NO: 44629, SEQ ID NOs: 44635 to 44636, SEQ ID NO: 44647, SEQ ID NO: 44650, SEQ ID NO: 44674, SEQ ID NO: 44691, SEQ ID NO: 44696, SEQ ID NO: 44702, SEQ ID NO: 44710, SEQ ID NO: 44713, SEQ ID NO: 44715, SEQ ID NO: 44722, SEQ ID NO: 44730, SEQ ID NO: 44733, SEQ ID NO: 44755, SEQ ID NO: 44770, SEQ ID NO: 44773, SEQ ID NO: 44781, SEQ ID NO: 44783, SEQ ID NO: 44797, SEQ ID NO: 44805, SEQ ID NO: 44822, SEQ ID NO: 44828, SEQ ID NO: 44830, SEQ ID NO: 44832, SEQ ID NO: 44850, SEQ ID NO: 44852, SEQ ID NO: 44854, SEQ ID NO: 44860, SEQ ID NO: 44866, SEQ ID NO: 44898, SEQ ID NO: 44900, SEQ ID NO: 44907, SEQ ID NO: 44933, SEQ ID NO: 44947, SEQ ID NO: 44986, SEQ ID NO: 45003, SEQ ID NO: 45007, SEQ ID NO: 45009, SEQ ID NO: 45012, SEQ ID NO: 45016, SEQ ID NO: 45018, SEQ ID NO: 45027, SEQ ID NO: 45031, SEQ ID NO: 45036, SEQ ID NO: 45044, SEQ ID NO: 45060, SEQ ID NO: 45071, SEQ ID NO: 45077, SEQ ID NO: 45095, SEQ ID NO: 45126, SEQ ID NO: 45132, SEQ ID NO: 45135, SEQ ID NO: 45139, SEQ ID NO: 45143, SEQ ID NO: 45159, SEQ ID NO: 45177, SEQ ID NO: 45197, SEQ ID NO: 45200, SEQ ID NO: 45219, SEQ ID NO: 45228, SEQ ID NO: 45323, SEQ ID NO: 45329, SEQ ID NO: 45351, SEQ ID NO: 45378, SEQ ID NO: 45380, SEQ ID NO: 45389, SEQ ID NO: 45413, SEQ ID NO: 45417, SEQ ID NO: 45438, SEQ ID NO: 45455, SEQ ID NO: 45457, SEQ ID NO: 45467, SEQ ID NO: 45478, SEQ ID NO: 45530, SEQ ID NO: 45562, SEQ ID NO: 45565, SEQ ID NOs: 45583 to 45584, SEQ ID NOs: 45595 to 45596, SEQ ID NO: 45608, SEQ ID NO: 45612, SEQ ID NO: 45616, SEQ ID NO: 45627, SEQ ID NO: 45653, SEQ ID NOs: 45666 to 45667, SEQ ID NO: 45680, SEQ ID NO: 45697, SEQ ID NO: 45705, SEQ ID NO: 45710, SEQ ID NO: 45722, SEQ ID NO: 45736, SEQ ID NO: 45742, SEQ ID NO: 45746, SEQ ID NO: 45765, SEQ ID NO: 45808, SEQ ID NO: 45830, SEQ ID NOs: 45840 to 45841, SEQ ID NO: 45896, SEQ ID NOs: 45904 to 45905, SEQ ID NO: 45913, SEQ ID NO: 45915, SEQ ID NOs: 45940 to 45943, SEQ ID NO: 45945, SEQ ID NOs: 45958 to 45959, SEQ ID NO: 45977, SEQ ID NO: 45983, SEQ ID NO: 45992, SEQ ID NO: 46006, SEQ ID NO: 46012, SEQ ID NO: 46018, SEQ ID NO: 46021, SEQ ID NOs: 46037 to 46038, SEQ ID NO: 46044, SEQ ID NO: 46058, SEQ ID NO: 46071, SEQ ID NO: 46082, SEQ ID NO: 46094, SEQ ID NO: 46096, SEQ ID NO: 46102, SEQ ID NOs: 46108 to 46109, SEQ ID NO: 46122, SEQ ID NO: 46125, SEQ ID NOs: 46133 to 46134, SEQ ID NO: 46146, SEQ ID NO: 46159, SEQ ID NO: 46177, SEQ ID NO: 46182, SEQ ID NO: 46188, SEQ ID NO: 46202, SEQ ID NO: 46219, SEQ ID NO: 46246, SEQ ID NO: 46249, SEQ ID NO: 46270, SEQ ID NO: 46279, SEQ ID NO: 46312, SEQ ID NO: 46339, SEQ ID NO: 46378, SEQ ID NO: 46433, SEQ ID NO: 46442, SEQ ID NO: 46446, SEQ ID NO: 46452, SEQ ID NO: 46454, SEQ ID NO: 46457, SEQ ID NO: 46478, SEQ ID NO: 46484, SEQ ID NO: 46486, SEQ ID NO: 46491, SEQ ID NO: 46506, SEQ ID NO: 46512, SEQ ID NO: 46517, SEQ ID NO: 46530, SEQ ID NO: 46534, SEQ ID NO: 46556, SEQ ID NO: 46560, SEQ ID NO: 46564, SEQ ID NO: 46596, SEQ ID NO: 46602, SEQ ID NO: 46616, SEQ ID NO: 46635, SEQ ID NO: 46656, SEQ ID NO: 46658, SEQ ID NO: 46666, SEQ ID NO: 46676, SEQ ID NO: 46679, SEQ ID NO: 46689, SEQ ID NO: 46705, SEQ ID NO: 46724, SEQ ID NO: 46738, SEQ ID NO: 46767, SEQ ID NO: 46770, SEQ ID NO: 46794, SEQ ID NO: 46810, SEQ ID NO: 46819, SEQ ID NO: 46824, SEQ ID NO: 46831, SEQ ID NO: 46849, SEQ ID NO: 46854, SEQ ID NO: 46870, SEQ ID NO: 46880, SEQ ID NO: 46916, SEQ ID NO: 46935, SEQ ID NO: 46939, SEQ ID NO: 46944, SEQ ID NO: 46958, SEQ ID NO: 46964, SEQ ID NO: 46967, SEQ ID NO: 46978, SEQ ID NO: 46987, SEQ ID NO: 46989, SEQ ID NO: 46991, SEQ ID NO: 46993, SEQ ID NO: 47007, SEQ ID NO: 47034, SEQ ID NO: 47037, SEQ ID NO: 47047, SEQ ID NO: 47057, SEQ ID NO: 47066, SEQ ID NO: 47096, SEQ ID NO: 47098, SEQ ID NO: 47119, SEQ ID NO: 47123, SEQ ID NO: 47137, SEQ ID NO: 47139, SEQ ID NO: 47143, SEQ ID NO: 47150, SEQ ID NO: 47158, SEQ ID NO: 47161, SEQ ID NO: 47170, SEQ ID NO: 47181, SEQ ID NO: 47197, SEQ ID NO: 47209, SEQ ID NO: 47254, SEQ ID NO: 47266, SEQ ID NO: 47272, SEQ ID NO: 47291, SEQ ID NO: 47298, SEQ ID NO: 47300, SEQ ID NO: 47319, SEQ ID NO: 47324, SEQ ID NOs: 47331 to 47332, SEQ ID NO: 47358, SEQ ID NO: 47361, SEQ ID NO: 47393, SEQ ID NO: 47414, SEQ ID NO: 47416, SEQ ID NO: 47422, SEQ ID NO: 47425, SEQ ID NOs: 47432 to 47433, SEQ ID NO: 47445, SEQ ID NO: 47453, SEQ ID NOs: 47460 to 47461, SEQ ID NO: 47477, SEQ ID NO: 47492, SEQ ID NO: 47507, SEQ ID NO: 47509, SEQ ID NO: 47516, SEQ ID NO: 47535, SEQ ID NOs: 47556 to 47557, SEQ ID NOs: 47578 to 47579, SEQ ID NOs: 47591 to 47592, SEQ ID NO: 47597, SEQ ID NO: 47600, SEQ ID NO: 47614, SEQ ID NO: 47626, SEQ ID NO: 47629, SEQ ID NO: 47637, SEQ ID NO: 47639, SEQ ID NO: 47649, SEQ ID NOs: 47689 to 47690, SEQ ID NO: 47713, SEQ ID NO: 47766, SEQ ID NOs: 47814 to 47815, SEQ ID NO: 47827, SEQ ID NO: 47834, SEQ ID NOs: 47852 to 47853, SEQ ID NO: 47855, SEQ ID NO: 47871, SEQ ID NOs: 47875 to 47876, SEQ ID NO: 47891, SEQ ID NO: 47896, SEQ ID NO: 47902, SEQ ID NO: 47923, SEQ ID NO: 47925, SEQ ID NO: 47927, SEQ ID NO: 47929, SEQ ID NO: 47932, SEQ ID NOs: 47962 to 47964, SEQ ID NO: 47972, SEQ ID NO: 47999, SEQ ID NO: 48008, SEQ ID NO: 48028, SEQ ID NOs: 48034 to 48035, SEQ ID NO: 48038, SEQ ID NO: 48056, SEQ ID NO: 48061, SEQ ID NO: 48066, SEQ ID NO: 48118, SEQ ID NO: 48120, SEQ ID NO: 48129, SEQ ID NO: 48140, SEQ ID NO: 48148, SEQ ID NO: 48153, SEQ ID NOs: 48159 to 48160, SEQ ID NO: 48163, SEQ ID NO: 48167, SEQ ID NO: 48178, SEQ ID NO: 48180, SEQ ID NO: 48186, SEQ ID NO: 48218, SEQ ID NO: 48220, SEQ ID NO: 48263, SEQ ID NO: 48286, SEQ ID NO: 48300, SEQ ID NO: 48307, SEQ ID NO: 48315, SEQ ID NO: 48321, SEQ ID NO: 48338, SEQ ID NO: 48341, SEQ ID NO: 48343, SEQ ID NO: 48358, SEQ ID NO: 48362, SEQ ID NO: 48366, SEQ ID NO: 48368, SEQ ID NO: 48418, SEQ ID NO: 48431, SEQ ID NO: 48436, SEQ ID NOs: 48438 to 48439, SEQ ID NOs: 48443 to 48444, SEQ ID NO: 48450, SEQ ID NOs: 48452 to 48453, SEQ ID NO: 48458, SEQ ID NOs: 48461 to 48462, SEQ ID NO: 48507, SEQ ID NO: 48516, SEQ ID NO: 48527, SEQ ID NO: 48537, SEQ ID NO: 48548, SEQ ID NO: 48567, SEQ ID NO: 48574, SEQ ID NO: 48576, SEQ ID NO: 48578, SEQ ID NO: 48594, SEQ ID NO: 48599, SEQ ID NO: 48612, SEQ ID NO: 48614, SEQ ID NO: 48623, SEQ ID NO: 48626, SEQ ID NO: 48630, SEQ ID NO: 48642, SEQ ID NO: 48648, SEQ ID NO: 48656, SEQ ID NOs: 48704 to 48705, SEQ ID NO: 48708, SEQ ID NO: 48739, SEQ ID NO: 48749, SEQ ID NO: 48752, SEQ ID NO: 48754, SEQ ID NO: 48756, SEQ ID NO: 48802, SEQ ID NO: 48832, SEQ ID NO: 48845, SEQ ID NO: 48850, SEQ ID NO: 48852, SEQ ID NO: 48856, SEQ ID

NO: 48870, SEQ ID NO: 48888, SEQ ID NO: 48902, SEQ ID NO: 48904, SEQ ID NOs: 48912 to 48913, SEQ ID NO: 48921, SEQ ID NO: 48970, SEQ ID NO: 48974, SEQ ID NO: 48993, SEQ ID NO: 48997, SEQ ID NO: 49004, SEQ ID NO: 49019, SEQ ID NO: 49025, SEQ ID NOs: 49045 to 49046, SEQ ID NO: 49052, SEQ ID NO: 49083, SEQ ID NO: 49086, SEQ ID NOs: 49091 to 49092, SEQ ID NO: 49102, SEQ ID NO: 49106, SEQ ID NO: 49111, SEQ ID NO: 49127, SEQ ID NO: 49152, SEQ ID NO: 49159, SEQ ID NO: 49173, SEQ ID NO: 49197, SEQ ID NO: 49201, SEQ ID NO: 49203, SEQ ID NO: 49207, SEQ ID NO: 49220, SEQ ID NO: 49227, SEQ ID NO: 49230, SEQ ID NO: 49234, SEQ ID NO: 49242, SEQ ID NO: 49256, SEQ ID NO: 49263, SEQ ID NOs: 49273 to 49274, SEQ ID NO: 49278, SEQ ID NO: 49280, SEQ ID NO: 49288, SEQ ID NO: 49290, SEQ ID NOs: 49294 to 49295, SEQ ID NO: 49326, SEQ ID NO: 49362, SEQ ID NOs: 49384 to 49385, SEQ ID NO: 49387, SEQ ID NO: 49393, SEQ ID NO: 49395, SEQ ID NOs: 49427 to 49428, SEQ ID NO: 49444, SEQ ID NO: 49458, SEQ ID NO: 49483, SEQ ID NO: 49487, SEQ ID NO: 49497, SEQ ID NO: 49501, SEQ ID NO: 49517, SEQ ID NO: 49525, SEQ ID NO: 49535, SEQ ID NO: 49537, SEQ ID NO: 49544, SEQ ID NO: 49557, SEQ ID NO: 49569, SEQ ID NO: 49572, SEQ ID NO: 49587, SEQ ID NO: 49594, SEQ ID NO: 49596, SEQ ID NO: 49598, SEQ ID NO: 49606, SEQ ID NO: 49617, SEQ ID NO: 49629, SEQ ID NO: 49646, SEQ ID NO: 49658, SEQ ID NO: 49693, SEQ ID NOs: 49702 to 49703, SEQ ID NO: 49710, SEQ ID NO: 49712, SEQ ID NO: 49719, SEQ ID NO: 49727, SEQ ID NO: 49737, SEQ ID NO: 49740, SEQ ID NO: 49743, SEQ ID NO: 49767, SEQ ID NO: 49778, SEQ ID NO: 49788, SEQ ID NO: 49811, SEQ ID NO: 49848, SEQ ID NO: 49860, SEQ ID NO: 49888, SEQ ID NO: 49908, SEQ ID NO: 49973, SEQ ID NO: 49977, SEQ ID NO: 49980, SEQ ID NOs: 49996 to 49997, SEQ ID NO: 50000, SEQ ID NO: 50012, SEQ ID NOs: 50017 to 50018, SEQ ID NO: 50051, SEQ ID NO: 50056, SEQ ID NO: 50062, SEQ ID NO: 50090, SEQ ID NO: 50093, SEQ ID NO: 50107, SEQ ID NO: 50129, SEQ ID NO: 50132, SEQ ID NO: 50138, SEQ ID NO: 50144, SEQ ID NO: 50167, SEQ ID NO: 50191, SEQ ID NO: 50194, SEQ ID NO: 50196, SEQ ID NO: 50228, SEQ ID NO: 50239, SEQ ID NO: 50263, SEQ ID NO: 50271, SEQ ID NO: 50297, SEQ ID NO: 50305, SEQ ID NO: 50320, SEQ ID NO: 50322, SEQ ID NO: 50326, SEQ ID NO: 50334, SEQ ID NO: 50349, SEQ ID NO: 50375, SEQ ID NO: 50394, SEQ ID NO: 50401, SEQ ID NO: 50414, SEQ ID NO: 50421, SEQ ID NO: 50423, SEQ ID NO: 50435, SEQ ID NOs: 50440 to 50441, SEQ ID NO: 50443, SEQ ID NO: 50510, SEQ ID NO: 50556, SEQ ID NO: 50564, SEQ ID NO: 50591, SEQ ID NO: 50605, SEQ ID NO: 50607, SEQ ID NO: 50611, SEQ ID NO: 50622, SEQ ID NO: 50625, SEQ ID NO: 50627, SEQ ID NO: 50632, SEQ ID NO: 50644, SEQ ID NOs: 50652 to 50653, SEQ ID NOs: 50668 to 50669, SEQ ID NO: 50677, SEQ ID NO: 50696, SEQ ID NO: 50699, SEQ ID NO: 50705, SEQ ID NO: 50709, SEQ ID NO: 50711, SEQ ID NO: 50729, SEQ ID NO: 50731, SEQ ID NO: 50741, SEQ ID NO: 50743, SEQ ID NO: 50748, SEQ ID NO: 50762, SEQ ID NO: 50765, SEQ ID NO: 50767, SEQ ID NO: 50800, SEQ ID NO: 50803, SEQ ID NO: 50807, SEQ ID NO: 50841, SEQ ID NO: 50865, SEQ ID NO: 50872, SEQ ID NO: 50905, SEQ ID NOs: 50955 to 50956, SEQ ID NOs: 50975 to 50977, SEQ ID NO: 50986, SEQ ID NO: 51021, SEQ ID NO: 51039 to 51040, SEQ ID NOs: 51066 to 51068, SEQ ID NO: 51084, SEQ ID NOs: 51099 to 51100, SEQ ID NOs: 51165 to 51167, SEQ ID NO: 51169, SEQ ID NO: 51190, SEQ ID NOs: 51194 to 51198, SEQ ID NOs: 51267 to 51270, SEQ ID NOs: 51281 to 51282, SEQ ID NO: 51324, SEQ ID NO: 51349, SEQ ID NO: 51379, SEQ ID NOs: 51413 to 51415, SEQ ID NOs: 51420 to 51421, or SEQ ID NOs: 51434 to 60455.

In some embodiments, the amino acid sequence for a MHC class I peptide vaccine for the MAGA4 protein comprises one or more of the SEQ ID NO: 41352, SEQ ID NOs: 41357 to 41358, SEQ ID NO: 41377, SEQ ID NO: 41770, SEQ ID NO: 49071, SEQ ID NO: 50632, SEQ ID NO: 50729, SEQ ID NO: 55758, and SEQ ID NOs: 60456 to 60527. In some embodiments, any one of the peptides in the MAGA4 vaccine comprise an amino acid sequence 80, 81, 82, 83, 84, 85, 86, 87, 88, 89, 90, 91, 92, 93, 94, 95, 96, 97, 98 or 99% identical to SEQ ID NO: 41352, SEQ ID NOs: 41357 to 41358, SEQ ID NO: 41377, SEQ ID NO: 41770, SEQ ID NO: 49071, SEQ ID NO: 50632, SEQ ID NO: 50729, SEQ ID NO: 55758, or SEQ ID NOs: 60456 to 60527.

In some embodiments, the amino acid sequence for a MHC class I peptide vaccine for the MAGA4 protein comprises one or more of the SEQ ID NO: 41345, SEQ ID NO: 41347, SEQ ID NO: 41352, SEQ ID NOs: 41357 to 41358, SEQ ID NO: 41366, SEQ ID NO: 41377, SEQ ID NO: 41382, SEQ ID NO: 41392, SEQ ID NO: 41396, SEQ ID NO: 41398, SEQ ID NO: 41406, SEQ ID NO: 41411, SEQ ID NO: 41414, SEQ ID NO: 41433, SEQ ID NO: 41436, SEQ ID NO: 41445, SEQ ID NO: 41449, SEQ ID NO: 41455, SEQ ID NO: 41478, SEQ ID NO: 41487, SEQ ID NOs: 41495 to 41496, SEQ ID NO: 41503, SEQ ID NO: 41515, SEQ ID NO: 41520, SEQ ID NO: 41529, SEQ ID NO: 41549, SEQ ID NO: 41553, SEQ ID NO: 41562, SEQ ID NO: 41569, SEQ ID NO: 41574, SEQ ID NO: 41576, SEQ ID NO: 41579, SEQ ID NOs: 41587 to 41588, SEQ ID NO: 41605, SEQ ID NO: 41617, SEQ ID NO: 41620, SEQ ID NO: 41634, SEQ ID NO: 41650, SEQ ID NO: 41665, SEQ ID NO: 41670, SEQ ID NO: 41672, SEQ ID NO: 41696, SEQ ID NO: 41703, SEQ ID NO: 41709, SEQ ID NO: 41725, SEQ ID NOs: 41732 to 41733, SEQ ID NO: 41748, SEQ ID NO: 41760, SEQ ID NO: 41766, SEQ ID NO: 41768, SEQ ID NO: 41770, SEQ ID NO: 41779, SEQ ID NO: 41791, SEQ ID NO: 41797, SEQ ID NO: 41813, SEQ ID NO: 41819, SEQ ID NO: 41825, SEQ ID NO: 41829, SEQ ID NOs: 41846 to 41847, SEQ ID NO: 41853, SEQ ID NO: 41876, SEQ ID NO: 41889, SEQ ID NO: 41892, SEQ ID NO: 41897, SEQ ID NOs: 41906 to 41907, SEQ ID NO: 41912, SEQ ID NO: 41924, SEQ ID NO: 41940, SEQ ID NO: 41953, SEQ ID NO: 41956, SEQ ID NO: 41967, SEQ ID NO: 41970, SEQ ID NO: 41976, SEQ ID NO: 41985, SEQ ID NO: 41990, SEQ ID NO: 42014, SEQ ID NO: 42017, SEQ ID NO: 42026, SEQ ID NO: 42034, SEQ ID NO: 42037, SEQ ID NO: 42046, SEQ ID NO: 42048, SEQ ID NOs: 42056 to 42057, SEQ ID NO: 42080, SEQ ID NO: 42088, SEQ ID NO: 42091, SEQ ID NO: 42102, SEQ ID NO: 42106, SEQ ID NO: 42115, SEQ ID NO: 42120, SEQ ID NO: 42129, SEQ ID NO: 42135, SEQ ID NO: 42138, SEQ ID NO: 42151, SEQ ID NO: 42158, SEQ ID NOs: 42163 to 42164, SEQ ID NOs: 42167 to 42168, SEQ ID NO: 42170, SEQ ID NO: 42186, SEQ ID NO: 42192, SEQ ID NO: 42195, SEQ ID NO: 42198, SEQ ID NO: 42204, SEQ ID NO: 42209, SEQ ID NO: 42218, SEQ ID NO: 42221, SEQ ID NO: 42224, SEQ ID NO: 42229, SEQ ID NO: 42240, SEQ ID NO: 42263, SEQ ID NO: 42265, SEQ ID NO: 42270, SEQ ID NO: 42316, SEQ ID NOs: 42336 to 42337, SEQ ID NO: 42339, SEQ ID NO: 42351, SEQ ID NO: 42354, SEQ ID NO: 42372, SEQ ID NO: 42378, SEQ ID NOs: 42385 to 42386, SEQ ID NO: 42394, SEQ ID NO: 42405, SEQ ID NO: 42409, SEQ ID NO: 42417, SEQ ID NO: 42423, SEQ ID NO: 42439, SEQ ID NO: 42447, SEQ ID NO: 42453, SEQ ID NO: 42458, SEQ ID NOs: 42460 to 42461, SEQ ID NO: 42466, SEQ ID NOs: 42472 to 42473, SEQ ID NOs: 42519 to 42520, SEQ ID NO: 42525, SEQ ID NO: 42528, SEQ ID NO: 42540, SEQ ID NO: 42545, SEQ ID NO: 42550, SEQ ID NOs: 42563 to 42564, SEQ ID NO: 42580, SEQ ID NO: 42605, SEQ ID NO: 42609, SEQ ID NOs: 42612 to 42613, SEQ ID NO: 42615, SEQ ID NO: 42628, SEQ ID NO: 42637, SEQ ID NO: 42648, SEQ ID NO: 42653, SEQ ID NO: 42675, SEQ ID NO: 42680, SEQ ID NO: 42685, SEQ ID NO: 42696, SEQ ID NO: 42703, SEQ ID NO: 42719, SEQ ID NO: 42735, SEQ ID NO: 42743, SEQ ID NO: 42748, SEQ ID NO: 42750, SEQ ID NO: 42768, SEQ ID NO: 42812, SEQ ID NO: 42814, SEQ ID NO: 42822, SEQ ID NO: 42827, SEQ ID NO: 42831, SEQ ID NO: 42846, SEQ ID NO: 42850, SEQ ID NO: 42872, SEQ ID NO: 42886, SEQ ID NO: 42911, SEQ ID NO: 42914, SEQ ID NO: 42923, SEQ ID NO: 42927, SEQ ID NOs: 42957 to 42958, SEQ ID NO: 42962, SEQ ID NO: 42971, SEQ ID NOs: 42997 to 42998, SEQ ID NO: 43002, SEQ ID NO: 43008, SEQ ID NO: 43035, SEQ ID NO: 43046, SEQ ID NO: 43048, SEQ ID NO: 43064, SEQ ID NO: 43083, SEQ ID NO: 43091, SEQ ID NO: 43093, SEQ ID NO: 43148, SEQ ID NO: 43160, SEQ ID NO: 43170, SEQ ID NO: 43175, SEQ ID NO: 43180, SEQ ID NO: 43186, SEQ ID NO: 43193, SEQ ID NO: 43196, SEQ ID NOs: 43231 to 43232, SEQ ID NO: 43238, SEQ ID NO: 43242, SEQ ID NO: 43248, SEQ ID NO: 43253, SEQ ID NO: 43258, SEQ ID NO: 43267, SEQ ID NO: 43274, SEQ ID NO: 43280, SEQ ID NO: 43285, SEQ ID NO: 43295, SEQ ID NO: 43308, SEQ ID NO: 43311, SEQ ID NO: 43329, SEQ ID NO: 43333, SEQ ID NOs: 43339 to 43340, SEQ ID NO: 43362, SEQ ID NO: 43365, SEQ ID NO: 43384, SEQ ID NO: 43389, SEQ ID NO: 43395, SEQ ID NO: 43401, SEQ ID NO: 43429, SEQ ID NO: 43432, SEQ ID NO: 43440, SEQ ID NOs: 43451 to 43453, SEQ ID NO: 43462, SEQ ID NO: 43464, SEQ ID NO: 43467, SEQ ID NO: 43479, SEQ ID NO: 43482, SEQ ID NO: 43496, SEQ ID NO: 43511, SEQ ID NO: 43513, SEQ ID NO: 43517, SEQ ID NO: 43545, SEQ ID NO: 43564, SEQ ID NO: 43573, SEQ ID NO: 43585, SEQ ID NO: 43587, SEQ ID NO: 43591, SEQ ID NO: 43611, SEQ ID NO: 43632, SEQ ID NO: 43636, SEQ ID NO: 43641, SEQ ID NO: 43643, SEQ ID NO: 43651, SEQ ID NO: 43669, SEQ ID NO: 43688, SEQ ID NO: 43696, SEQ ID NO: 43700, SEQ ID NO: 43703, SEQ ID NO: 43707, SEQ ID NO: 43718, SEQ ID NO: 43760, SEQ ID NO: 43763, SEQ ID NO: 43768, SEQ ID NO: 43777, SEQ ID NO: 43780, SEQ ID NO: 43787, SEQ ID NO: 43801, SEQ ID NO: 43808, SEQ ID NO: 43810, SEQ ID NO: 43825, SEQ ID NO: 43827, SEQ ID NO: 43836, SEQ ID NO: 43860, SEQ ID NO: 43867, SEQ ID NOs: 43881 to 43882, SEQ ID NO: 43884, SEQ ID NO: 43887, SEQ ID NOs: 43898 to 43899, SEQ ID NO: 43905, SEQ ID NO: 43915, SEQ ID NO: 43924, SEQ ID NO: 43932, SEQ ID NO: 43958, SEQ ID NO: 43971, SEQ ID NO: 43974, SEQ ID NO: 43978, SEQ ID NOs: 43982 to 43984, SEQ ID NOs: 43986 to 43987, SEQ ID NO: 43993, SEQ ID NO: 43995, SEQ ID NO: 44012, SEQ ID NO: 44035, SEQ ID NO: 44037, SEQ ID NO: 44048, SEQ ID NO: 44050, SEQ ID NO: 44052, SEQ ID NO: 44055, SEQ ID NO: 44063, SEQ ID NO: 44073, SEQ ID NO: 44080, SEQ ID NO: 44085, SEQ ID NO: 44087, SEQ ID NO: 44089, SEQ ID NO: 44112, SEQ ID NO: 44117, SEQ ID NO: 44123, SEQ ID NOs: 44151 to 44152, SEQ ID NO: 44160, SEQ ID NO: 44181, SEQ ID NO: 44207, SEQ ID NO: 44210, SEQ ID NO: 44244, SEQ ID NO: 44246, SEQ ID NO: 44254, SEQ ID NO: 44263, SEQ ID NOs: 44298 to 44299, SEQ ID NO: 44309, SEQ ID NO: 44324, SEQ ID NO: 44328, SEQ ID NO: 44342, SEQ ID NO: 44345, SEQ ID NO: 44359, SEQ ID NO: 44361, SEQ ID NO: 44383, SEQ ID NO: 44401, SEQ ID NO: 44422, SEQ ID NO: 44440, SEQ ID NO: 44452, SEQ ID NO: 44454, SEQ ID NO: 44456, SEQ ID NO: 44463, SEQ ID NO: 44467, SEQ ID NO: 44485, SEQ ID NO: 44512, SEQ ID NO: 44523, SEQ ID NO: 44545, SEQ ID NO: 44552, SEQ ID NO: 44564, SEQ ID NOs: 44566 to 44567, SEQ ID NOs: 44589 to 44591, SEQ ID NO: 44615, SEQ ID NO: 44623, SEQ ID NO: 44631, SEQ ID NO: 44636, SEQ ID NO: 44649, SEQ ID NO: 44654, SEQ ID NO: 44691, SEQ ID NO: 44713, SEQ ID NO: 44722, SEQ ID NO: 44730, SEQ ID NO: 44754, SEQ ID NO: 44756, SEQ ID NOs: 44762 to 44763, SEQ ID NO: 44773, SEQ ID NO: 44781, SEQ ID NO: 44794, SEQ ID NO: 44850, SEQ ID NOs: 44873 to 44875, SEQ ID NO: 44877, SEQ ID NO: 44884, SEQ ID NO: 44908, SEQ ID NO: 44913, SEQ ID NO: 44940, SEQ ID NO: 44955, SEQ ID NO: 44964, SEQ ID NO: 44971, SEQ ID NO: 44976, SEQ ID NO: 45000, SEQ ID NO: 45027, SEQ ID NO: 45035, SEQ ID NO: 45060, SEQ ID NO: 45062, SEQ ID NO: 45095, SEQ ID NO: 45123, SEQ ID NOs: 45126 to 45127, SEQ ID NO: 45132, SEQ ID NO: 45135, SEQ ID NOs: 45138 to 45139, SEQ ID NO: 45193, SEQ ID NO: 45197, SEQ ID NO: 45200, SEQ ID NO: 45223, SEQ ID NO: 45225, SEQ ID NO: 45244, SEQ ID NO: 45262, SEQ ID NO: 45273, SEQ ID NO: 45292, SEQ ID NO: 45302, SEQ ID NO: 45306, SEQ ID NO: 45314, SEQ ID NO: 45380, SEQ ID NO: 45385, SEQ ID NO: 45389, SEQ ID NO: 45398, SEQ ID NO: 45409, SEQ ID NO: 45438, SEQ ID NO: 45444, SEQ ID NOs: 45450 to 45451, SEQ ID NO: 45478, SEQ ID NO: 45480, SEQ ID NO: 45485, SEQ ID NO: 45490, SEQ ID NO: 45510, SEQ ID NO: 45514, SEQ ID NOs: 45519 to 45520, SEQ ID NO: 45530, SEQ ID NO: 45541, SEQ ID NO: 45552, SEQ ID NO: 45556, SEQ ID NOs: 45562 to 45563, SEQ ID NO: 45568, SEQ ID NO: 45577, SEQ ID NOs: 45580 to 45581, SEQ ID NO: 45584, SEQ ID NO: 45588, SEQ ID NO: 45595, SEQ ID NO: 45599, SEQ ID NO: 45632, SEQ ID NO: 45653, SEQ ID NOs: 45666 to 45667, SEQ ID NO: 45675, SEQ ID NO: 45680, SEQ ID NO: 45687, SEQ ID NO: 45697, SEQ ID NOs: 45699 to 45700, SEQ ID NO: 45712, SEQ ID NO: 45714, SEQ ID NO: 45723, SEQ ID NO: 45746, SEQ ID NO: 45765, SEQ ID NO: 45787, SEQ ID NO: 45793, SEQ ID NO: 45818, SEQ ID NO: 45826, SEQ ID NOs: 45829 to 45830, SEQ ID NO: 45835, SEQ ID NO: 45837, SEQ ID NO: 45846, SEQ ID NO: 45859, SEQ ID NO: 45885, SEQ ID NO: 45894, SEQ ID NO: 45904, SEQ ID NO: 45915, SEQ ID NO: 45930, SEQ ID NO: 45938, SEQ ID NO: 45959, SEQ ID NO: 45983, SEQ ID NO: 46006, SEQ ID NO: 46011, SEQ ID NO: 46014, SEQ ID NO: 46044, SEQ ID NO: 46049, SEQ ID NO: 46054, SEQ ID NO: 46058, SEQ ID NO: 46063, SEQ ID NO: 46071, SEQ ID NO: 46077, SEQ ID NO: 46096, SEQ ID NO: 46103, SEQ ID NO: 46108, SEQ ID NO: 46110, SEQ ID NO: 46125, SEQ ID NO: 46133, SEQ ID NOs: 46170 to 46171, SEQ ID NO: 46195, SEQ ID NO: 46208, SEQ ID NO: 46212, SEQ ID NO: 46219, SEQ ID NO: 46226, SEQ ID NO: 46234, SEQ ID NO: 46236, SEQ ID NO: 46261, SEQ ID NO: 46270, SEQ ID NO: 46273, SEQ ID NO: 46275, SEQ ID NO: 46339, SEQ ID NO: 46364, SEQ ID NO: 46376, SEQ ID NOs: 46400 to 46401, SEQ ID NOs: 46421 to 46422, SEQ ID NO: 46433, SEQ ID NOs: 46442 to 46443, SEQ ID NO: 46446, SEQ ID NOs: 46452 to 46454, SEQ ID NO: 46457, SEQ ID NO: 46459, SEQ ID NO: 46462, SEQ ID NO: 46465, SEQ ID NO: 46478, SEQ ID NO: 46484, SEQ ID NO: 46489, SEQ ID NO: 46499, SEQ ID NO: 46512, SEQ ID NO: 46521, SEQ ID NO: 46530, SEQ ID NO: 46536, SEQ ID NO: 46560, SEQ ID NO: 46564, SEQ ID NO: 46570, SEQ ID NO: 46572, SEQ ID NO: 46575, SEQ ID NO: 46579, SEQ ID NO: 46586, SEQ ID NO: 46602, SEQ ID NO: 46616, SEQ ID NO: 46621, SEQ ID NO: 46628, SEQ ID NO: 46637, SEQ ID NO: 46642, SEQ ID NO: 46648, SEQ ID NO: 46652, SEQ ID NO: 46655, SEQ ID NO: 46660, SEQ ID NO: 46663, SEQ ID NOs: 46665 to 46666, SEQ ID NO: 46676, SEQ ID NOs: 46678 to 46679, SEQ ID NO: 46682, SEQ ID NO: 46685, SEQ ID NO: 46689, SEQ ID NO: 46713, SEQ ID NO: 46715, SEQ ID NO: 46736, SEQ ID NO: 46739, SEQ ID NO: 46770, SEQ ID NO: 46777, SEQ ID NO: 46800, SEQ ID NOs: 46823 to 46825, SEQ ID NO: 46831, SEQ ID NO: 46872, SEQ ID NO: 46880, SEQ ID NO: 46897, SEQ ID NO: 46916, SEQ ID NO: 46928, SEQ ID NO: 46937, SEQ ID NO: 46950, SEQ ID NO: 46978, SEQ ID NO: 46981, SEQ ID NO: 46983, SEQ ID NO: 46989, SEQ ID NO: 46991, SEQ ID NO: 46993, SEQ ID NO: 47003, SEQ ID NO: 47006, SEQ ID NO: 47017, SEQ ID NO: 47028, SEQ ID NO: 47045, SEQ ID NO: 47047, SEQ ID NO: 47057, SEQ ID NOs: 47079 to 47080, SEQ ID NO: 47082, SEQ ID NO: 47114, SEQ ID NO: 47119, SEQ ID NO: 47123, SEQ ID NOs: 47137 to 47139, SEQ ID NO: 47151, SEQ ID NO: 47158, SEQ ID NO: 47167, SEQ ID NO: 47172, SEQ ID NO: 47186, SEQ ID NO: 47191, SEQ ID NO: 47206, SEQ ID NO: 47224, SEQ ID NO: 47298, SEQ ID NO: 47316, SEQ ID NO: 47324, SEQ ID NOs: 47331 to 47332, SEQ ID NO: 47335, SEQ ID NO: 47356, SEQ ID NO: 47358, SEQ ID NOs: 47360 to 47361, SEQ ID NOs: 47377 to 47378, SEQ ID NO: 47381, SEQ ID NO: 47405, SEQ ID NO: 47412, SEQ ID NO: 47416, SEQ ID NO: 47422, SEQ ID NO: 47425, SEQ ID NO: 47427, SEQ ID NOs: 47432 to 47433, SEQ ID NO: 47445, SEQ ID NO: 47451, SEQ ID NO: 47460, SEQ ID NO: 47482, SEQ ID NO: 47491, SEQ ID NO: 47509, SEQ ID NO: 47516, SEQ ID NOs: 47533 to 47535, SEQ ID NOs: 47538 to 47539, SEQ ID NO: 47555, SEQ ID NO: 47561, SEQ ID NOs: 47575 to 47576, SEQ ID NO: 47582, SEQ ID NO: 47592, SEQ ID NO: 47614, SEQ ID NO: 47625, SEQ ID NO: 47630, SEQ ID NO: 47637, SEQ ID NO: 47643, SEQ ID NO: 47654, SEQ ID NO: 47673, SEQ ID NO: 47689, SEQ ID NO: 47698, SEQ ID NO: 47701, SEQ ID NO: 47727, SEQ ID NO: 47749, SEQ ID NOs: 47759 to 47760, SEQ ID NO: 47767, SEQ ID NO: 47773, SEQ ID NO: 47782, SEQ ID NO: 47790, SEQ ID NO: 47793, SEQ ID NO: 47799, SEQ ID NO: 47806, SEQ ID NO: 47809, SEQ ID NO: 47834, SEQ ID NO: 47840, SEQ ID NO: 47844, SEQ ID NO: 47848, SEQ ID NO: 47855, SEQ ID NO: 47867, SEQ ID NO: 47890, SEQ ID NO: 47895, SEQ ID NO: 47899, SEQ ID NO: 47902, SEQ ID NO: 47923, SEQ ID NO: 47927, SEQ ID NOs: 47959 to 47960, SEQ ID NO: 47964, SEQ ID NO: 47979, SEQ ID NO: 47984, SEQ ID NO: 47986, SEQ ID NOs: 48030 to 48031, SEQ ID NO: 48034, SEQ ID NO: 48059, SEQ ID NO: 48093, SEQ ID NO: 48107, SEQ ID NO: 48113, SEQ ID NO: 48118, SEQ ID NO: 48121, SEQ ID NO: 48129, SEQ ID NOs: 48138 to 48139, SEQ ID NO: 48144, SEQ ID NO: 48158, SEQ ID NO: 48160, SEQ ID NO: 48162, SEQ ID NO: 48175, SEQ ID NO: 48186, SEQ ID NO: 48203, SEQ ID NO: 48210, SEQ ID NO: 48213, SEQ ID NO: 48220, SEQ ID NO: 48224, SEQ ID NO: 48229, SEQ ID NO: 48258, SEQ ID NO: 48266, SEQ ID NO: 48273, SEQ ID NO: 48280, SEQ ID NO: 48286, SEQ ID NOs: 48295 to 48300 to 48301, SEQ ID NOs: 48306 to 48307, SEQ ID NO: 48315, SEQ ID NO: 48347, SEQ ID NO: 48353, SEQ ID NO: 48358, SEQ ID NO: 48366, SEQ ID NO: 48371, SEQ ID NO: 48379, SEQ ID NO: 48387, SEQ ID NO: 48400, SEQ ID NO: 48415, SEQ ID NOs: 48418 to 48419, SEQ ID NO: 48436, SEQ ID NOs: 48438 to 48440, SEQ ID NO: 48443, SEQ ID NO: 48452, SEQ ID NOs: 48461 to 48462, SEQ ID NO: 48466, SEQ ID NO: 48469, SEQ ID NO: 48520, SEQ ID NO: 48537, SEQ ID NO: 48545, SEQ ID NO: 48574, SEQ ID NOs: 48576 to 48578, SEQ ID NO: 48594, SEQ ID NO: 48599, SEQ ID NO: 48614, SEQ ID NO: 48627, SEQ ID NO: 48642, SEQ ID NO: 48648, SEQ ID NO: 48654, SEQ ID NO: 48656, SEQ ID NO: 48666, SEQ ID NOs: 48669 to 48670, SEQ ID NO: 48674, SEQ ID NOs: 48680 to 48681, SEQ ID NO: 48684, SEQ ID NO: 48686, SEQ ID NO: 48692, SEQ ID NO: 48701, SEQ ID NO: 48705, SEQ ID NO: 48714, SEQ ID NO: 48717, SEQ ID NO: 48735, SEQ ID NO: 48738, SEQ ID NO: 48749, SEQ ID NO: 48751, SEQ ID NO: 48764, SEQ ID NO: 48769, SEQ ID NO: 48793, SEQ ID NO: 48796, SEQ ID NOs: 48799 to 48800, SEQ ID NOs: 48802 to 48803, SEQ ID NO: 48818, SEQ ID NO: 48832, SEQ ID NO: 48834, SEQ ID NO: 48838, SEQ ID NO: 48845, SEQ ID NO: 48856, SEQ ID NO: 48877, SEQ ID NO: 48884, SEQ ID NO: 48903, SEQ ID NO: 48936, SEQ ID NO: 48947, SEQ ID NOs: 48968 to 48970, SEQ ID NO: 48974, SEQ ID NOs: 48981 to 48982, SEQ ID NO: 48997, SEQ ID NOs: 49013 to 49014, SEQ ID NOs: 49019 to 49020, SEQ ID NO: 49031, SEQ ID NO: 49033, SEQ ID NO: 49043, SEQ ID NO: 49052, SEQ ID NOs: 49061 to 49062, SEQ ID NO: 49068, SEQ ID NO: 49071, SEQ ID NO: 49086, SEQ ID NO: 49102, SEQ ID NO: 49111, SEQ ID NO: 49156, SEQ ID NO: 49164, SEQ ID NO: 49173, SEQ ID NO: 49176, SEQ ID NO: 49183, SEQ ID NO: 49185, SEQ ID NOs: 49200 to 49201, SEQ ID NO: 49209, SEQ ID NO: 49220, SEQ ID NO: 49247, SEQ ID NO: 49251, SEQ ID NO: 49256, SEQ ID NO: 49263, SEQ ID NOs: 49273 to 49274, SEQ ID NOs: 49280 to 49281, SEQ ID NO: 49291, SEQ ID NOs: 49294 to 49295, SEQ ID NO: 49298, SEQ ID NO: 49309, SEQ ID NO: 49319, SEQ ID NO: 49326, SEQ ID NO: 49330, SEQ ID NO: 49340, SEQ ID NOs: 49351 to 49352, SEQ ID NO: 49360, SEQ ID NOs: 49376 to 49377, SEQ ID NO: 49384, SEQ ID NO: 49393, SEQ ID NO: 49395, SEQ ID NO: 49399, SEQ ID NO: 49406, SEQ ID NO: 49411, SEQ ID NOs: 49443 to 49444, SEQ ID NO: 49452, SEQ ID NO: 49462, SEQ ID NO: 49474, SEQ ID NO: 49487, SEQ ID NO: 49499, SEQ ID NO: 49525, SEQ ID NO: 49537, SEQ ID NO: 49540, SEQ ID NO: 49557, SEQ ID NO: 49572, SEQ ID NO: 49584, SEQ ID NO: 49597, SEQ ID NO: 49626, SEQ ID NO: 49630, SEQ ID NO: 49646, SEQ ID NO: 49658, SEQ ID NO: 49671, SEQ ID NO: 49681, SEQ ID NO: 49703, SEQ ID NO: 49728, SEQ ID NO: 49730, SEQ ID NO: 49737, SEQ ID NOs: 49742 to 49743, SEQ ID NOs: 49766 to 49767, SEQ ID NO: 49772, SEQ ID NO: 49782, SEQ ID NOs: 49787 to 49788, SEQ ID NO: 49793, SEQ ID NO: 49796, SEQ ID NO: 49805, SEQ ID NO: 49811, SEQ ID NO: 49823, SEQ ID NO: 49838, SEQ ID NO: 49850, SEQ ID NOs: 49859 to 49860, SEQ ID NO: 49873, SEQ ID NO: 49883, SEQ ID NO: 49892, SEQ ID NO: 49912, SEQ ID NO: 49928, SEQ ID NO: 49948, SEQ ID NO: 49961, SEQ ID NO: 49965, SEQ ID NO: 49987, SEQ ID NO: 49997, SEQ ID NOs: 50017 to 50018, SEQ ID NO: 50020, SEQ ID NO: 50022, SEQ ID NO: 50045, SEQ ID NO: 50062, SEQ ID NO: 50073, SEQ ID NO: 50079, SEQ ID NO: 50090, SEQ ID NO: 50107, SEQ ID NOs: 50111 to 50112, SEQ ID NO: 50123, SEQ ID NO: 50138, SEQ ID NOs: 50165 to 50167, SEQ ID NOs: 50227 to 50228, SEQ ID NOs: 50243, SEQ ID NO: 50250, SEQ ID NO: 50254, SEQ ID NO: 50282, SEQ ID NO: 50284, SEQ ID NO: 50290, SEQ ID NO: 50297, SEQ ID NO: 50305, SEQ ID NO: 50309, SEQ ID NO: 50319, SEQ ID NO: 50331, SEQ ID NO: 50334, SEQ ID NO: 50339, SEQ ID NO: 50366, SEQ ID NO: 50388, SEQ ID NO: 50392, SEQ ID NO: 50394, SEQ ID NOs: 50400 to 50401, SEQ ID NO: 50418, SEQ ID NO: 50423, SEQ ID NO: 50428, SEQ ID NO: 50437, SEQ ID NO: 50443, SEQ ID NO: 50450, SEQ ID NO: 50464, SEQ ID NO: 50485, SEQ ID NO: 50494, SEQ ID NO: 50496, SEQ ID NO: 50499, SEQ ID NO: 50526, SEQ ID NO: 50528, SEQ ID NO: 50532, SEQ ID NO: 50538, SEQ ID NO: 50554, SEQ ID NO: 50557, SEQ ID NO: 50560, SEQ ID NO: 50564, SEQ ID NO: 50574, SEQ ID NO: 50585, SEQ ID NO: 50617, SEQ ID NO: 50632, SEQ ID NO: 50634, SEQ ID NO: 50644, SEQ ID NO: 50654, SEQ ID NO: 50678, SEQ ID NO: 50699, SEQ ID NO: 50714, SEQ ID NOs: 50728 to 50729, SEQ ID NO: 50735, SEQ ID NO: 50741, SEQ ID NO: 50744, SEQ ID NO: 50765, SEQ ID NO: 50769, SEQ ID NO: 50793, SEQ ID NO: 50818, SEQ ID NO: 50822, SEQ ID NO: 50826, SEQ ID NO: 50835, SEQ ID NO: 50842, SEQ ID NO: 50847, SEQ ID NO: 50849, SEQ ID NO: 50851, SEQ ID NO: 50893, SEQ ID NO: 50918, SEQ ID NOs: 50935 to 50936, SEQ ID NOs: 50941 to 50944, SEQ ID NOs: 50960 to 50962, SEQ ID NOs: 50975 to 50976, SEQ ID NOs: 51008 to 51009, SEQ ID NO: 51012, SEQ ID NOs: 51021 to 51022, SEQ ID NO: 51046, SEQ ID NO: 51062, SEQ ID NOs: 51068 to 51071, SEQ ID NOs: 51102 to 51104, SEQ ID NO: 51118, SEQ ID NOs: 51168 to 51169, SEQ ID NO: 51214, SEQ ID NO: 51235, SEQ ID NO: 51239, SEQ ID NO: 51241, SEQ ID NO: 51243, SEQ ID NO: 51257, SEQ ID NOs: 51263 to 51266, SEQ ID NOs: 51295 to 51297, SEQ ID NO: 51313, SEQ ID NO: 51405, SEQ ID NOs: 51413 to 51417, SEQ ID NO: 51524, SEQ ID NO: 51526, SEQ ID NO: 51693, SEQ ID NO: 51717, SEQ ID NO: 51762, SEQ ID NO: 51765, SEQ ID NO: 51853, SEQ ID NO: 51878, SEQ ID NO: 52035, SEQ ID NO: 52179, SEQ ID NO: 52275, SEQ ID NO: 52290, SEQ ID NO: 52379, SEQ ID NO: 52463, SEQ ID NO: 52497, SEQ ID NO: 52515, SEQ ID NO: 52652, SEQ ID NO: 52660, SEQ ID NO: 52679, SEQ ID NO: 52686, SEQ ID NO: 52746, SEQ ID NO: 52758, SEQ ID NO: 52816, SEQ ID NO: 52944, SEQ ID NO: 52984, SEQ ID NO: 52988, SEQ ID NO: 52991, SEQ ID NO: 53045, SEQ ID NO: 53118, SEQ ID NO: 53166, SEQ ID NO: 53338, SEQ ID NO: 53382, SEQ ID NO: 53464, SEQ ID NO: 53478, SEQ ID NO: 53511, SEQ ID NO: 53519, SEQ ID NO: 53548, SEQ ID NO: 53581, SEQ ID NO: 53653, SEQ ID NO: 53968, SEQ ID NO: 54024, SEQ ID NO: 54038, SEQ ID NO: 54045, SEQ ID NO: 54080, SEQ ID NO: 54097, SEQ ID NO: 54111, SEQ ID NO: 54238, SEQ ID NO: 54251, SEQ ID NO: 54269, SEQ ID NO: 54409, SEQ ID NO: 54418, SEQ ID NO: 54442, SEQ ID NO: 54473, SEQ ID NO: 54543, SEQ ID NO: 54713, SEQ ID NO: 54719, SEQ ID NO: 54727, SEQ ID NO: 54772, SEQ ID NO: 54788, SEQ ID NO: 54863, SEQ ID NO: 54877, SEQ ID NO: 54945, SEQ ID NO: 54960, SEQ ID NO: 55004, SEQ ID NO: 55109, SEQ ID NO: 55207, SEQ ID NO: 55230, SEQ ID NO: 55300, SEQ ID NO: 55355, SEQ ID NO: 55437, SEQ ID NO: 55516, SEQ ID NO: 55695, SEQ ID NO: 55758, SEQ ID NO: 55801, SEQ ID NO: 55814, SEQ ID NO: 55875, SEQ ID NO: 55879, SEQ ID NO: 55886, SEQ ID NO: 55911, SEQ ID NO: 55986, SEQ ID NO: 56043, SEQ ID NO: 56052, SEQ ID NO: 56175, SEQ ID NO: 56240, SEQ ID NO: 56277, SEQ ID NO: 56352, SEQ ID NO: 56418, SEQ ID NO: 56435, SEQ ID NO: 56521, SEQ ID NO: 56593, SEQ ID NO: 56609, SEQ ID NO: 56629, SEQ ID NOs: 56649 to 56650, SEQ ID NO: 56793, SEQ ID NO: 56836, SEQ ID NO: 56852, SEQ ID NO: 56902, SEQ ID NO: 57155, SEQ ID NO: 57157, SEQ ID NO: 57265, SEQ ID NO: 57278, SEQ ID NO: 57323, SEQ ID NO: 57472, SEQ ID NO: 57535, SEQ ID NO: 57550, SEQ ID NO: 57561, SEQ ID NO: 57568, SEQ ID NO: 57639, SEQ ID NO: 57655, SEQ ID NO: 57790, SEQ ID NO: 57811, SEQ ID NO: 57904, SEQ ID NO: 57944, SEQ ID NO: 58040, SEQ ID NO: 58064, SEQ ID NO: 58075, SEQ ID NO: 58145, SEQ ID NO: 58199, SEQ ID NO: 58223, SEQ ID NO: 58226, SEQ ID NO: 58309, SEQ ID NO: 58349, SEQ ID NO: 58395, SEQ ID NO: 58411, SEQ ID NO: 58433, SEQ ID NO: 58547, SEQ ID NO: 58589, SEQ ID NO: 58679, SEQ ID NOs: 58683 to 58684, SEQ ID NO: 58815, SEQ ID NO: 58823, SEQ ID NO: 58855, SEQ ID NO: 58932, SEQ ID NO: 59223, SEQ ID NO: 59246, SEQ ID NO: 59248, SEQ ID NO: 59530, SEQ ID NO: 59622, SEQ ID NO: 59755, SEQ ID NO: 59757, SEQ ID NO: 59775, SEQ ID NO: 59816, SEQ ID NO: 59821, SEQ ID NO: 59828, SEQ ID NO: 59856, SEQ ID NO: 59871, SEQ ID NO: 59873, SEQ ID NO: 59875, SEQ ID NO: 59960, SEQ ID NO: 59967, SEQ ID NO: 60005, SEQ ID NOs: 60046 to 60047, SEQ ID NO: 60081, SEQ ID NO: 60224, SEQ ID NO: 60228, SEQ ID NO: 60276, SEQ ID NO: 60289, SEQ ID NO: 60292, SEQ ID NOs: 60422 to 60423, SEQ ID NO: 60444, and SEQ ID NOs: 60456 to 68237. In some embodiments, any one of the peptides in the MAGA4 vaccine comprise an amino acid sequence 80, 81, 82, 83, 84, 85, 86, 87, 88, 89, 90, 91, 92, 93, 94, 95, 96, 97, 98 or 99% identical to SEQ ID NO: 41345, SEQ ID NO: 41347, SEQ ID NO: 41352, SEQ ID NOs: 41357 to 41358, SEQ ID NO: 41366, SEQ ID NO: 41377, SEQ ID NO: 41382, SEQ ID NO: 41392, SEQ ID NO: 41396, SEQ ID NO: 41398, SEQ ID NO: 41406, SEQ ID NO: 41411, SEQ ID NO: 41414, SEQ ID NO: 41433, SEQ ID NO: 41436, SEQ ID NO: 41445, SEQ ID NO: 41449, SEQ ID NO: 41455, SEQ ID NO: 41478, SEQ ID NO: 41487, SEQ ID NOs: 41495 to 41496, SEQ ID NO: 41503, SEQ ID NO: 41515, SEQ ID NO: 41520, SEQ ID NO: 41529, SEQ ID NO: 41549, SEQ ID NO: 41553, SEQ ID NO: 41562, SEQ ID NO: 41569, SEQ ID NO: 41574, SEQ ID NO: 41576, SEQ ID NO: 41579, SEQ ID NOs: 41587 to 41588, SEQ ID NO: 41605, SEQ ID NO: 41617, SEQ ID NO: 41620, SEQ ID NO: 41634, SEQ ID NO: 41650, SEQ ID NO: 41665, SEQ ID NO: 41670, SEQ ID NO: 41672, SEQ ID NO: 41696, SEQ ID NO: 41703, SEQ ID NO: 41709, SEQ ID NO: 41725, SEQ ID NOs: 41732 to 41733, SEQ ID NO: 41748, SEQ ID NO: 41760, SEQ ID NO: 41766, SEQ ID NO: 41768, SEQ ID NO: 41770, SEQ ID NO: 41779, SEQ ID NO: 41791, SEQ ID NO: 41797, SEQ ID NO: 41813, SEQ ID NO: 41819, SEQ ID NO: 41825, SEQ ID NO: 41829, SEQ ID NOs: 41846 to 41847, SEQ ID NO: 41853, SEQ ID NO: 41876, SEQ ID NO: 41889, SEQ ID NO: 41892, SEQ ID NO: 41897, SEQ ID NOs: 41906 to 41907, SEQ ID NO: 41912, SEQ ID NO: 41924, SEQ ID NO: 41940, SEQ ID NO: 41953, SEQ ID NO: 41956, SEQ ID NO: 41967, SEQ ID NO: 41970, SEQ ID NO: 41976, SEQ ID NO: 41985, SEQ ID NO: 41990, SEQ ID NO: 42014, SEQ ID NO: 42017, SEQ ID NO: 42026, SEQ ID NO: 42034, SEQ ID NO: 42037, SEQ ID NO: 42046, SEQ ID NO: 42048, SEQ ID NOs: 42056 to 42057, SEQ ID NO: 42080, SEQ ID NO: 42088, SEQ ID NO: 42091, SEQ ID NO: 42102, SEQ ID NO: 42106, SEQ ID NO: 42115, SEQ ID NO: 42120, SEQ ID NO: 42129, SEQ ID NO: 42135, SEQ ID NO: 42138, SEQ ID NO: 42151, SEQ ID NO: 42158, SEQ ID NOs: 42163 to 42164, SEQ ID NOs: 42167 to 42168, SEQ ID NO: 42170, SEQ ID NO: 42186, SEQ ID NO: 42192, SEQ ID NO: 42195, SEQ ID NO: 42198, SEQ ID NO: 42204, SEQ ID NO: 42209, SEQ ID NO: 42218, SEQ ID NO: 42221, SEQ ID NO: 42224, SEQ ID NO: 42229, SEQ ID NO: 42240, SEQ ID NO: 42263, SEQ ID NO: 42265, SEQ ID NO: 42270, SEQ ID NO: 42316, SEQ ID NOs: 42336 to 42337, SEQ ID NO: 42339, SEQ ID NO: 42351, SEQ ID NO: 42354, SEQ ID NO: 42372, SEQ ID NO: 42378, SEQ ID NOs: 42385 to 42386, SEQ ID NO: 42394, SEQ ID NO: 42405, SEQ ID NO: 42409, SEQ ID NO: 42417, SEQ ID NO: 42423, SEQ ID NO: 42439, SEQ ID NO: 42447, SEQ ID NO: 42453, SEQ ID NO: 42458, SEQ ID NOs: 42460 to 42461, SEQ ID NO: 42466, SEQ ID NOs: 42472 to 42473, SEQ ID NOs: 42519 to 42520, SEQ ID NO: 42525, SEQ ID NO: 42528, SEQ ID NO: 42540, SEQ ID NO: 42545, SEQ ID NO: 42550, SEQ ID NOs: 42563 to 42564, SEQ ID NO: 42580, SEQ ID NO: 42605, SEQ ID NO: 42609, SEQ ID NOs: 42612 to 42613, SEQ ID NO: 42615, SEQ ID NO: 42628, SEQ ID NO: 42637, SEQ ID NO: 42648, SEQ ID NO: 42653, SEQ ID NO: 42675, SEQ ID NO: 42680, SEQ ID NO: 42685, SEQ ID NO: 42696, SEQ ID NO: 42703, SEQ ID NO: 42719, SEQ ID NO: 42735, SEQ ID NO: 42743, SEQ ID NO: 42748, SEQ ID NO: 42750, SEQ ID NO: 42768, SEQ ID NO: 42812, SEQ ID NO: 42814, SEQ ID NO: 42822, SEQ ID NO: 42827, SEQ ID NO: 42831, SEQ ID NO: 42846, SEQ ID NO: 42850, SEQ ID NO: 42872, SEQ ID NO: 42886, SEQ ID NO: 42911, SEQ ID NO: 42914, SEQ ID NO: 42923, SEQ ID NO: 42927, SEQ ID NOs: 42957 to 42958, SEQ ID NO: 42962, SEQ ID NO: 42971, SEQ ID NOs: 42997 to 42998, SEQ ID NO: 43002, SEQ ID NO: 43008, SEQ ID NO: 43035, SEQ ID NO: 43046, SEQ ID NO: 43048, SEQ ID NO: 43064, SEQ ID NO: 43083, SEQ ID NO: 43091, SEQ ID NO: 43093, SEQ ID NO: 43148, SEQ ID NO: 43160, SEQ ID NO: 43170, SEQ ID NO: 43175, SEQ ID NO: 43180, SEQ ID NO: 43186, SEQ ID NO: 43193, SEQ ID NO: 43196, SEQ ID NOs: 43231 to 43232, SEQ ID NO: 43238, SEQ ID NO: 43242, SEQ ID NO: 43248, SEQ ID NO: 43253, SEQ ID NO: 43258, SEQ ID NO: 43267, SEQ ID NO: 43274, SEQ ID NO: 43280, SEQ ID NO: 43285, SEQ ID NO: 43295, SEQ ID NO: 43308, SEQ ID NO: 43311, SEQ ID NO: 43329, SEQ ID NO: 43333, SEQ ID NOs: 43339 to 43340, SEQ ID NO: 43362, SEQ ID NO: 43365, SEQ ID NO: 43384, SEQ ID NO: 43389, SEQ ID NO: 43395, SEQ ID NO: 43401, SEQ ID NO: 43429, SEQ ID NO: 43432, SEQ ID NO: 43440, SEQ ID NOs: 43451 to 43453, SEQ ID NO: 43462, SEQ ID NO: 43464, SEQ ID NO: 43467, SEQ ID NO: 43479, SEQ ID NO: 43482, SEQ ID NO: 43496, SEQ ID NO: 43511, SEQ ID NO: 43513, SEQ ID NO: 43517, SEQ ID NO: 43545, SEQ ID NO: 43564, SEQ ID NO: 43573, SEQ ID NO: 43585, SEQ ID NO: 43587, SEQ ID NO: 43591, SEQ ID NO: 43611, SEQ ID NO: 43632, SEQ ID NO: 43636, SEQ ID NO: 43641, SEQ ID NO: 43643, SEQ ID NO: 43651, SEQ ID NO: 43669, SEQ ID NO: 43688, SEQ ID NO: 43696, SEQ ID NO: 43700, SEQ ID NO: 43703, SEQ ID NO: 43707, SEQ ID NO: 43718, SEQ ID NO: 43760, SEQ ID NO: 43763, SEQ ID NO: 43768, SEQ ID NO: 43777, SEQ ID NO: 43780, SEQ ID NO: 43787, SEQ ID NO: 43801, SEQ ID NO: 43808, SEQ ID NO: 43810, SEQ ID NO: 43825, SEQ ID NO: 43827, SEQ ID NO: 43836, SEQ ID NO: 43860, SEQ ID NO: 43867, SEQ ID NOs: 43881 to 43882, SEQ ID NO: 43884, SEQ ID NO: 43887, SEQ ID NOs: 43898 to 43899, SEQ ID NO: 43905, SEQ ID NO: 43915, SEQ ID NO: 43924, SEQ ID NO: 43932, SEQ ID NO: 43958, SEQ ID NO: 43971, SEQ ID NO: 43974, SEQ ID NO: 43978, SEQ ID NOs: 43982 to 43984, SEQ ID NOs: 43986 to 43987, SEQ ID NO: 43993, SEQ ID NO: 43995, SEQ ID NO: 44012, SEQ ID NO: 44035, SEQ ID NO: 44037, SEQ ID NO: 44048, SEQ ID NO: 44050, SEQ ID NO: 44052, SEQ ID NO: 44055, SEQ ID NO: 44063, SEQ ID NO: 44073, SEQ ID NO: 44080, SEQ ID NO: 44085, SEQ ID NO: 44087, SEQ ID NO: 44089, SEQ ID NO: 44112, SEQ ID NO: 44117, SEQ ID NO: 44123, SEQ ID NOs: 44151 to 44152, SEQ ID NO: 44160, SEQ ID NO: 44181, SEQ ID NO: 44207, SEQ ID NO: 44210, SEQ ID NO: 44244, SEQ ID NO: 44246, SEQ ID NO: 44254, SEQ ID NO: 44263, SEQ ID NOs: 44298 to 44299, SEQ ID NO: 44309, SEQ ID NO: 44324, SEQ ID NO: 44328, SEQ ID NO: 44342, SEQ ID NO: 44345, SEQ ID NO: 44359, SEQ ID NO: 44361, SEQ ID NO: 44383, SEQ ID NO: 44401, SEQ ID NO: 44422, SEQ ID NO: 44440, SEQ ID NO: 44452, SEQ ID NO: 44454, SEQ ID NO: 44456, SEQ ID NO: 44463, SEQ ID NO: 44467, SEQ ID NO: 44485, SEQ ID NO: 44512, SEQ ID NO: 44523, SEQ ID NO: 44545, SEQ ID NO: 44552, SEQ ID NO: 44564, SEQ ID NOs: 44566 to 44567, SEQ ID NOs: 44589 to 44591, SEQ ID NO: 44615, SEQ ID NO: 44623, SEQ ID NO: 44631, SEQ ID NO: 44636, SEQ ID NO: 44649, SEQ ID NO: 44654, SEQ ID NO: 44691, SEQ ID NO: 44713, SEQ ID NO: 44722, SEQ ID NO: 44730, SEQ ID NO: 44754, SEQ ID NO: 44756, SEQ ID NOs: 44762 to 44763, SEQ ID NO: 44773, SEQ ID NO: 44781, SEQ ID NO: 44794, SEQ ID NO: 44850, SEQ ID NOs: 44873 to 44875, SEQ ID NO: 44877, SEQ ID NO: 44884, SEQ ID NO: 44908, SEQ ID NO: 44913, SEQ ID NO: 44940, SEQ ID NO: 44955, SEQ ID NO: 44964, SEQ ID NO: 44971, SEQ ID NO: 44976, SEQ ID NO: 45000, SEQ ID NO: 45027, SEQ ID NO: 45035, SEQ ID NO: 45060, SEQ ID NO: 45062, SEQ ID NO: 45095, SEQ ID NO: 45123, SEQ ID NOs: 45126 to 45127, SEQ ID NO: 45132, SEQ ID NO: 45135, SEQ ID NOs: 45138 to 45139, SEQ ID NO: 45193, SEQ ID NO: 45197, SEQ ID NO: 45200, SEQ ID NO: 45223, SEQ ID NO: 45225, SEQ ID NO: 45244, SEQ ID NO: 45262, SEQ ID NO: 45273, SEQ ID NO: 45292, SEQ ID NO: 45302, SEQ ID NO: 45306, SEQ ID NO: 45314, SEQ ID NO: 45380, SEQ ID NO: 45385, SEQ ID NO: 45389, SEQ ID NO: 45398, SEQ ID NO: 45409, SEQ ID NO: 45438, SEQ ID NO: 45444, SEQ ID NOs: 45450 to 45451, SEQ ID NO: 45478, SEQ ID NO: 45480, SEQ ID NO: 45485, SEQ ID NO: 45490, SEQ ID NO: 45510, SEQ ID NO: 45514, SEQ ID NOs: 45519 to 45520, SEQ ID NO: 45530, SEQ ID NO: 45541, SEQ ID NO: 45552, SEQ ID NO: 45556, SEQ ID NOs: 45562 to 45563, SEQ ID NO: 45568, SEQ ID NO: 45577, SEQ ID NOs: 45580 to 45581, SEQ ID NO: 45584, SEQ ID NO: 45588, SEQ ID NO: 45595, SEQ ID NO: 45599, SEQ ID NO: 45632, SEQ ID NO: 45653, SEQ ID NOs: 45666 to 45667, SEQ ID NO: 45675, SEQ ID NO: 45680, SEQ ID NO: 45687, SEQ ID NO: 45697, SEQ ID NOs: 45699 to 45700, SEQ ID NO: 45712, SEQ ID NO: 45714, SEQ ID NO: 45723, SEQ ID NO: 45746, SEQ ID NO: 45765, SEQ ID NO: 45787, SEQ ID NO: 45793, SEQ ID NO: 45818, SEQ ID NO: 45826, SEQ ID NOs: 45829 to 45830, SEQ ID NO: 45835, SEQ ID NO: 45837, SEQ ID NO: 45846, SEQ ID NO: 45859, SEQ ID NO: 45885, SEQ ID NO: 45894, SEQ ID NO: 45904, SEQ ID NO: 45915, SEQ ID NO: 45930, SEQ ID NO: 45938, SEQ ID NO: 45959, SEQ ID NO: 45983, SEQ ID NO: 46006, SEQ ID NO: 46011, SEQ ID NO: 46014, SEQ ID NO: 46044, SEQ ID NO: 46049, SEQ ID NO: 46054, SEQ ID NO: 46058, SEQ ID NO: 46063, SEQ ID NO: 46071, SEQ ID NO: 46077, SEQ ID NO: 46096, SEQ ID NO: 46103, SEQ ID NO: 46108, SEQ ID NO: 46110, SEQ ID NO: 46125, SEQ ID NO: 46133, SEQ ID NOs: 46170 to 46171, SEQ ID NO: 46195, SEQ ID NO: 46208, SEQ ID NO: 46212, SEQ ID NO: 46219, SEQ ID NO: 46226, SEQ ID NO: 46234, SEQ ID NO: 46236, SEQ ID NO: 46261, SEQ ID NO: 46270, SEQ ID NO: 46273, SEQ ID NO:

46275, SEQ ID NO: 46339, SEQ ID NO: 46364, SEQ ID NO: 46376, SEQ ID NOs: 46400 to 46401, SEQ ID NOs: 46421 to 46422, SEQ ID NO: 46433, SEQ ID NOs: 46442 to 46443, SEQ ID NO: 46446, SEQ ID NOs: 46452 to 46454, SEQ ID NO: 46457, SEQ ID NO: 46459, SEQ ID NO: 46462, SEQ ID NO: 46465, SEQ ID NO: 46478, SEQ ID NO: 46484, SEQ ID NO: 46489, SEQ ID NO: 46499, SEQ ID NO: 46512, SEQ ID NO: 46521, SEQ ID NO: 46530, SEQ ID NO: 46536, SEQ ID NO: 46560, SEQ ID NO: 46564, SEQ ID NO: 46570, SEQ ID NO: 46572, SEQ ID NO: 46575, SEQ ID NO: 46579, SEQ ID NO: 46586, SEQ ID NO: 46602, SEQ ID NO: 46616, SEQ ID NO: 46621, SEQ ID NO: 46628, SEQ ID NO: 46637, SEQ ID NO: 46642, SEQ ID NO: 46648, SEQ ID NO: 46652, SEQ ID NO: 46655, SEQ ID NO: 46660, SEQ ID NO: 46663, SEQ ID NOs: 46665 to 46666, SEQ ID NO: 46676, SEQ ID NOs: 46678 to 46679, SEQ ID NO: 46682, SEQ ID NO: 46685, SEQ ID NO: 46689, SEQ ID NO: 46713, SEQ ID NO: 46715, SEQ ID NO: 46736, SEQ ID NO: 46739, SEQ ID NO: 46770, SEQ ID NO: 46777, SEQ ID NO: 46800, SEQ ID NOs: 46823 to 46825, SEQ ID NO: 46831, SEQ ID NO: 46872, SEQ ID NO: 46880, SEQ ID NO: 46897, SEQ ID NO: 46916, SEQ ID NO: 46928, SEQ ID NO: 46937, SEQ ID NO: 46950, SEQ ID NO: 46978, SEQ ID NO: 46981, SEQ ID NO: 46983, SEQ ID NO: 46989, SEQ ID NO: 46991, SEQ ID NO: 46993, SEQ ID NO: 47003, SEQ ID NO: 47006, SEQ ID NO: 47017, SEQ ID NO: 47028, SEQ ID NO: 47045, SEQ ID NO: 47047, SEQ ID NO: 47057, SEQ ID NOs: 47079 to 47080, SEQ ID NO: 47082, SEQ ID NO: 47114, SEQ ID NO: 47119, SEQ ID NO: 47123, SEQ ID NOs: 47137 to 47139, SEQ ID NO: 47151, SEQ ID NO: 47158, SEQ ID NO: 47167, SEQ ID NO: 47172, SEQ ID NO: 47186, SEQ ID NO: 47191, SEQ ID NO: 47206, SEQ ID NO: 47224, SEQ ID NO: 47298, SEQ ID NO: 47316, SEQ ID NO: 47324, SEQ ID NOs: 47331 to 47332, SEQ ID NO: 47335, SEQ ID NO: 47356, SEQ ID NO: 47358, SEQ ID NOs: 47360 to 47361, SEQ ID NOs: 47377 to 47378, SEQ ID NO: 47381, SEQ ID NO: 47405, SEQ ID NO: 47412, SEQ ID NO: 47416, SEQ ID NO: 47422, SEQ ID NO: 47425, SEQ ID NO: 47427, SEQ ID NOs: 47432 to 47433, SEQ ID NO: 47445, SEQ ID NO: 47451, SEQ ID NO: 47460, SEQ ID NO: 47482, SEQ ID NO: 47491, SEQ ID NO: 47509, SEQ ID NO: 47516, SEQ ID NOs: 47533 to 47535, SEQ ID NOs: 47538 to 47539, SEQ ID NO: 47555, SEQ ID NO: 47561, SEQ ID NOs: 47575 to 47576, SEQ ID NO: 47582, SEQ ID NO: 47592, SEQ ID NO: 47614, SEQ ID NO: 47625, SEQ ID NO: 47630, SEQ ID NO: 47637, SEQ ID NO: 47643, SEQ ID NO: 47654, SEQ ID NO: 47673, SEQ ID NO: 47689, SEQ ID NO: 47698, SEQ ID NO: 47701, SEQ ID NO: 47727, SEQ ID NO: 47749, SEQ ID NOs: 47759 to 47760, SEQ ID NO: 47767, SEQ ID NO: 47773, SEQ ID NO: 47782, SEQ ID NO: 47790, SEQ ID NO: 47793, SEQ ID NO: 47799, SEQ ID NO: 47806, SEQ ID NO: 47809, SEQ ID NO: 47834, SEQ ID NO: 47840, SEQ ID NO: 47844, SEQ ID NO: 47848, SEQ ID NO: 47855, SEQ ID NO: 47867, SEQ ID NO: 47890, SEQ ID NO: 47895, SEQ ID NO: 47899, SEQ ID NO: 47902, SEQ ID NO: 47923, SEQ ID NO: 47927, SEQ ID NOs: 47959 to 47960, SEQ ID NO: 47964, SEQ ID NO: 47979, SEQ ID NO: 47984, SEQ ID NO: 47986, SEQ ID NOs: 48030 to 48031, SEQ ID NO: 48034, SEQ ID NO: 48059, SEQ ID NO: 48093, SEQ ID NO: 48107, SEQ ID NO: 48113, SEQ ID NO: 48118, SEQ ID NO: 48121, SEQ ID NO: 48129, SEQ ID NOs: 48138 to 48139, SEQ ID NO: 48144, SEQ ID NO: 48158, SEQ ID NO: 48160, SEQ ID NO: 48162, SEQ ID NO: 48175, SEQ ID NO: 48186, SEQ ID NO: 48203, SEQ ID NO: 48210, SEQ ID NO: 48213, SEQ ID NO: 48220, SEQ ID NO: 48224, SEQ ID NO: 48229, SEQ ID NO: 48258, SEQ ID NO: 48266, SEQ ID NO: 48273, SEQ ID NO: 48280, SEQ ID NO: 48286, SEQ ID NO: 48295, SEQ ID NOs: 48300 to 48301, SEQ ID NOs: 48306 to 48307, SEQ ID NO: 48315, SEQ ID NO: 48347, SEQ ID NO: 48353, SEQ ID NO: 48358, SEQ ID NO: 48366, SEQ ID NO: 48371, SEQ ID NO: 48379, SEQ ID NO: 48387, SEQ ID NO: 48400, SEQ ID NO: 48415, SEQ ID NOs: 48418 to 48419, SEQ ID NO: 48436, SEQ ID NOs: 48438 to 48440, SEQ ID NO: 48443, SEQ ID NO: 48452, SEQ ID NOs: 48461 to 48462, SEQ ID NO: 48466, SEQ ID NO: 48469, SEQ ID NO: 48520, SEQ ID NO: 48537, SEQ ID NO: 48545, SEQ ID NO: 48574, SEQ ID NOs: 48576 to 48578, SEQ ID NO: 48594, SEQ ID NO: 48599, SEQ ID NO: 48614, SEQ ID NO: 48627, SEQ ID NO: 48642, SEQ ID NO: 48648, SEQ ID NO: 48654, SEQ ID NO: 48656, SEQ ID NO: 48666, SEQ ID NOs: 48669 to 48670, SEQ ID NO: 48674, SEQ ID NOs: 48680 to 48681, SEQ ID NO: 48684, SEQ ID NO: 48686, SEQ ID NO: 48692, SEQ ID NO: 48701, SEQ ID NO: 48705, SEQ ID NO: 48714, SEQ ID NO: 48717, SEQ ID NO: 48735, SEQ ID NO: 48738, SEQ ID NO: 48749, SEQ ID NO: 48751, SEQ ID NO: 48764, SEQ ID NO: 48769, SEQ ID NO: 48793, SEQ ID NO: 48796, SEQ ID NOs: 48799 to 48800, SEQ ID NOs: 48802 to 48803, SEQ ID NO: 48818, SEQ ID NO: 48832, SEQ ID NO: 48834, SEQ ID NO: 48838, SEQ ID NO: 48845, SEQ ID NO: 48856, SEQ ID NO: 48877, SEQ ID NO: 48884, SEQ ID NO: 48903, SEQ ID NO: 48936, SEQ ID NO: 48947, SEQ ID NOs: 48968 to 48970, SEQ ID NO: 48974, SEQ ID NOs: 48981 to 48982, SEQ ID NO: 48997, SEQ ID NOs: 49013 to 49014, SEQ ID NOs: 49019 to 49020, SEQ ID NO: 49031, SEQ ID NO: 49033, SEQ ID NO: 49043, SEQ ID NO: 49052, SEQ ID NOs: 49061 to 49062, SEQ ID NO: 49068, SEQ ID NO: 49071, SEQ ID NO: 49086, SEQ ID NO: 49102, SEQ ID NO: 49111, SEQ ID NO: 49156, SEQ ID NO: 49164, SEQ ID NO: 49173, SEQ ID NO: 49176, SEQ ID NO: 49183, SEQ ID NO: 49185, SEQ ID NOs: 49200 to 49201, SEQ ID NO: 49209, SEQ ID NO: 49220, SEQ ID NO: 49247, SEQ ID NO: 49251, SEQ ID NO: 49256, SEQ ID NO: 49263, SEQ ID NOs: 49273 to 49274, SEQ ID NOs: 49280 to 49281, SEQ ID NO: 49291, SEQ ID NOs: 49294 to 49295, SEQ ID NO: 49298, SEQ ID NO: 49309, SEQ ID NO: 49319, SEQ ID NO: 49326, SEQ ID NO: 49330, SEQ ID NO: 49340, SEQ ID NOs: 49351 to 49352, SEQ ID NO: 49360, SEQ ID NOs: 49376 to 49377, SEQ ID NO: 49384, SEQ ID NO: 49393, SEQ ID NO: 49395, SEQ ID NO: 49399, SEQ ID NO: 49406, SEQ ID NO: 49411, SEQ ID NOs: 49443 to 49444, SEQ ID NO: 49452, SEQ ID NO: 49462, SEQ ID NO: 49474, SEQ ID NO: 49487, SEQ ID NO: 49499, SEQ ID NO: 49525, SEQ ID NO: 49537, SEQ ID NO: 49540, SEQ ID NO: 49557, SEQ ID NO: 49572, SEQ ID NO: 49584, SEQ ID NO: 49597, SEQ ID NO: 49626, SEQ ID NO: 49630, SEQ ID NO: 49646, SEQ ID NO: 49658, SEQ ID NO: 49671, SEQ ID NO: 49681, SEQ ID NO: 49703, SEQ ID NO: 49728, SEQ ID NO: 49730, SEQ ID NO: 49737, SEQ ID NOs: 49742 to 49743, SEQ ID NOs: 49766 to 49767, SEQ ID NO: 49772, SEQ ID NO: 49782, SEQ ID NOs: 49787 to 49788, SEQ ID NO: 49793, SEQ ID NO: 49796, SEQ ID NO: 49805, SEQ ID NO: 49811, SEQ ID NO: 49823, SEQ ID NO: 49838, SEQ ID NO: 49850, SEQ ID NOs: 49859 to 49860, SEQ ID NO: 49873, SEQ ID NO: 49883, SEQ ID NO: 49892, SEQ ID NO: 49912, SEQ ID NO: 49928, SEQ ID NO: 49948, SEQ ID NO: 49961, SEQ ID NO: 49965, SEQ ID NO: 49987, SEQ ID NO: 49997, SEQ ID NOs: 50017 to 50018, SEQ ID NO: 50020, SEQ ID NO: 50022, SEQ ID NO: 50045, SEQ

ID NO: 50062, SEQ ID NO: 50073, SEQ ID NO: 50079, SEQ ID NO: 50090, SEQ ID NO: 50107, SEQ ID NOs: 50111 to 50112, SEQ ID NO: 50123, SEQ ID NO: 50138, SEQ ID NOs: 50165 to 50167, SEQ ID NOs: 50227 to 50228, SEQ ID NO: 50243, SEQ ID NO: 50250, SEQ ID NO: 50254, SEQ ID NO: 50282, SEQ ID NO: 50284, SEQ ID NO: 50290, SEQ ID NO: 50297, SEQ ID NO: 50305, SEQ ID NO: 50309, SEQ ID NO: 50319, SEQ ID NO: 50331, SEQ ID NO: 50334, SEQ ID NO: 50339, SEQ ID NO: 50366, SEQ ID NO: 50388, SEQ ID NO: 50392, SEQ ID NO: 50394, SEQ ID NOs: 50400 to 50401, SEQ ID NO: 50418, SEQ ID NO: 50423, SEQ ID NO: 50428, SEQ ID NO: 50437, SEQ ID NO: 50443, SEQ ID NO: 50450, SEQ ID NO: 50464, SEQ ID NO: 50485, SEQ ID NO: 50494, SEQ ID NO: 50496, SEQ ID NO: 50499, SEQ ID NO: 50526, SEQ ID NO: 50528, SEQ ID NO: 50532, SEQ ID NO: 50538, SEQ ID NO: 50554, SEQ ID NO: 50557, SEQ ID NO: 50560, SEQ ID NO: 50564, SEQ ID NO: 50574, SEQ ID NO: 50585, SEQ ID NO: 50617, SEQ ID NO: 50632, SEQ ID NO: 50634, SEQ ID NO: 50644, SEQ ID NO: 50654, SEQ ID NO: 50678, SEQ ID NO: 50699, SEQ ID NO: 50714, SEQ ID NOs: 50728 to 50729, SEQ ID NO: 50735, SEQ ID NO: 50741, SEQ ID NO: 50744, SEQ ID NO: 50765, SEQ ID NO: 50769, SEQ ID NO: 50793, SEQ ID NO: 50818, SEQ ID NO: 50822, SEQ ID NO: 50826, SEQ ID NO: 50835, SEQ ID NO: 50842, SEQ ID NO: 50847, SEQ ID NO: 50849, SEQ ID NO: 50851, SEQ ID NO: 50893, SEQ ID NO: 50918, SEQ ID NOs: 50935 to 50936, SEQ ID NOs: 50941 to 50944, SEQ ID NOs: 50960 to 50962, SEQ ID NOs: 50975 to 50976, SEQ ID NOs: 51008 to 51009, SEQ ID NO: 51012, SEQ ID NOs: 51021 to 51022, SEQ ID NO: 51046, SEQ ID NO: 51062, SEQ ID NOs: 51068 to 51071, SEQ ID NOs: 51102 to 51104, SEQ ID NO: 51118, SEQ ID NOs: 51168 to 51169, SEQ ID NO: 51214, SEQ ID NO: 51235, SEQ ID NO: 51239, SEQ ID NO: 51241, SEQ ID NO: 51243, SEQ ID NO: 51257, SEQ ID NOs: 51263 to 51266, SEQ ID NOs: 51295 to 51297, SEQ ID NO: 51313, SEQ ID NO: 51405, SEQ ID NOs: 51413 to 51417, SEQ ID NO: 51524, SEQ ID NO: 51526, SEQ ID NO: 51693, SEQ ID NO: 51717, SEQ ID NO: 51762, SEQ ID NO: 51765, SEQ ID NO: 51853, SEQ ID NO: 51878, SEQ ID NO: 52035, SEQ ID NO: 52179, SEQ ID NO: 52275, SEQ ID NO: 52290, SEQ ID NO: 52379, SEQ ID NO: 52463, SEQ ID NO: 52497, SEQ ID NO: 52515, SEQ ID NO: 52652, SEQ ID NO: 52660, SEQ ID NO: 52679, SEQ ID NO: 52686, SEQ ID NO: 52746, SEQ ID NO: 52758, SEQ ID NO: 52816, SEQ ID NO: 52944, SEQ ID NO: 52984, SEQ ID NO: 52988, SEQ ID NO: 52991, SEQ ID NO: 53045, SEQ ID NO: 53118, SEQ ID NO: 53166, SEQ ID NO: 53338, SEQ ID NO: 53382, SEQ ID NO: 53464, SEQ ID NO: 53478, SEQ ID NO: 53511, SEQ ID NO: 53519, SEQ ID NO: 53548, SEQ ID NO: 53581, SEQ ID NO: 53653, SEQ ID NO: 53968, SEQ ID NO: 54024, SEQ ID NO: 54038, SEQ ID NO: 54045, SEQ ID NO: 54080, SEQ ID NO: 54097, SEQ ID NO: 54111, SEQ ID NO: 54238, SEQ ID NO: 54251, SEQ ID NO: 54269, SEQ ID NO: 54409, SEQ ID NO: 54418, SEQ ID NO: 54442, SEQ ID NO: 54473, SEQ ID NO: 54543, SEQ ID NO: 54713, SEQ ID NO: 54719, SEQ ID NO: 54727, SEQ ID NO: 54772, SEQ ID NO: 54788, SEQ ID NO: 54863, SEQ ID NO: 54877, SEQ ID NO: 54945, SEQ ID NO: 54960, SEQ ID NO: 55004, SEQ ID NO: 55109, SEQ ID NO: 55207, SEQ ID NO: 55230, SEQ ID NO: 55300, SEQ ID NO: 55355, SEQ ID NO: 55437, SEQ ID NO: 55516, SEQ ID NO: 55695, SEQ ID NO: 55758, SEQ ID NO: 55801, SEQ ID NO: 55814, SEQ ID NO: 55875, SEQ ID NO: 55879, SEQ ID NO: 55886, SEQ ID NO: 55911, SEQ ID NO: 55986, SEQ ID NO: 56043, SEQ ID NO: 56052, SEQ ID NO: 56175, SEQ ID NO: 56240, SEQ ID NO: 56277, SEQ ID NO: 56352, SEQ ID NO: 56418, SEQ ID NO: 56435, SEQ ID NO: 56521, SEQ ID NO: 56593, SEQ ID NO: 56609, SEQ ID NO: 56629, SEQ ID NOs: 56649 to 56650, SEQ ID NO: 56793, SEQ ID NO: 56836, SEQ ID NO: 56852, SEQ ID NO: 56902, SEQ ID NO: 57155, SEQ ID NO: 57157, SEQ ID NO: 57265, SEQ ID NO: 57278, SEQ ID NO: 57323, SEQ ID NO: 57472, SEQ ID NO: 57535, SEQ ID NO: 57550, SEQ ID NO: 57561, SEQ ID NO: 57568, SEQ ID NO: 57639, SEQ ID NO: 57655, SEQ ID NO: 57790, SEQ ID NO: 57811, SEQ ID NO: 57904, SEQ ID NO: 57944, SEQ ID NO: 58040, SEQ ID NO: 58064, SEQ ID NO: 58075, SEQ ID NO: 58145, SEQ ID NO: 58199, SEQ ID NO: 58223, SEQ ID NO: 58226, SEQ ID NO: 58309, SEQ ID NO: 58349, SEQ ID NO: 58395, SEQ ID NO: 58411, SEQ ID NO: 58433, SEQ ID NO: 58547, SEQ ID NO: 58589, SEQ ID NO: 58679, SEQ ID NOs: 58683 to 58684, SEQ ID NO: 58815, SEQ ID NO: 58823, SEQ ID NO: 58855, SEQ ID NO: 58932, SEQ ID NO: 59223, SEQ ID NO: 59246, SEQ ID NO: 59248, SEQ ID NO: 59530, SEQ ID NO: 59622, SEQ ID NO: 59755, SEQ ID NO: 59757, SEQ ID NO: 59775, SEQ ID NO: 59816, SEQ ID NO: 59821, SEQ ID NO: 59828, SEQ ID NO: 59856, SEQ ID NO: 59871, SEQ ID NO: 59873, SEQ ID NO: 59875, SEQ ID NO: 59960, SEQ ID NO: 59967, SEQ ID NO: 60005, SEQ ID NOs: 60046 to 60047, SEQ ID NO: 60081, SEQ ID NO: 60224, SEQ ID NO: 60228, SEQ ID NO: 60276, SEQ ID NO: 60289, SEQ ID NO: 60292, SEQ ID NOs: 60422 to 60423, SEQ ID NO: 60444, or SEQ ID NOs: 60456 to 68237.

In some embodiments, the amino acid sequence for a MHC class I peptide vaccine for the MAGA4 protein comprises two or more of the SEQ ID NO: 41352, SEQ ID NOs: 41357 to 41358, SEQ ID NO: 41377, SEQ ID NO: 41770, SEQ ID NO: 49071, SEQ ID NO: 50632, SEQ ID NO: 50729, SEQ ID NO: 55758, and SEQ ID NOs: 60456 to 60527. In some embodiments, any one of the peptides in the MAGA4 vaccine comprise an amino acid sequence 80, 81, 82, 83, 84, 85, 86, 87, 88, 89, 90, 91, 92, 93, 94, 95, 96, 97, 98 or 99% identical to SEQ ID NO: 41352, SEQ ID NOs: 41357 to 41358, SEQ ID NO: 41377, SEQ ID NO: 41770, SEQ ID NO: 49071, SEQ ID NO: 50632, SEQ ID NO: 50729, SEQ ID NO: 55758, or SEQ ID NOs: 60456 to 60527.

In some embodiments, the amino acid sequence for a MHC class I peptide vaccine for the MAGA4 protein comprises two or more of the SEQ ID NO: 41345, SEQ ID NO: 41347, SEQ ID NO: 41352, SEQ ID NOs: 41357 to 41358, SEQ ID NO: 41366, SEQ ID NO: 41377, SEQ ID NO: 41382, SEQ ID NO: 41392, SEQ ID NO: 41396, SEQ ID NO: 41398, SEQ ID NO: 41406, SEQ ID NO: 41411, SEQ ID NO: 41414, SEQ ID NO: 41433, SEQ ID NO: 41436, SEQ ID NO: 41445, SEQ ID NO: 41449, SEQ ID NO: 41455, SEQ ID NO: 41478, SEQ ID NO: 41487, SEQ ID NOs: 41495 to 41496, SEQ ID NO: 41503, SEQ ID NO: 41515, SEQ ID NO: 41520, SEQ ID NO: 41529, SEQ ID NO: 41549, SEQ ID NO: 41553, SEQ ID NO: 41562, SEQ ID NO: 41569, SEQ ID NO: 41574, SEQ ID NO: 41576, SEQ ID NO: 41579, SEQ ID NOs: 41587 to 41588, SEQ ID NO: 41605, SEQ ID NO: 41617, SEQ ID NO: 41620, SEQ ID NO: 41634, SEQ ID NO: 41650, SEQ ID NO: 41665, SEQ ID NO: 41670, SEQ ID NO: 41672, SEQ ID NO: 41696, SEQ ID NO: 41703, SEQ ID NO: 41709, SEQ ID NO: 41725, SEQ ID NOs: 41732 to 41733, SEQ ID NO: 41748, SEQ ID NO: 41760, SEQ ID NO: 41766, SEQ ID NO: 41768, SEQ ID NO: 41770, SEQ ID NO: 41779, SEQ ID NO: 41791, SEQ ID NO: 41797, SEQ ID NO: 41813, SEQ ID NO: 41819, SEQ ID NO: 41825, SEQ ID NO: 41829, SEQ ID NOs: 41846 to 41847, SEQ ID NO: 41853, SEQ ID NO: 41876, SEQ ID NO: 41889, SEQ ID NO: 41892, SEQ ID NO: 41897, SEQ ID NOs: 41906 to 41907, SEQ ID NO: 41912, SEQ ID NO: 41924, SEQ ID NO: 41940, SEQ ID NO: 41953, SEQ ID NO: 41956, SEQ ID NO: 41967, SEQ ID NO: 41970, SEQ ID NO: 41976, SEQ ID NO: 41985, SEQ ID NO: 41990, SEQ ID NO: 42014, SEQ ID NO: 42017, SEQ ID NO: 42026, SEQ ID NO: 42034, SEQ ID NO: 42037, SEQ ID NO: 42046, SEQ ID NO: 42048, SEQ ID NOs: 42056 to 42057, SEQ ID NO: 42080, SEQ ID NO: 42088, SEQ ID NO: 42091, SEQ ID NO: 42102, SEQ ID NO: 42106, SEQ ID NO: 42115, SEQ ID NO: 42120, SEQ ID NO: 42129, SEQ ID NO: 42135, SEQ ID NO: 42138, SEQ ID NO: 42151, SEQ ID NO: 42158, SEQ ID NOs: 42163 to 42164, SEQ ID NOs: 42167 to 42168, SEQ ID NO: 42170, SEQ ID NO: 42186, SEQ ID NO: 42192, SEQ ID NO: 42195, SEQ ID NO: 42198, SEQ ID NO: 42204, SEQ ID NO: 42209, SEQ ID NO: 42218, SEQ ID NO: 42221, SEQ ID NO: 42224, SEQ ID NO: 42229, SEQ ID NO: 42240, SEQ ID NO: 42263, SEQ ID NO: 42265, SEQ ID NO: 42270, SEQ ID NO: 42316, SEQ ID NOs: 42336 to 42337, SEQ ID NO: 42339, SEQ ID NO: 42351, SEQ ID NO: 42354, SEQ ID NO: 42372, SEQ ID NO: 42378, SEQ ID NOs: 42385 to 42386, SEQ ID NO: 42394, SEQ ID NO: 42405, SEQ ID NO: 42409, SEQ ID NO: 42417, SEQ ID NO: 42423, SEQ ID NO: 42439, SEQ ID NO: 42447, SEQ ID NO: 42453, SEQ ID NO: 42458, SEQ ID NOs: 42460 to 42461, SEQ ID NO: 42466, SEQ ID NOs: 42472 to 42473, SEQ ID NOs: 42519 to 42520, SEQ ID NO: 42525, SEQ ID NO: 42528, SEQ ID NO: 42540, SEQ ID NO: 42545, SEQ ID NO: 42550, SEQ ID NOs: 42563 to 42564, SEQ ID NO: 42580, SEQ ID NO: 42605, SEQ ID NO: 42609, SEQ ID NOs: 42612 to 42613, SEQ ID NO: 42615, SEQ ID NO: 42628, SEQ ID NO: 42637, SEQ ID NO: 42648, SEQ ID NO: 42653, SEQ ID NO: 42675, SEQ ID NO: 42680, SEQ ID NO: 42685, SEQ ID NO: 42696, SEQ ID NO: 42703, SEQ ID NO: 42719, SEQ ID NO: 42735, SEQ ID NO: 42743, SEQ ID NO: 42748, SEQ ID NO: 42750, SEQ ID NO: 42768, SEQ ID NO: 42812, SEQ ID NO: 42814, SEQ ID NO: 42822, SEQ ID NO: 42827, SEQ ID NO: 42831, SEQ ID NO: 42846, SEQ ID NO: 42850, SEQ ID NO: 42872, SEQ ID NO: 42886, SEQ ID NO: 42911, SEQ ID NO: 42914, SEQ ID NO: 42923, SEQ ID NO: 42927, SEQ ID NOs: 42957 to 42958, SEQ ID NO: 42962, SEQ ID NO: 42971, SEQ ID NOs: 42997 to 42998, SEQ ID NO: 43002, SEQ ID NO: 43008, SEQ ID NO: 43035, SEQ ID NO: 43046, SEQ ID NO: 43048, SEQ ID NO: 43064, SEQ ID NO: 43083, SEQ ID NO: 43091, SEQ ID NO: 43093, SEQ ID NO: 43148, SEQ ID NO: 43160, SEQ ID NO: 43170, SEQ ID NO: 43175, SEQ ID NO: 43180, SEQ ID NO: 43186, SEQ ID NO: 43193, SEQ ID NO: 43196, SEQ ID NOs: 43231 to 43232, SEQ ID NO: 43238, SEQ ID NO: 43242, SEQ ID NO: 43248, SEQ ID NO: 43253, SEQ ID NO: 43258, SEQ ID NO: 43267, SEQ ID NO: 43274, SEQ ID NO: 43280, SEQ ID NO: 43285, SEQ ID NO: 43295, SEQ ID NO: 43308, SEQ ID NO: 43311, SEQ ID NO: 43329, SEQ ID NO: 43333, SEQ ID NOs: 43339 to 43340, SEQ ID NO: 43362, SEQ ID NO: 43365, SEQ ID NO: 43384, SEQ ID NO: 43389, SEQ ID NO: 43395, SEQ ID NO: 43401, SEQ ID NO: 43429, SEQ ID NO: 43432, SEQ ID NO: 43440, SEQ ID NOs: 43451 to 43453, SEQ ID NO: 43462, SEQ ID NO: 43464, SEQ ID NO: 43467, SEQ ID NO: 43479, SEQ ID NO: 43482, SEQ ID NO: 43496, SEQ ID NO: 43511, SEQ ID NO: 43513, SEQ ID NO: 43517, SEQ ID NO: 43545, SEQ ID NO: 43564, SEQ ID NO: 43573, SEQ ID NO: 43585, SEQ ID NO: 43587, SEQ ID NO: 43591, SEQ ID NO: 43611, SEQ ID NO: 43632, SEQ ID NO: 43636, SEQ ID NO: 43641, SEQ ID NO: 43643, SEQ ID NO: 43651, SEQ ID NO: 43669, SEQ ID NO: 43688, SEQ ID NO: 43696, SEQ ID NO: 43700, SEQ ID NO: 43703, SEQ ID NO: 43707, SEQ ID NO: 43718, SEQ ID NO: 43760, SEQ ID NO: 43763, SEQ ID NO: 43768, SEQ ID NO: 43777, SEQ ID NO: 43780, SEQ ID NO: 43787, SEQ ID NO: 43801, SEQ ID NO: 43808, SEQ ID NO: 43810, SEQ ID NO: 43825, SEQ ID NO: 43827, SEQ ID NO: 43836, SEQ ID NO: 43860, SEQ ID NO: 43867, SEQ ID NOs: 43881 to 43882, SEQ ID NO: 43884, SEQ ID NO: 43887, SEQ ID NOs: 43898 to 43899, SEQ ID NO: 43905, SEQ ID NO: 43915, SEQ ID NO: 43924, SEQ ID NO: 43932, SEQ ID NO: 43958, SEQ ID NO: 43971, SEQ ID NO: 43974, SEQ ID NO: 43978, SEQ ID NOs: 43982 to 43984, SEQ ID NOs: 43986 to 43987, SEQ ID NO: 43993, SEQ ID NO: 43995, SEQ ID NO: 44012, SEQ ID NO: 44035, SEQ ID NO: 44037, SEQ ID NO: 44048, SEQ ID NO: 44050, SEQ ID NO: 44052, SEQ ID NO: 44055, SEQ ID NO: 44063, SEQ ID NO: 44073, SEQ ID NO: 44080, SEQ ID NO: 44085, SEQ ID NO: 44087, SEQ ID NO: 44089, SEQ ID NO: 44112, SEQ ID NO: 44117, SEQ ID NO: 44123, SEQ ID NOs: 44151 to 44152, SEQ ID NO: 44160, SEQ ID NO: 44181, SEQ ID NO: 44207, SEQ ID NO: 44210, SEQ ID NO: 44244, SEQ ID NO: 44246, SEQ ID NO: 44254, SEQ ID NO: 44263, SEQ ID NOs: 44298 to 44299, SEQ ID NO: 44309, SEQ ID NO: 44324, SEQ ID NO: 44328, SEQ ID NO: 44342, SEQ ID NO: 44345, SEQ ID NO: 44359, SEQ ID NO: 44361, SEQ ID NO: 44383, SEQ ID NO: 44401, SEQ ID NO: 44422, SEQ ID NO: 44440, SEQ ID NO: 44452, SEQ ID NO: 44454, SEQ ID NO: 44456, SEQ ID NO: 44463, SEQ ID NO: 44467, SEQ ID NO: 44485, SEQ ID NO: 44512, SEQ ID NO: 44523, SEQ ID NO: 44545, SEQ ID NO: 44552, SEQ ID NO: 44564, SEQ ID NOs: 44566 to 44567, SEQ ID NOs: 44589 to 44591, SEQ ID NO: 44615, SEQ ID NO: 44623, SEQ ID NO: 44631, SEQ ID NO: 44636, SEQ ID NO: 44649, SEQ ID NO: 44654, SEQ ID NO: 44691, SEQ ID NO: 44713, SEQ ID NO: 44722, SEQ ID NO: 44730, SEQ ID NO: 44754, SEQ ID NO: 44756, SEQ ID NOs: 44762 to 44763, SEQ ID NO: 44773, SEQ ID NO: 44781, SEQ ID NO: 44794, SEQ ID NO: 44850, SEQ ID NOs: 44873 to 44875, SEQ ID NO: 44877, SEQ ID NO: 44884, SEQ ID NO: 44908, SEQ ID NO: 44913, SEQ ID NO: 44940, SEQ ID NO: 44955, SEQ ID NO: 44964, SEQ ID NO: 44971, SEQ ID NO: 44976, SEQ ID NO: 45000, SEQ ID NO: 45027, SEQ ID NO: 45035, SEQ ID NO: 45060, SEQ ID NO: 45062, SEQ ID NO: 45095, SEQ ID NO: 45123, SEQ ID NOs: 45126 to 45127, SEQ ID NO: 45132, SEQ ID NO: 45135, SEQ ID NOs: 45138 to 45139, SEQ ID NO: 45193, SEQ ID NO: 45197, SEQ ID NO: 45200, SEQ ID NO: 45223, SEQ ID NO: 45225, SEQ ID NO: 45244, SEQ ID NO: 45262, SEQ ID NO: 45273, SEQ ID NO: 45292, SEQ ID NO: 45302, SEQ ID NO: 45306, SEQ ID NO: 45314, SEQ ID NO: 45380, SEQ ID NO: 45385, SEQ ID NO: 45389, SEQ ID NO: 45398, SEQ ID NO: 45409, SEQ ID NO: 45438, SEQ ID NO: 45444, SEQ ID NOs: 45450 to 45451, SEQ ID NO: 45478, SEQ ID NO: 45480, SEQ ID NO: 45485, SEQ ID NO: 45490, SEQ ID NO: 45510, SEQ ID NO: 45514, SEQ ID NOs: 45519 to 45520, SEQ ID NO: 45530, SEQ ID NO: 45541, SEQ ID NO: 45552, SEQ ID NO: 45556, SEQ ID NOs: 45562 to 45563, SEQ ID NO: 45568, SEQ ID NO: 45577, SEQ ID NOs: 45580 to 45581, SEQ ID NO: 45584, SEQ ID NO: 45588, SEQ ID NO: 45595, SEQ ID NO: 45599, SEQ ID NO: 45632, SEQ ID NO: 45653, SEQ ID NOs: 45666 to 45667, SEQ ID NO: 45675, SEQ ID NO: 45680, SEQ ID NO: 45687, SEQ ID NO: 45697, SEQ ID NOs: 45699 to 45700, SEQ ID NO: 45712, SEQ ID NO: 45714, SEQ ID NO: 45723, SEQ ID NO: 45746, SEQ ID NO: 45765, SEQ ID NO: 45787, SEQ ID NO: 45793, SEQ ID NO: 45818, SEQ ID NO: 45826, SEQ ID NOs: 45829 to 45830, SEQ ID NO: 45835, SEQ ID NO: 45837, SEQ ID NO: 45846, SEQ ID NO: 45859, SEQ ID NO: 45885, SEQ ID NO: 45894, SEQ ID NO: 45904, SEQ ID NO: 45915, SEQ ID NO: 45930, SEQ ID NO: 45938, SEQ ID NO: 45959, SEQ ID NO: 45983, SEQ ID NO: 46006, SEQ ID NO: 46011, SEQ ID NO: 46014, SEQ ID NO: 46044, SEQ ID NO: 46049, SEQ ID NO: 46054, SEQ ID NO: 46058, SEQ ID NO: 46063, SEQ ID NO: 46071, SEQ ID NO: 46077, SEQ ID NO: 46096, SEQ ID NO: 46103, SEQ ID NO: 46108, SEQ ID NO: 46110, SEQ ID NO: 46125, SEQ ID NO: 46133, SEQ ID NOs: 46170 to 46171, SEQ ID NO: 46195, SEQ ID NO: 46208, SEQ ID NO: 46212, SEQ ID NO: 46219, SEQ ID NO: 46226, SEQ ID NO: 46234, SEQ ID NO: 46236, SEQ ID NO: 46261, SEQ ID NO: 46270, SEQ ID NO: 46273, SEQ ID NO: 46275, SEQ ID NO: 46339, SEQ ID NO: 46364, SEQ ID NO: 46376, SEQ ID NOs: 46400 to 46401, SEQ ID NOs: 46421 to 46422, SEQ ID NO: 46433, SEQ ID NOs: 46442 to 46443, SEQ ID NO: 46446, SEQ ID NOs: 46452 to 46454, SEQ ID NO: 46457, SEQ ID NO: 46459, SEQ ID NO: 46462, SEQ ID NO: 46465, SEQ ID NO: 46478, SEQ ID NO: 46484, SEQ ID NO: 46489, SEQ ID NO: 46499, SEQ ID NO: 46512, SEQ ID NO: 46521, SEQ ID NO: 46530, SEQ ID NO: 46536, SEQ ID NO: 46560, SEQ ID NO: 46564, SEQ ID NO: 46570, SEQ ID NO: 46572, SEQ ID NO: 46575, SEQ ID NO: 46579, SEQ ID NO: 46586, SEQ ID NO: 46602, SEQ ID NO: 46616, SEQ ID NO: 46621, SEQ ID NO: 46628, SEQ ID NO: 46637, SEQ ID NO: 46642, SEQ ID NO: 46648, SEQ ID NO: 46652, SEQ ID NO: 46655, SEQ ID NO: 46660, SEQ ID NO: 46663, SEQ ID NOs: 46665 to 46666, SEQ ID NO: 46676, SEQ ID NOs: 46678 to 46679, SEQ ID NO: 46682, SEQ ID NO: 46685, SEQ ID NO: 46689, SEQ ID NO: 46713, SEQ ID NO: 46715, SEQ ID NO: 46736, SEQ ID NO: 46739, SEQ ID NO: 46770, SEQ ID NO: 46777, SEQ ID NO: 46800, SEQ ID NOs: 46823 to 46825, SEQ ID NO: 46831, SEQ ID NO: 46872, SEQ ID NO: 46880, SEQ ID NO: 46897, SEQ ID NO: 46916, SEQ ID NO: 46928, SEQ ID NO: 46937, SEQ ID NO: 46950, SEQ ID NO: 46978, SEQ ID NO: 46981, SEQ ID NO: 46983, SEQ ID NO: 46989, SEQ ID NO: 46991, SEQ ID NO: 46993, SEQ ID NO: 47003, SEQ ID NO: 47006, SEQ ID NO: 47017, SEQ ID NO: 47028, SEQ ID NO: 47045, SEQ ID NO: 47047, SEQ ID NO: 47057, SEQ ID NOs: 47079 to 47080, SEQ ID NO: 47082, SEQ ID NO: 47114, SEQ ID NO: 47119, SEQ ID NO: 47123, SEQ ID NOs: 47137 to 47139, SEQ ID NO: 47151, SEQ ID NO: 47158, SEQ ID NO: 47167, SEQ ID NO: 47172, SEQ ID NO: 47186, SEQ ID NO: 47191, SEQ ID NO: 47206, SEQ ID NO: 47224, SEQ ID NO: 47298, SEQ ID NO: 47316, SEQ ID NO: 47324, SEQ ID NOs: 47331 to 47332, SEQ ID NO: 47335, SEQ ID NO: 47356, SEQ ID NO: 47358, SEQ ID NOs: 47360 to 47361, SEQ ID NOs: 47377 to 47378, SEQ ID NO: 47381, SEQ ID NO: 47405, SEQ ID NO: 47412, SEQ ID NO: 47416, SEQ ID NO: 47422, SEQ ID NO: 47425, SEQ ID NO: 47427, SEQ ID NOs: 47432 to 47433, SEQ ID NO: 47445, SEQ ID NO: 47451, SEQ ID NO: 47460, SEQ ID NO: 47482, SEQ ID NO: 47491, SEQ ID NO: 47509, SEQ ID NO: 47516, SEQ ID NOs: 47533 to 47535, SEQ ID NOs: 47538 to 47539, SEQ ID NO: 47555, SEQ ID NO: 47561, SEQ ID NOs: 47575 to 47576, SEQ ID NO: 47582, SEQ ID NO: 47592, SEQ ID NO: 47614, SEQ ID NO: 47625, SEQ ID NO: 47630, SEQ ID NO: 47637, SEQ ID NO: 47643, SEQ ID NO: 47654, SEQ ID NO: 47673, SEQ ID NO: 47689, SEQ ID NO: 47698, SEQ ID NO: 47701, SEQ ID NO: 47727, SEQ ID NO: 47749, SEQ ID NOs: 47759 to 47760, SEQ ID NO: 47767, SEQ ID NO: 47773, SEQ ID NO: 47782, SEQ ID NO: 47790, SEQ ID NO: 47793, SEQ ID NO: 47799, SEQ ID NO: 47806, SEQ ID NO: 47809, SEQ ID NO: 47834, SEQ ID NO: 47840, SEQ ID NO: 47844, SEQ ID NO: 47848, SEQ ID NO: 47855, SEQ ID NO: 47867, SEQ ID NO: 47890, SEQ ID NO: 47895, SEQ ID NO: 47899, SEQ ID NO: 47902, SEQ ID NO: 47923, SEQ ID NO: 47927, SEQ ID NOs: 47959 to 47960, SEQ ID NO: 47964, SEQ ID NO: 47979, SEQ ID NO: 47984, SEQ ID NO: 47986, SEQ ID NOs: 48030 to 48031, SEQ ID NO: 48034, SEQ ID NO: 48059, SEQ ID NO: 48093, SEQ ID NO: 48107, SEQ ID NO: 48113, SEQ ID NO: 48118, SEQ ID NO: 48121, SEQ ID NO: 48129, SEQ ID NOs: 48138 to 48139, SEQ ID NO: 48144, SEQ ID NO: 48158, SEQ ID NO: 48160, SEQ ID NO: 48162, SEQ ID NO: 48175, SEQ ID NO: 48186, SEQ ID NO: 48203, SEQ ID NO: 48210, SEQ ID NO: 48213, SEQ ID NO: 48220, SEQ ID NO: 48224, SEQ ID NO: 48229, SEQ ID NO: 48258, SEQ ID NO: 48266, SEQ ID NO: 48273, SEQ ID NO: 48280, SEQ ID NO: 48286, SEQ ID NO: 48295, SEQ ID NOs: 48300 to 48301, SEQ ID NOs: 48306 to 48307, SEQ ID NO: 48315, SEQ ID NO: 48347, SEQ ID NO: 48353, SEQ ID NO: 48358, SEQ ID NO: 48366, SEQ ID NO: 48371, SEQ ID NO: 48379, SEQ ID NO: 48387, SEQ ID NO: 48400, SEQ ID NO: 48415, SEQ ID NOs: 48418 to 48419, SEQ ID NO: 48436, SEQ ID NOs: 48438 to 48440, SEQ ID NO: 48443, SEQ ID NO: 48452, SEQ ID NOs: 48461 to 48462, SEQ ID NO: 48466, SEQ ID NO: 48469, SEQ ID NO: 48520, SEQ ID NO: 48537, SEQ ID NO: 48545, SEQ ID NO: 48574, SEQ ID NOs: 48576 to 48578, SEQ ID NO: 48594, SEQ ID NO: 48599, SEQ ID NO: 48614, SEQ ID NO: 48627, SEQ ID NO: 48642, SEQ ID NO: 48648, SEQ ID NO: 48654, SEQ ID NO: 48656, SEQ ID NO: 48666, SEQ ID NOs: 48669 to 48670, SEQ ID NO: 48674, SEQ ID NOs: 48680 to 48681, SEQ ID NO: 48684, SEQ ID NO: 48686, SEQ ID NO: 48692, SEQ ID NO: 48701, SEQ ID NO: 48705, SEQ ID NO: 48714, SEQ ID NO: 48717, SEQ ID NO: 48735, SEQ ID NO: 48738, SEQ ID NO: 48749, SEQ ID NO: 48751, SEQ ID NO: 48764, SEQ ID NO: 48769, SEQ ID NO: 48793, SEQ ID NO: 48796, SEQ ID NOs: 48799 to 48800, SEQ ID NOs: 48802 to 48803, SEQ ID NO: 48818, SEQ ID NO: 48832, SEQ ID NO: 48834, SEQ ID NO: 48838, SEQ ID NO: 48845, SEQ ID NO: 48856, SEQ ID NO: 48877, SEQ ID NO: 48884, SEQ ID NO: 48903, SEQ ID NO: 48936, SEQ ID NO: 48947, SEQ ID NOs: 48968 to 48970, SEQ ID NO: 48974, SEQ ID NOs: 48981 to 48982, SEQ ID NO: 48997, SEQ ID NOs: 49013 to 49014, SEQ ID NOs: 49019 to 49020, SEQ ID NO: 49031, SEQ ID NO: 49033, SEQ ID NO: 49043, SEQ ID NO: 49052, SEQ ID NOs: 49061 to 49062, SEQ ID NO: 49068, SEQ ID NO: 49071, SEQ ID NO: 49086, SEQ ID NO: 49102, SEQ ID NO: 49111, SEQ ID NO: 49156, SEQ ID NO: 49164, SEQ ID NO: 49173, SEQ ID NO: 49176, SEQ ID NO: 49183, SEQ ID NO: 49185, SEQ ID NOs: 49200 to 49201, SEQ ID NO: 49209, SEQ ID NO: 49220, SEQ ID NO: 49247, SEQ ID NO: 49251, SEQ ID NO: 49256, SEQ ID NO: 49263, SEQ ID NOs: 49273 to 49274, SEQ ID NOs: 49280 to 49281, SEQ ID NO: 49291, SEQ ID NOs: 49294 to 49295, SEQ ID NO: 49298, SEQ ID NO: 49309, SEQ ID NO: 49319, SEQ ID NO: 49326, SEQ ID NO: 49330, SEQ ID NO: 49340, SEQ ID NOs: 49351 to 49352, SEQ ID NO: 49360, SEQ ID NOs: 49376 to 49377, SEQ ID NO: 49384, SEQ ID NO: 49393, SEQ ID NO: 49395, SEQ ID NO:

49399, SEQ ID NO: 49406, SEQ ID NO: 49411, SEQ ID NOs: 49443 to 49444, SEQ ID NO: 49452, SEQ ID NO: 49462, SEQ ID NO: 49474, SEQ ID NO: 49487, SEQ ID NO: 49499, SEQ ID NO: 49525, SEQ ID NO: 49537, SEQ ID NO: 49540, SEQ ID NO: 49557, SEQ ID NO: 49572, SEQ ID NO: 49584, SEQ ID NO: 49597, SEQ ID NO: 49626, SEQ ID NO: 49630, SEQ ID NO: 49646, SEQ ID NO: 49658, SEQ ID NO: 49671, SEQ ID NO: 49681, SEQ ID NO: 49703, SEQ ID NO: 49728, SEQ ID NO: 49730, SEQ ID NO: 49737, SEQ ID NOs: 49742 to 49743, SEQ ID NOs: 49766 to 49767, SEQ ID NO: 49772, SEQ ID NO: 49782, SEQ ID NOs: 49787 to 49788, SEQ ID NO: 49793, SEQ ID NO: 49796, SEQ ID NO: 49805, SEQ ID NO: 49811, SEQ ID NO: 49823, SEQ ID NO: 49838, SEQ ID NO: 49850, SEQ ID NOs: 49859 to 49860, SEQ ID NO: 49873, SEQ ID NO: 49883, SEQ ID NO: 49892, SEQ ID NO: 49912, SEQ ID NO: 49928, SEQ ID NO: 49948, SEQ ID NO: 49961, SEQ ID NO: 49965, SEQ ID NO: 49987, SEQ ID NO: 49997, SEQ ID NOs: 50017 to 50018, SEQ ID NO: 50020, SEQ ID NO: 50022, SEQ ID NO: 50045, SEQ ID NO: 50062, SEQ ID NO: 50073, SEQ ID NO: 50079, SEQ ID NO: 50090, SEQ ID NO: 50107, SEQ ID NOs: 50111 to 50112, SEQ ID NO: 50123, SEQ ID NO: 50138, SEQ ID NOs: 50165 to 50167, SEQ ID NOs: 50227 to 50228, SEQ ID NO: 50243, SEQ ID NO: 50250, SEQ ID NO: 50254, SEQ ID NO: 50282, SEQ ID NO: 50284, SEQ ID NO: 50290, SEQ ID NO: 50297, SEQ ID NO: 50305, SEQ ID NO: 50309, SEQ ID NO: 50319, SEQ ID NO: 50331, SEQ ID NO: 50334, SEQ ID NO: 50339, SEQ ID NO: 50366, SEQ ID NO: 50388, SEQ ID NO: 50392, SEQ ID NO: 50394, SEQ ID NOs: 50400 to 50401, SEQ ID NO: 50418, SEQ ID NO: 50423, SEQ ID NO: 50428, SEQ ID NO: 50437, SEQ ID NO: 50443, SEQ ID NO: 50450, SEQ ID NO: 50464, SEQ ID NO: 50485, SEQ ID NO: 50494, SEQ ID NO: 50496, SEQ ID NO: 50499, SEQ ID NO: 50526, SEQ ID NO: 50528, SEQ ID NO: 50532, SEQ ID NO: 50538, SEQ ID NO: 50554, SEQ ID NO: 50557, SEQ ID NO: 50560, SEQ ID NO: 50564, SEQ ID NO: 50574, SEQ ID NO: 50585, SEQ ID NO: 50617, SEQ ID NO: 50632, SEQ ID NO: 50634, SEQ ID NO: 50644, SEQ ID NO: 50654, SEQ ID NO: 50678, SEQ ID NO: 50699, SEQ ID NO: 50714, SEQ ID NOs: 50728 to 50729, SEQ ID NO: 50735, SEQ ID NO: 50741, SEQ ID NO: 50744, SEQ ID NO: 50765, SEQ ID NO: 50769, SEQ ID NO: 50793, SEQ ID NO: 50818, SEQ ID NO: 50822, SEQ ID NO: 50826, SEQ ID NO: 50835, SEQ ID NO: 50842, SEQ ID NO: 50847, SEQ ID NO: 50849, SEQ ID NO: 50851, SEQ ID NO: 50893, SEQ ID NO: 50918, SEQ ID NOs: 50935 to 50936, SEQ ID NOs: 50941 to 50944, SEQ ID NOs: 50960 to 50962, SEQ ID NOs: 50975 to 50976, SEQ ID NOs: 51008 to 51009, SEQ ID NO: 51012, SEQ ID NOs: 51021 to 51022, SEQ ID NO: 51046, SEQ ID NO: 51062, SEQ ID NOs: 51068 to 51071, SEQ ID NOs: 51102 to 51104, SEQ ID NO: 51118, SEQ ID NOs: 51168 to 51169, SEQ ID NO: 51214, SEQ ID NO: 51235, SEQ ID NO: 51239, SEQ ID NO: 51241, SEQ ID NO: 51243, SEQ ID NO: 51257, SEQ ID NOs: 51263 to 51266, SEQ ID NOs: 51295 to 51297, SEQ ID NO: 51313, SEQ ID NO: 51405, SEQ ID NOs: 51413 to 51417, SEQ ID NO: 51524, SEQ ID NO: 51526, SEQ ID NO: 51693, SEQ ID NO: 51717, SEQ ID NO: 51762, SEQ ID NO: 51765, SEQ ID NO: 51853, SEQ ID NO: 51878, SEQ ID NO: 52035, SEQ ID NO: 52179, SEQ ID NO: 52275, SEQ ID NO: 52290, SEQ ID NO: 52379, SEQ ID NO: 52463, SEQ ID NO: 52497, SEQ ID NO: 52515, SEQ ID NO: 52652, SEQ ID NO: 52660, SEQ ID NO: 52679, SEQ ID NO: 52686, SEQ ID NO: 52746, SEQ ID NO: 52758, SEQ ID NO: 52816, SEQ ID NO: 52944, SEQ ID NO: 52984, SEQ ID NO: 52988, SEQ ID NO: 52991, SEQ ID NO: 53045, SEQ ID NO: 53118, SEQ ID NO: 53166, SEQ ID NO: 53338, SEQ ID NO: 53382, SEQ ID NO: 53464, SEQ ID NO: 53478, SEQ ID NO: 53511, SEQ ID NO: 53519, SEQ ID NO: 53548, SEQ ID NO: 53581, SEQ ID NO: 53653, SEQ ID NO: 53968, SEQ ID NO: 54024, SEQ ID NO: 54038, SEQ ID NO: 54045, SEQ ID NO: 54080, SEQ ID NO: 54097, SEQ ID NO: 54111, SEQ ID NO: 54238, SEQ ID NO: 54251, SEQ ID NO: 54269, SEQ ID NO: 54409, SEQ ID NO: 54418, SEQ ID NO: 54442, SEQ ID NO: 54473, SEQ ID NO: 54543, SEQ ID NO: 54713, SEQ ID NO: 54719, SEQ ID NO: 54727, SEQ ID NO: 54772, SEQ ID NO: 54788, SEQ ID NO: 54863, SEQ ID NO: 54877, SEQ ID NO: 54945, SEQ ID NO: 54960, SEQ ID NO: 55004, SEQ ID NO: 55109, SEQ ID NO: 55207, SEQ ID NO: 55230, SEQ ID NO: 55300, SEQ ID NO: 55355, SEQ ID NO: 55437, SEQ ID NO: 55516, SEQ ID NO: 55695, SEQ ID NO: 55758, SEQ ID NO: 55801, SEQ ID NO: 55814, SEQ ID NO: 55875, SEQ ID NO: 55879, SEQ ID NO: 55886, SEQ ID NO: 55911, SEQ ID NO: 55986, SEQ ID NO: 56043, SEQ ID NO: 56052, SEQ ID NO: 56175, SEQ ID NO: 56240, SEQ ID NO: 56277, SEQ ID NO: 56352, SEQ ID NO: 56418, SEQ ID NO: 56435, SEQ ID NO: 56521, SEQ ID NO: 56593, SEQ ID NO: 56609, SEQ ID NO: 56629, SEQ ID NOs: 56649 to 56650, SEQ ID NO: 56793, SEQ ID NO: 56836, SEQ ID NO: 56852, SEQ ID NO: 56902, SEQ ID NO: 57155, SEQ ID NO: 57157, SEQ ID NO: 57265, SEQ ID NO: 57278, SEQ ID NO: 57323, SEQ ID NO: 57472, SEQ ID NO: 57535, SEQ ID NO: 57550, SEQ ID NO: 57561, SEQ ID NO: 57568, SEQ ID NO: 57639, SEQ ID NO: 57655, SEQ ID NO: 57790, SEQ ID NO: 57811, SEQ ID NO: 57904, SEQ ID NO: 57944, SEQ ID NO: 58040, SEQ ID NO: 58064, SEQ ID NO: 58075, SEQ ID NO: 58145, SEQ ID NO: 58199, SEQ ID NO: 58223, SEQ ID NO: 58226, SEQ ID NO: 58309, SEQ ID NO: 58349, SEQ ID NO: 58395, SEQ ID NO: 58411, SEQ ID NO: 58433, SEQ ID NO: 58547, SEQ ID NO: 58589, SEQ ID NO: 58679, SEQ ID NOs: 58683 to 58684, SEQ ID NO: 58815, SEQ ID NO: 58823, SEQ ID NO: 58855, SEQ ID NO: 58932, SEQ ID NO: 59223, SEQ ID NO: 59246, SEQ ID NO: 59248, SEQ ID NO: 59530, SEQ ID NO: 59622, SEQ ID NO: 59755, SEQ ID NO: 59757, SEQ ID NO: 59775, SEQ ID NO: 59816, SEQ ID NO: 59821, SEQ ID NO: 59828, SEQ ID NO: 59856, SEQ ID NO: 59871, SEQ ID NO: 59873, SEQ ID NO: 59875, SEQ ID NO: 59960, SEQ ID NO: 59967, SEQ ID NO: 60005, SEQ ID NOs: 60046 to 60047, SEQ ID NO: 60081, SEQ ID NO: 60224, SEQ ID NO: 60228, SEQ ID NO: 60276, SEQ ID NO: 60289, SEQ ID NO: 60292, SEQ ID NOs: 60422 to 60423, SEQ ID NO: 60444, and SEQ ID NOs: 60456 to 68237. In some embodiments, any one of the peptides in the MAGA4 vaccine comprise an amino acid sequence 80, 81, 82, 83, 84, 85, 86, 87, 88, 89, 90, 91, 92, 93, 94, 95, 96, 97, 98 or 99% identical to SEQ ID NO: 41345, SEQ ID NO: 41347, SEQ ID NO: 41352, SEQ ID NOs: 41357 to 41358, SEQ ID NO: 41366, SEQ ID NO: 41377, SEQ ID NO: 41382, SEQ ID NO: 41392, SEQ ID NO: 41396, SEQ ID NO: 41398, SEQ ID NO: 41406, SEQ ID NO: 41411, SEQ ID NO: 41414, SEQ ID NO: 41433, SEQ ID NO: 41436, SEQ ID NO: 41445, SEQ ID NO: 41449, SEQ ID NO: 41455, SEQ ID NO: 41478, SEQ ID NO: 41487, SEQ ID NOs: 41495 to 41496, SEQ ID NO: 41503, SEQ ID NO: 41515, SEQ ID NO: 41520, SEQ ID NO: 41529, SEQ ID NO: 41549, SEQ ID NO: 41553, SEQ ID NO: 41562, SEQ ID NO: 41569, SEQ ID NO: 41574, SEQ ID NO: 41576, SEQ ID NO: 41579, SEQ ID NOs: 41587 to 41588, SEQ ID NO: 41605, SEQ ID NO: 41617, SEQ ID NO: 41620, SEQ ID NO: 41634, SEQ ID NO: 41650, SEQ ID NO: 41665, SEQ ID NO: 41670, SEQ ID NO: 41672, SEQ ID NO: 41696, SEQ ID NO: 41703, SEQ ID NO: 41709, SEQ ID NO: 41725, SEQ ID NOs: 41732 to 41733, SEQ ID NO: 41748, SEQ ID NO: 41760, SEQ ID NO: 41766, SEQ ID NO: 41768, SEQ ID NO: 41770, SEQ ID NO: 41779, SEQ ID NO: 41791, SEQ ID NO: 41797, SEQ ID NO: 41813, SEQ ID NO: 41819, SEQ ID NO: 41825, SEQ ID NO: 41829, SEQ ID NOs: 41846 to 41847, SEQ ID NO: 41853, SEQ ID NO: 41876, SEQ ID NO: 41889, SEQ ID NO: 41892, SEQ ID NO: 41897, SEQ ID NOs: 41906 to 41907, SEQ ID NO: 41912, SEQ ID NO: 41924, SEQ ID NO: 41940, SEQ ID NO: 41953, SEQ ID NO: 41956, SEQ ID NO: 41967, SEQ ID NO: 41970, SEQ ID NO: 41976, SEQ ID NO: 41985, SEQ ID NO: 41990, SEQ ID NO: 42014, SEQ ID NO: 42017, SEQ ID NO: 42026, SEQ ID NO: 42034, SEQ ID NO: 42037, SEQ ID NO: 42046, SEQ ID NO: 42048, SEQ ID NOs: 42056 to 42057, SEQ ID NO: 42080, SEQ ID NO: 42088, SEQ ID NO: 42091, SEQ ID NO: 42102, SEQ ID NO: 42106, SEQ ID NO: 42115, SEQ ID NO: 42120, SEQ ID NO: 42129, SEQ ID NO: 42135, SEQ ID NO: 42138, SEQ ID NO: 42151, SEQ ID NO: 42158, SEQ ID NOs: 42163 to 42164, SEQ ID NOs: 42167 to 42168, SEQ ID NO: 42170, SEQ ID NO: 42186, SEQ ID NO: 42192, SEQ ID NO: 42195, SEQ ID NO: 42198, SEQ ID NO: 42204, SEQ ID NO: 42209, SEQ ID NO: 42218, SEQ ID NO: 42221, SEQ ID NO: 42224, SEQ ID NO: 42229, SEQ ID NO: 42240, SEQ ID NO: 42263, SEQ ID NO: 42265, SEQ ID NO: 42270, SEQ ID NO: 42316, SEQ ID NOs: 42336 to 42337, SEQ ID NO: 42339, SEQ ID NO: 42351, SEQ ID NO: 42354, SEQ ID NO: 42372, SEQ ID NO: 42378, SEQ ID NOs: 42385 to 42386, SEQ ID NO: 42394, SEQ ID NO: 42405, SEQ ID NO: 42409, SEQ ID NO: 42417, SEQ ID NO: 42423, SEQ ID NO: 42439, SEQ ID NO: 42447, SEQ ID NO: 42453, SEQ ID NO: 42458, SEQ ID NOs: 42460 to 42461, SEQ ID NO: 42466, SEQ ID NOs: 42472 to 42473, SEQ ID NOs: 42519 to 42520, SEQ ID NO: 42525, SEQ ID NO: 42528, SEQ ID NO: 42540, SEQ ID NO: 42545, SEQ ID NO: 42550, SEQ ID NOs: 42563 to 42564, SEQ ID NO: 42580, SEQ ID NO: 42605, SEQ ID NO: 42609, SEQ ID NOs: 42612 to 42613, SEQ ID NO: 42615, SEQ ID NO: 42628, SEQ ID NO: 42637, SEQ ID NO: 42648, SEQ ID NO: 42653, SEQ ID NO: 42675, SEQ ID NO: 42680, SEQ ID NO: 42685, SEQ ID NO: 42696, SEQ ID NO: 42703, SEQ ID NO: 42719, SEQ ID NO: 42735, SEQ ID NO: 42743, SEQ ID NO: 42748, SEQ ID NO: 42750, SEQ ID NO: 42768, SEQ ID NO: 42812, SEQ ID NO: 42814, SEQ ID NO: 42822, SEQ ID NO: 42827, SEQ ID NO: 42831, SEQ ID NO: 42846, SEQ ID NO: 42850, SEQ ID NO: 42872, SEQ ID NO: 42886, SEQ ID NO: 42911, SEQ ID NO: 42914, SEQ ID NO: 42923, SEQ ID NO: 42927, SEQ ID NOs: 42957 to 42958, SEQ ID NO: 42962, SEQ ID NO: 42971, SEQ ID NOs: 42997 to 42998, SEQ ID NO: 43002, SEQ ID NO: 43008, SEQ ID NO: 43035, SEQ ID NO: 43046, SEQ ID NO: 43048, SEQ ID NO: 43064, SEQ ID NO: 43083, SEQ ID NO: 43091, SEQ ID NO: 43093, SEQ ID NO: 43148, SEQ ID NO: 43160, SEQ ID NO: 43170, SEQ ID NO: 43175, SEQ ID NO: 43180, SEQ ID NO: 43186, SEQ ID NO: 43193, SEQ ID NO: 43196, SEQ ID NOs: 43231 to 43232, SEQ ID NO: 43238, SEQ ID NO: 43242, SEQ ID NO: 43248, SEQ ID NO: 43253, SEQ ID NO: 43258, SEQ ID NO: 43267, SEQ ID NO: 43274, SEQ ID NO: 43280, SEQ ID NO: 43285, SEQ ID NO: 43295, SEQ ID NO: 43308, SEQ ID NO: 43311, SEQ ID NO: 43329, SEQ ID NO: 43333, SEQ ID NOs: 43339 to 43340, SEQ ID NO: 43362, SEQ ID NO: 43365, SEQ ID NO: 43384, SEQ ID NO: 43389, SEQ ID NO: 43395, SEQ ID NO: 43401, SEQ ID NO: 43429, SEQ ID NO: 43432, SEQ ID NO: 43440, SEQ ID NOs: 43451 to 43453, SEQ ID NO: 43462, SEQ ID NO: 43464, SEQ ID NO: 43467, SEQ ID NO: 43479, SEQ ID NO: 43482, SEQ ID NO: 43496, SEQ ID NO: 43511, SEQ ID NO: 43513, SEQ ID NO: 43517, SEQ ID NO: 43545, SEQ ID NO: 43564, SEQ ID NO: 43573, SEQ ID NO: 43585, SEQ ID NO: 43587, SEQ ID NO: 43591, SEQ ID NO: 43611, SEQ ID NO: 43632, SEQ ID NO: 43636, SEQ ID NO: 43641, SEQ ID NO: 43643, SEQ ID NO: 43651, SEQ ID NO: 43669, SEQ ID NO: 43688, SEQ ID NO: 43696, SEQ ID NO: 43700, SEQ ID NO: 43703, SEQ ID NO: 43707, SEQ ID NO: 43718, SEQ ID NO: 43760, SEQ ID NO: 43763, SEQ ID NO: 43768, SEQ ID NO: 43777, SEQ ID NO: 43780, SEQ ID NO: 43787, SEQ ID NO: 43801, SEQ ID NO: 43808, SEQ ID NO: 43810, SEQ ID NO: 43825, SEQ ID NO: 43827, SEQ ID NO: 43836, SEQ ID NO: 43860, SEQ ID NO: 43867, SEQ ID NOs: 43881 to 43882, SEQ ID NO: 43884, SEQ ID NO: 43887, SEQ ID NOs: 43898 to 43899, SEQ ID NO: 43905, SEQ ID NO: 43915, SEQ ID NO: 43924, SEQ ID NO: 43932, SEQ ID NO: 43958, SEQ ID NO: 43971, SEQ ID NO: 43974, SEQ ID NO: 43978, SEQ ID NOs: 43982 to 43984, SEQ ID NOs: 43986 to 43987, SEQ ID NO: 43993, SEQ ID NO: 43995, SEQ ID NO: 44012, SEQ ID NO: 44035, SEQ ID NO: 44037, SEQ ID NO: 44048, SEQ ID NO: 44050, SEQ ID NO: 44052, SEQ ID NO: 44055, SEQ ID NO: 44063, SEQ ID NO: 44073, SEQ ID NO: 44080, SEQ ID NO: 44085, SEQ ID NO: 44087, SEQ ID NO: 44089, SEQ ID NO: 44112, SEQ ID NO: 44117, SEQ ID NO: 44123, SEQ ID NOs: 44151 to 44152, SEQ ID NO: 44160, SEQ ID NO: 44181, SEQ ID NO: 44207, SEQ ID NO: 44210, SEQ ID NO: 44244, SEQ ID NO: 44246, SEQ ID NO: 44254, SEQ ID NO: 44263, SEQ ID NOs: 44298 to 44299, SEQ ID NO: 44309, SEQ ID NO: 44324, SEQ ID NO: 44328, SEQ ID NO: 44342, SEQ ID NO: 44345, SEQ ID NO: 44359, SEQ ID NO: 44361, SEQ ID NO: 44383, SEQ ID NO: 44401, SEQ ID NO: 44422, SEQ ID NO: 44440, SEQ ID NO: 44452, SEQ ID NO: 44454, SEQ ID NO: 44456, SEQ ID NO: 44463, SEQ ID NO: 44467, SEQ ID NO: 44485, SEQ ID NO: 44512, SEQ ID NO: 44523, SEQ ID NO: 44545, SEQ ID NO: 44552, SEQ ID NO: 44564, SEQ ID NOs: 44566 to 44567, SEQ ID NOs: 44589 to 44591, SEQ ID NO: 44615, SEQ ID NO: 44623, SEQ ID NO: 44631, SEQ ID NO: 44636, SEQ ID NO: 44649, SEQ ID NO: 44654, SEQ ID NO: 44691, SEQ ID NO: 44713, SEQ ID NO: 44722, SEQ ID NO: 44730, SEQ ID NO: 44754, SEQ ID NO: 44756, SEQ ID NOs: 44762 to 44763, SEQ ID NO: 44773, SEQ ID NO: 44781, SEQ ID NO: 44794, SEQ ID NO: 44850, SEQ ID NOs: 44873 to 44875, SEQ ID NO: 44877, SEQ ID NO: 44884, SEQ ID NO: 44908, SEQ ID NO: 44913, SEQ ID NO: 44940, SEQ ID NO: 44955, SEQ ID NO: 44964, SEQ ID NO: 44971, SEQ ID NO: 44976, SEQ ID NO: 45000, SEQ ID NO: 45027, SEQ ID NO: 45035, SEQ ID NO: 45060, SEQ ID NO: 45062, SEQ ID NO: 45095, SEQ ID NO: 45123, SEQ ID NOs: 45126 to 45127, SEQ ID NO: 45132, SEQ ID NO: 45135, SEQ ID NOs: 45138 to 45139, SEQ ID NO: 45193, SEQ ID NO: 45197, SEQ ID NO: 45200, SEQ ID NO: 45223, SEQ ID NO: 45225, SEQ ID NO: 45244, SEQ ID NO: 45262, SEQ ID NO: 45273, SEQ ID NO: 45292, SEQ ID NO: 45302, SEQ ID NO: 45306, SEQ ID NO: 45314, SEQ ID NO: 45380, SEQ ID NO: 45385, SEQ ID NO: 45389, SEQ ID NO: 45398, SEQ ID NO: 45409, SEQ ID NO: 45438, SEQ ID NO: 45444, SEQ ID NOs: 45450 to 45451, SEQ ID NO: 45478, SEQ ID NO: 45480, SEQ ID NO: 45485, SEQ ID NO: 45490, SEQ ID NO: 45510, SEQ ID NO: 45514, SEQ ID NOs: 45519 to 45520, SEQ ID NO: 45530, SEQ ID NO: 45541, SEQ ID NO: 45552, SEQ ID NO: 45556, SEQ ID NOs: 45562 to 45563, SEQ ID NO: 45568, SEQ ID NO: 45577, SEQ ID NOs: 45580 to 45581, SEQ ID NO: 45584, SEQ ID NO: 45588, SEQ ID NO: 45595, SEQ ID NO: 45599, SEQ ID NO: 45632, SEQ ID NO: 45653, SEQ ID NOs: 45666 to 45667, SEQ ID NO: 45675, SEQ ID NO: 45680, SEQ ID NO: 45687, SEQ ID NO: 45697, SEQ ID NOs: 45699 to 45700, SEQ ID NO: 45712, SEQ ID NO: 45714, SEQ ID NO: 45723, SEQ ID NO: 45746, SEQ ID NO: 45765, SEQ ID NO: 45787, SEQ ID NO: 45793, SEQ ID NO: 45818, SEQ ID NO: 45826, SEQ ID NOs: 45829 to 45830, SEQ ID NO: 45835, SEQ ID NO: 45837, SEQ ID NO: 45846, SEQ ID NO: 45859, SEQ ID NO: 45885, SEQ ID NO: 45894, SEQ ID NO: 45904, SEQ ID NO: 45915, SEQ ID NO: 45930, SEQ ID NO: 45938, SEQ ID NO: 45959, SEQ ID NO: 45983, SEQ ID NO: 46006, SEQ ID NO: 46011, SEQ ID NO: 46014, SEQ ID NO: 46044, SEQ ID NO: 46049, SEQ ID NO: 46054, SEQ ID NO: 46058, SEQ ID NO: 46063, SEQ ID NO: 46071, SEQ ID NO: 46077, SEQ ID NO: 46096, SEQ ID NO: 46103, SEQ ID NO: 46108, SEQ ID NO: 46110, SEQ ID NO: 46125, SEQ ID NO: 46133, SEQ ID NOs: 46170 to 46171, SEQ ID NO: 46195, SEQ ID NO: 46208, SEQ ID NO: 46212, SEQ ID NO: 46219, SEQ ID NO: 46226, SEQ ID NO: 46234, SEQ ID NO: 46236, SEQ ID NO: 46261, SEQ ID NO: 46270, SEQ ID NO: 46273, SEQ ID NO: 46275, SEQ ID NO: 46339, SEQ ID NO: 46364, SEQ ID NO: 46376, SEQ ID NOs: 46400 to 46401, SEQ ID NOs: 46421 to 46422, SEQ ID NO: 46433, SEQ ID NOs: 46442 to 46443, SEQ ID NO: 46446, SEQ ID NOs: 46452 to 46454, SEQ ID NO: 46457, SEQ ID NO: 46459, SEQ ID NO: 46462, SEQ ID NO: 46465, SEQ ID NO: 46478, SEQ ID NO: 46484, SEQ ID NO: 46489, SEQ ID NO: 46499, SEQ ID NO: 46512, SEQ ID NO: 46521, SEQ ID NO: 46530, SEQ ID NO: 46536, SEQ ID NO: 46560, SEQ ID NO: 46564, SEQ ID NO: 46570, SEQ ID NO: 46572, SEQ ID NO: 46575, SEQ ID NO: 46579, SEQ ID NO: 46586, SEQ ID NO: 46602, SEQ ID NO: 46616, SEQ ID NO: 46621, SEQ ID NO: 46628, SEQ ID NO: 46637, SEQ ID NO: 46642, SEQ ID NO: 46648, SEQ ID NO: 46652, SEQ ID NO: 46655, SEQ ID NO: 46660, SEQ ID NO: 46663, SEQ ID NOs: 46665 to 46666, SEQ ID NO: 46676, SEQ ID NOs: 46678 to 46679, SEQ ID NO: 46682, SEQ ID NO: 46685, SEQ ID NO: 46689, SEQ ID NO: 46713, SEQ ID NO: 46715, SEQ ID NO: 46736, SEQ ID NO: 46739, SEQ ID NO: 46770, SEQ ID NO: 46777, SEQ ID NO: 46800, SEQ ID NOs: 46823 to 46825, SEQ ID NO: 46831, SEQ ID NO: 46872, SEQ ID NO: 46880, SEQ ID NO: 46897, SEQ ID NO: 46916, SEQ ID NO: 46928, SEQ ID NO: 46937, SEQ ID NO: 46950, SEQ ID NO: 46978, SEQ ID NO: 46981, SEQ ID NO: 46983, SEQ ID NO: 46989, SEQ ID NO: 46991, SEQ ID NO: 46993, SEQ ID NO: 47003, SEQ ID NO: 47006, SEQ ID NO: 47017, SEQ ID NO: 47028, SEQ ID NO: 47045, SEQ ID NO: 47047, SEQ ID NO: 47057, SEQ ID NOs: 47079 to 47080, SEQ ID NO: 47082, SEQ ID NO: 47114, SEQ ID NO: 47119, SEQ ID NO: 47123, SEQ ID NOs: 47137 to 47139, SEQ ID NO: 47151, SEQ ID NO: 47158, SEQ ID NO: 47167, SEQ ID NO: 47172, SEQ ID NO: 47186, SEQ ID NO: 47191, SEQ ID NO: 47206, SEQ ID NO: 47224, SEQ ID NO: 47298, SEQ ID NO: 47316, SEQ ID NO: 47324, SEQ ID NOs: 47331 to 47332, SEQ ID NO: 47335, SEQ ID NO: 47356, SEQ ID NO: 47358, SEQ ID NOs: 47360 to 47361, SEQ ID NOs: 47377 to 47378, SEQ ID NO: 47381, SEQ ID NO: 47405, SEQ ID NO: 47412, SEQ ID NO: 47416, SEQ ID NO: 47422, SEQ ID NO: 47425, SEQ ID NO: 47427, SEQ ID NOs: 47432 to 47433, SEQ ID NO: 47445, SEQ ID NO: 47451, SEQ ID NO: 47460, SEQ ID NO: 47482, SEQ ID NO: 47491, SEQ ID NO: 47509, SEQ ID NO: 47516, SEQ ID NOs: 47533 to 47535, SEQ ID NOs: 47538 to 47539, SEQ ID NO: 47555, SEQ ID NO: 47561, SEQ ID NOs: 47575 to 47576, SEQ ID NO: 47582, SEQ ID NO: 47592, SEQ ID NO: 47614, SEQ ID NO: 47625, SEQ ID NO: 47630, SEQ ID NO: 47637, SEQ ID NO: 47643, SEQ ID NO: 47654, SEQ ID NO: 47673, SEQ ID NO: 47689, SEQ ID NO: 47698, SEQ ID NO: 47701, SEQ ID NO: 47727, SEQ ID NO: 47749, SEQ ID NOs: 47759 to 47760, SEQ ID NO: 47767, SEQ ID NO: 47773, SEQ ID NO: 47782, SEQ ID NO: 47790, SEQ ID NO: 47793, SEQ ID NO: 47799, SEQ ID NO: 47806, SEQ ID NO: 47809, SEQ ID NO: 47834, SEQ ID NO: 47840, SEQ ID NO: 47844, SEQ ID NO: 47848, SEQ ID NO: 47855, SEQ ID NO: 47867, SEQ ID NO: 47890, SEQ ID NO: 47895, SEQ ID NO: 47899, SEQ ID NO: 47902, SEQ ID NO: 47923, SEQ ID NO: 47927, SEQ ID NOs: 47959 to 47960, SEQ ID NO: 47964, SEQ ID NO: 47979, SEQ ID NO: 47984, SEQ ID NO: 47986, SEQ ID NOs: 48030 to 48031, SEQ ID NO: 48034, SEQ ID NO: 48059, SEQ ID NO: 48093, SEQ ID NO: 48107, SEQ ID NO: 48113, SEQ ID NO: 48118, SEQ ID NO: 48121, SEQ ID NO: 48129, SEQ ID NOs: 48138 to 48139, SEQ ID NO: 48144, SEQ ID NO: 48158, SEQ ID NO: 48160, SEQ ID NO: 48162, SEQ ID NO: 48175, SEQ ID NO: 48186, SEQ ID NO: 48203, SEQ ID NO: 48210, SEQ ID NO: 48213, SEQ ID NO: 48220, SEQ ID NO: 48224, SEQ ID NO: 48229, SEQ ID NO: 48258, SEQ ID NO: 48266, SEQ ID NO: 48273, SEQ ID NO: 48280, SEQ ID NO: 48286, SEQ ID NO: 48295, SEQ ID NOs: 48300 to 48301, SEQ ID NOs: 48306 to 48307, SEQ ID NO: 48315, SEQ ID NO: 48347, SEQ ID NO: 48353, SEQ ID NO: 48358, SEQ ID NO: 48366, SEQ ID NO: 48371, SEQ ID NO: 48379, SEQ ID NO: 48387, SEQ ID NO: 48400, SEQ ID NO: 48415, SEQ ID NOs: 48418 to 48419, SEQ ID NO: 48436, SEQ ID NOs: 48438 to 48440, SEQ ID NO: 48443, SEQ ID NO: 48452, SEQ ID NOs: 48461 to 48462, SEQ ID NO: 48466, SEQ ID NO: 48469, SEQ ID NO: 48520, SEQ ID NO: 48537, SEQ ID NO: 48545, SEQ ID NO: 48574, SEQ ID NOs: 48576 to 48578, SEQ ID NO: 48594, SEQ ID NO: 48599, SEQ ID NO: 48614, SEQ ID NO: 48627, SEQ ID NO: 48642, SEQ ID NO: 48648, SEQ ID NO: 48654, SEQ ID NO: 48656, SEQ ID NO: 48666, SEQ ID NOs: 48669 to 48670, SEQ ID NO: 48674, SEQ ID NOs: 48680 to 48681, SEQ ID NO: 48684, SEQ ID NO: 48686, SEQ ID NO: 48692, SEQ ID NO: 48701, SEQ ID NO: 48705, SEQ ID NO: 48714, SEQ ID NO: 48717, SEQ ID NO: 48735, SEQ ID NO: 48738, SEQ ID NO: 48749, SEQ ID NO: 48751, SEQ ID NO: 48764, SEQ ID NO: 48769, SEQ ID NO: 48793, SEQ ID NO: 48796, SEQ ID NOs: 48799 to 48800, SEQ ID NOs: 48802 to 48803, SEQ ID NO: 48818, SEQ ID NO: 48832, SEQ ID NO: 48834, SEQ ID NO: 48838, SEQ ID NO: 48845, SEQ ID NO: 48856, SEQ ID NO: 48877, SEQ ID NO: 48884, SEQ ID NO: 48903, SEQ ID NO: 48936, SEQ ID NO: 48947, SEQ ID NOs: 48968 to 48970, SEQ ID NO: 48974, SEQ ID NOs: 48981 to 48982, SEQ ID NO: 48997, SEQ ID NOs: 49013 to 49014, SEQ ID NOs: 49019 to 49020, SEQ ID NO: 49031, SEQ ID NO: 49033, SEQ ID NO: 49043, SEQ ID NO: 49052, SEQ ID NOs: 49061 to 49062, SEQ ID NO: 49068, SEQ ID NO: 49071, SEQ ID NO: 49086, SEQ ID NO: 49102, SEQ ID NO: 49111, SEQ ID NO: 49156, SEQ ID NO: 49164, SEQ ID NO: 49173, SEQ ID NO: 49176, SEQ ID NO: 49183, SEQ ID NO: 49185, SEQ ID NOs: 49200 to 49201, SEQ ID NO: 49209, SEQ ID NO: 49220, SEQ ID NO: 49247, SEQ ID NO: 49251, SEQ ID NO: 49256, SEQ ID NO: 49263, SEQ ID NOs: 49273 to 49274, SEQ ID NOs: 49280 to 49281, SEQ ID NO: 49291, SEQ ID NOs: 49294 to 49295, SEQ ID NO: 49298, SEQ ID NO: 49309, SEQ ID NO: 49319, SEQ ID NO: 49326, SEQ ID NO: 49330, SEQ ID NO: 49340, SEQ ID NOs: 49351 to 49352, SEQ ID NO: 49360, SEQ ID NOs: 49376 to 49377, SEQ ID NO: 49384, SEQ ID NO: 49393, SEQ ID NO: 49395, SEQ ID NO: 49399, SEQ ID NO: 49406, SEQ ID NO: 49411, SEQ ID NOs: 49443 to 49444, SEQ ID NO: 49452, SEQ ID NO: 49462, SEQ ID NO: 49474, SEQ ID NO: 49487, SEQ ID NO: 49499, SEQ ID NO: 49525, SEQ ID NO: 49537, SEQ ID NO: 49540, SEQ ID NO: 49557, SEQ ID NO: 49572, SEQ ID NO: 49584, SEQ ID NO: 49597, SEQ ID NO: 49626, SEQ ID NO: 49630, SEQ ID NO: 49646, SEQ ID NO: 49658, SEQ ID NO: 49671, SEQ ID NO: 49681, SEQ ID NO: 49703, SEQ ID NO: 49728, SEQ ID NO: 49730, SEQ ID NO: 49737, SEQ ID NOs: 49742 to 49743, SEQ ID NOs: 49766 to 49767, SEQ ID NO: 49772, SEQ ID NO: 49782, SEQ ID NOs: 49787 to 49788, SEQ ID NO: 49793, SEQ ID NO: 49796, SEQ ID NO: 49805, SEQ ID NO: 49811, SEQ ID NO: 49823, SEQ ID NO: 49838, SEQ ID NO: 49850, SEQ ID NOs: 49859 to 49860, SEQ ID NO: 49873, SEQ ID NO: 49883, SEQ ID NO: 49892, SEQ ID NO: 49912, SEQ ID NO: 49928, SEQ ID NO: 49948, SEQ ID NO: 49961, SEQ ID NO: 49965, SEQ ID NO: 49987, SEQ ID NO: 49997, SEQ ID NOs: 50017 to 50018, SEQ ID NO: 50020, SEQ ID NO: 50022, SEQ ID NO: 50045, SEQ ID NO: 50062, SEQ ID NO: 50073, SEQ ID NO: 50079, SEQ ID NO: 50090, SEQ ID NO: 50107, SEQ ID NOs: 50111 to 50112, SEQ ID NO: 50123, SEQ ID NO: 50138, SEQ ID NOs: 50165 to 50167, SEQ ID NOs: 50227 to 50228, SEQ ID NO: 50243, SEQ ID NO: 50250, SEQ ID NO: 50254, SEQ ID NO: 50282, SEQ ID NO: 50284, SEQ ID NO: 50290, SEQ ID NO: 50297, SEQ ID NO: 50305, SEQ ID NO: 50309, SEQ ID NO: 50319, SEQ ID NO: 50331, SEQ ID NO: 50334, SEQ ID NO: 50339, SEQ ID NO: 50366, SEQ ID NO: 50388, SEQ ID NO: 50392, SEQ ID NO: 50394, SEQ ID NOs: 50400 to 50401, SEQ ID NO: 50418, SEQ ID NO: 50423, SEQ ID NO: 50428, SEQ ID NO: 50437, SEQ ID NO: 50443, SEQ ID NO: 50450, SEQ ID NO: 50464, SEQ ID NO: 50485, SEQ ID NO: 50494, SEQ ID NO: 50496, SEQ ID NO: 50499, SEQ ID NO: 50526, SEQ ID NO: 50528, SEQ ID NO: 50532, SEQ ID NO: 50538, SEQ ID NO: 50554, SEQ ID NO: 50557, SEQ ID NO: 50560, SEQ ID NO: 50564, SEQ ID NO: 50574, SEQ ID NO: 50585, SEQ ID NO: 50617, SEQ ID NO: 50632, SEQ ID NO: 50634, SEQ ID NO: 50644, SEQ ID NO: 50654, SEQ ID NO: 50678, SEQ ID NO: 50699, SEQ ID NO: 50714, SEQ ID NOs: 50728 to 50729, SEQ ID NO: 50735, SEQ ID NO: 50741, SEQ ID NO: 50744, SEQ ID NO: 50765, SEQ ID NO: 50769, SEQ ID NO: 50793, SEQ ID NO: 50818, SEQ ID NO: 50822, SEQ ID NO: 50826, SEQ ID NO: 50835, SEQ ID NO: 50842, SEQ ID NO: 50847, SEQ ID NO: 50849, SEQ ID NO: 50851, SEQ ID NO: 50893, SEQ ID NO: 50918, SEQ ID NOs: 50935 to 50936, SEQ ID NOs: 50941 to 50944, SEQ ID NOs: 50960 to 50962, SEQ ID NOs: 50975 to 50976, SEQ ID NOs: 51008 to 51009, SEQ ID NO: 51012, SEQ ID NOs: 51021 to 51022, SEQ ID NO: 51046, SEQ ID NO: 51062, SEQ ID NOs: 51068 to 51071, SEQ ID NOs: 51102 to 51104, SEQ ID NO: 51118, SEQ ID NOs: 51168 to 51169, SEQ ID NO: 51214, SEQ ID NO: 51235, SEQ ID NO: 51239, SEQ ID NO: 51241, SEQ ID NO: 51243, SEQ ID NO: 51257, SEQ ID NOs: 51263 to 51266, SEQ ID NOs: 51295 to 51297, SEQ ID NO: 51313, SEQ ID NO: 51405, SEQ ID NOs: 51413 to 51417, SEQ ID NO: 51524, SEQ ID NO: 51526, SEQ ID NO: 51693, SEQ ID NO: 51717, SEQ ID NO: 51762, SEQ ID NO: 51765, SEQ ID NO: 51853, SEQ ID NO: 51878, SEQ ID NO: 52035, SEQ ID NO: 52179, SEQ ID NO: 52275, SEQ ID NO: 52290, SEQ ID NO: 52379, SEQ ID NO: 52463, SEQ ID NO: 52497, SEQ ID NO: 52515, SEQ ID NO: 52652, SEQ ID NO: 52660, SEQ ID NO: 52679, SEQ ID NO: 52686, SEQ ID NO: 52746, SEQ ID NO: 52758, SEQ ID NO: 52816, SEQ ID NO: 52944, SEQ ID NO: 52984, SEQ ID NO: 52988, SEQ ID NO: 52991, SEQ ID NO: 53045, SEQ ID NO: 53118, SEQ ID NO: 53166, SEQ ID NO: 53338, SEQ ID NO: 53382, SEQ ID NO: 53464, SEQ ID NO: 53478, SEQ ID NO: 53511, SEQ ID NO: 53519, SEQ ID NO: 53548, SEQ ID NO: 53581, SEQ ID NO: 53653, SEQ ID NO: 53968, SEQ ID NO: 54024, SEQ ID NO: 54038, SEQ ID NO: 54045, SEQ ID NO: 54080, SEQ ID NO: 54097, SEQ ID NO: 54111, SEQ ID NO: 54238, SEQ ID NO: 54251, SEQ ID NO: 54269, SEQ ID NO: 54409, SEQ ID NO: 54418, SEQ ID NO: 54442, SEQ ID NO: 54473, SEQ ID NO: 54543, SEQ ID NO: 54713, SEQ ID NO: 54719, SEQ ID NO: 54727, SEQ ID NO: 54772, SEQ ID NO: 54788, SEQ ID NO: 54863, SEQ ID NO: 54877, SEQ ID NO: 54945, SEQ ID NO: 54960, SEQ ID NO: 55004, SEQ ID NO: 55109, SEQ ID NO: 55207, SEQ ID NO: 55230, SEQ ID NO: 55300, SEQ ID NO: 55355, SEQ ID NO: 55437, SEQ ID NO: 55516, SEQ ID NO: 55695, SEQ ID NO: 55758, SEQ ID NO: 55801, SEQ ID NO: 55814, SEQ ID NO: 55875, SEQ ID NO: 55879, SEQ ID NO: 55886, SEQ ID NO: 55911, SEQ ID NO: 55986, SEQ ID NO: 56043, SEQ ID NO: 56052, SEQ ID NO: 56175, SEQ ID NO: 56240, SEQ ID NO: 56277, SEQ ID NO: 56352, SEQ ID NO: 56418, SEQ ID NO: 56435, SEQ ID NO: 56521, SEQ ID NO: 56593, SEQ ID NO: 56609, SEQ ID NO: 56629, SEQ ID NOs: 56649 to 56650, SEQ ID NO: 56793, SEQ ID NO: 56836, SEQ ID NO: 56852, SEQ ID NO: 56902, SEQ ID NO: 57155, SEQ ID NO: 57157, SEQ ID NO: 57265, SEQ ID NO: 57278, SEQ ID NO: 57323, SEQ ID NO: 57472, SEQ ID NO: 57535, SEQ ID NO: 57550, SEQ ID NO: 57561, SEQ ID NO: 57568, SEQ ID NO: 57639, SEQ ID NO: 57655, SEQ ID NO: 57790, SEQ ID NO: 57811, SEQ ID NO: 57904, SEQ ID NO: 57944, SEQ ID NO: 58040, SEQ ID NO: 58064, SEQ ID NO: 58075, SEQ ID NO: 58145, SEQ ID NO: 58199, SEQ ID NO: 58223, SEQ ID NO: 58226, SEQ ID NO: 58309, SEQ ID NO: 58349, SEQ ID NO: 58395, SEQ ID NO: 58411, SEQ ID NO: 58433, SEQ ID NO: 58547, SEQ ID NO: 58589, SEQ ID NO: 58679, SEQ ID NOs: 58683 to 58684, SEQ ID NO: 58815, SEQ ID NO: 58823, SEQ ID NO: 58855, SEQ ID NO: 58932, SEQ ID NO: 59223, SEQ ID NO: 59246, SEQ ID NO: 59248, SEQ ID NO: 59530, SEQ ID NO: 59622, SEQ ID NO: 59755, SEQ ID NO: 59757, SEQ ID NO: 59775, SEQ ID NO: 59816, SEQ ID NO: 59821, SEQ ID NO: 59828, SEQ ID NO: 59856, SEQ ID NO: 59871, SEQ ID NO: 59873, SEQ ID NO: 59875, SEQ ID NO: 59960, SEQ ID NO: 59967, SEQ ID NO: 60005, SEQ ID NOs: 60046 to 60047, SEQ ID NO: 60081, SEQ ID NO: 60224, SEQ ID NO: 60228, SEQ ID NO: 60276, SEQ ID NO: 60289, SEQ ID NO: 60292, SEQ ID NOs: 60422 to 60423, SEQ ID NO: 60444, or SEQ ID NOs: 60456 to 68237.

In some embodiments, the amino acid sequence for a MHC class I peptide vaccine for the MAGC1 protein comprises one or more of the SEQ ID NO: 49395, SEQ ID NO: 50632, and SEQ ID NOs: 68238 to 68321. In some embodiments, any one of the peptides in the MAGC1 vaccine comprise an amino acid sequence 80, 81, 82, 83, 84, 85, 86, 87, 88, 89, 90, 91, 92, 93, 94, 95, 96, 97, 98 or 99% identical to SEQ ID NO: 49395, SEQ ID NO: 50632, or SEQ ID NOs: 68238 to 68321.

In some embodiments, the amino acid sequence for a MHC class I peptide vaccine for the MAGC1 protein comprises one or more of the SEQ ID NO: 41352, SEQ ID NO: 41478, SEQ ID NO: 41495, SEQ ID NO: 41725, SEQ ID NO: 41847, SEQ ID NO: 42129, SEQ ID NO: 42135, SEQ ID NO: 42168, SEQ ID NO: 42170, SEQ ID NO: 42195, SEQ ID NO: 42218, SEQ ID NO: 42229, SEQ ID NO: 42458, SEQ ID NO: 42545, SEQ ID NO: 42628, SEQ ID NO: 42653, SEQ ID NO: 42685, SEQ ID NO: 42703, SEQ ID NO: 42872, SEQ ID NO: 43008, SEQ ID NO: 43046, SEQ ID NO: 43083, SEQ ID NO: 43333, SEQ ID NO: 43429, SEQ ID NO: 43564, SEQ ID NO: 43780, SEQ ID NO: 43836, SEQ ID NO: 43881, SEQ ID NO: 43898, SEQ ID NO: 43932, SEQ ID NO: 44048, SEQ ID NO: 44181, SEQ ID NO: 44328, SEQ ID NO: 44456, SEQ ID NO: 44523, SEQ ID NO: 44566, SEQ ID NO: 44773, SEQ ID NO: 44877, SEQ ID NO: 45197, SEQ ID NO: 45385, SEQ ID NO: 45450, SEQ ID NO: 45556, SEQ ID NO: 45580, SEQ ID NO: 45584, SEQ ID NO: 45599, SEQ ID NO: 45765, SEQ ID NO: 45829, SEQ ID NO: 45894, SEQ ID NO: 45915, SEQ ID NO: 46273, SEQ ID NO: 46400, SEQ ID NO: 46421, SEQ ID NO: 46457, SEQ ID NO: 46459, SEQ ID NO: 46484, SEQ ID NO: 46666, SEQ ID NO: 46678, SEQ ID NO: 46689, SEQ ID NO: 46981, SEQ ID NO: 46991, SEQ ID NO: 46993, SEQ ID NO: 47047, SEQ ID NO: 47151, SEQ ID NO: 47324, SEQ ID NO: 47432, SEQ ID NO: 47592, SEQ ID NO: 47673, SEQ ID NO: 47895, SEQ ID NO: 47960, SEQ ID NO: 47964, SEQ ID NO: 47979, SEQ ID NO: 47984, SEQ ID NO: 48034, SEQ ID NO: 48113, SEQ ID NO: 48118, SEQ ID NO: 48300, SEQ ID NO: 48436, SEQ ID NOs: 48461 to 48462, SEQ ID NO: 48469, SEQ ID NO: 48574, SEQ ID NO: 48680, SEQ ID NO: 48796, SEQ ID NO: 48832, SEQ ID NO: 48838, SEQ ID NO: 48845, SEQ ID NO: 48877, SEQ ID NO: 48947, SEQ ID NO: 49019, SEQ ID NO: 49111, SEQ ID NO: 49176, SEQ ID NO: 49263, SEQ ID NO: 49395, SEQ ID NO: 49462, SEQ ID NO: 49557, SEQ ID NO: 49823, SEQ ID NO: 49883, SEQ ID NO: 50062, SEQ ID NO: 50167, SEQ ID NO: 50305, SEQ ID NO: 50394, SEQ ID NO: 50401, SEQ ID NO: 50423, SEQ ID NO: 50428, SEQ ID NO: 50443, SEQ ID NO: 50450, SEQ ID NO: 50564, SEQ ID NO: 50574, SEQ ID NO: 50632, SEQ ID NO: 50678, and SEQ ID NOs: 68238 to 95592. In some embodiments, any one of the peptides in the MAGC1 vaccine comprise an amino acid sequence 80, 81, 82, 83, 84, 85, 86, 87, 88, 89, 90, 91, 92, 93, 94, 95, 96, 97, 98 or 99% identical to SEQ ID NO: 41352, SEQ ID NO: 41478, SEQ ID NO: 41495, SEQ ID NO: 41725, SEQ ID NO: 41847, SEQ ID NO: 42129, SEQ ID NO: 42135, SEQ ID NO: 42168, SEQ ID NO: 42170, SEQ ID NO: 42195, SEQ ID NO: 42218, SEQ ID NO: 42229, SEQ ID NO: 42458, SEQ ID NO: 42545, SEQ ID NO: 42628, SEQ ID NO: 42653, SEQ ID NO: 42685, SEQ ID NO: 42703, SEQ ID NO: 42872, SEQ ID NO: 43008, SEQ ID NO: 43046, SEQ ID NO: 43083, SEQ ID NO: 43333, SEQ ID NO: 43429, SEQ ID NO: 43564, SEQ ID NO: 43780, SEQ ID NO: 43836, SEQ ID NO: 43881, SEQ ID NO: 43898, SEQ ID NO: 43932, SEQ ID NO: 44048, SEQ ID NO: 44181, SEQ ID NO: 44328, SEQ ID NO: 44456, SEQ ID NO: 44523, SEQ ID NO: 44566, SEQ ID NO: 44773, SEQ ID NO: 44877, SEQ ID NO: 45197, SEQ ID NO: 45385, SEQ ID NO: 45450, SEQ ID NO: 45556, SEQ ID NO: 45580, SEQ ID NO: 45584, SEQ ID NO: 45599, SEQ ID NO: 45765, SEQ ID NO: 45829, SEQ ID NO: 45894, SEQ ID NO: 45915, SEQ ID NO: 46273, SEQ ID NO: 46400, SEQ ID NO: 46421, SEQ ID NO: 46457, SEQ ID NO: 46459, SEQ ID NO: 46484, SEQ ID NO: 46666, SEQ ID NO: 46678, SEQ ID NO: 46689, SEQ ID NO: 46981, SEQ ID NO: 46991, SEQ ID NO: 46993, SEQ ID NO: 47047, SEQ ID NO: 47151, SEQ ID NO: 47324, SEQ ID NO: 47432, SEQ ID NO: 47592, SEQ ID NO: 47673, SEQ ID NO: 47895, SEQ ID NO: 47960, SEQ ID NO: 47964, SEQ ID NO: 47979, SEQ ID NO: 47984, SEQ ID NO: 48034, SEQ ID NO: 48113, SEQ ID NO: 48118, SEQ ID NO: 48300, SEQ ID NO: 48436, SEQ ID NOs: 48461 to 48462, SEQ ID NO: 48469, SEQ ID NO: 48574, SEQ ID NO: 48680, SEQ ID NO: 48796, SEQ ID NO: 48832, SEQ ID NO: 48838, SEQ ID NO: 48845, SEQ ID NO: 48877, SEQ ID NO: 48947, SEQ ID NO: 49019, SEQ ID NO: 49111, SEQ ID NO: 49176, SEQ ID NO: 49263, SEQ ID NO: 49395, SEQ ID NO: 49462, SEQ ID NO: 49557, SEQ ID NO: 49823, SEQ ID NO: 49883, SEQ ID NO: 50062, SEQ ID NO: 50167, SEQ ID NO: 50305, SEQ ID NO: 50394, SEQ ID NO: 50401, SEQ ID NO: 50423, SEQ ID NO: 50428, SEQ ID NO: 50443, SEQ ID NO: 50450, SEQ ID NO: 50564, SEQ ID NO: 50574, SEQ ID NO: 50632, SEQ ID NO: 50678, or SEQ ID NOs: 68238 to 95592.

In some embodiments, the amino acid sequence for a MHC class I peptide vaccine for the MAGC1 protein comprises two or more of the SEQ ID NO: 49395, SEQ ID NO: 50632, and SEQ ID NOs: 68238 to 68321. In some embodiments, any one of the peptides in the MAGC1 vaccine comprise an amino acid sequence 80, 81, 82, 83, 84, 85, 86, 87, 88, 89, 90, 91, 92, 93, 94, 95, 96, 97, 98 or 99% identical to SEQ ID NO: 49395, SEQ ID NO: 50632, or SEQ ID NOs: 68238 to 68321.

In some embodiments, the amino acid sequence for a MHC class I peptide vaccine for the MAGC1 protein comprises two or more of the SEQ ID NO: 41352, SEQ ID NO: 41478, SEQ ID NO: 41495, SEQ ID NO: 41725, SEQ ID NO: 41847, SEQ ID NO: 42129, SEQ ID NO: 42135, SEQ ID NO: 42168, SEQ ID NO: 42170, SEQ ID NO: 42195, SEQ ID NO: 42218, SEQ ID NO: 42229, SEQ ID NO: 42458, SEQ ID NO: 42545, SEQ ID NO: 42628, SEQ ID NO: 42653, SEQ ID NO: 42685, SEQ ID NO: 42703, SEQ ID NO: 42872, SEQ ID NO: 43008, SEQ ID NO: 43046, SEQ ID NO: 43083, SEQ ID NO: 43333, SEQ ID NO: 43429, SEQ ID NO: 43564, SEQ ID NO: 43780, SEQ ID NO: 43836, SEQ ID NO: 43881, SEQ ID NO: 43898, SEQ ID NO: 43932, SEQ ID NO: 44048, SEQ ID NO: 44181, SEQ ID NO: 44328, SEQ ID NO: 44456, SEQ ID NO: 44523, SEQ ID NO: 44566, SEQ ID NO: 44773, SEQ ID NO: 44877, SEQ ID NO: 45197, SEQ ID NO: 45385, SEQ ID NO: 45450, SEQ ID NO: 45556, SEQ ID NO: 45580, SEQ ID NO: 45584, SEQ ID NO: 45599, SEQ ID NO: 45765, SEQ ID NO: 45829, SEQ ID NO: 45894, SEQ ID NO: 45915, SEQ ID NO: 46273, SEQ ID NO: 46400, SEQ ID NO: 46421, SEQ ID NO: 46457, SEQ ID NO: 46459, SEQ ID NO: 46484, SEQ ID NO: 46666, SEQ ID NO: 46678, SEQ ID NO: 46689, SEQ ID NO: 46981, SEQ ID NO: 46991, SEQ ID NO: 46993, SEQ ID NO: 47047, SEQ ID NO: 47151, SEQ ID NO: 47324, SEQ ID NO: 47432, SEQ ID NO: 47592, SEQ ID NO: 47673, SEQ ID NO: 47895, SEQ ID NO: 47960, SEQ ID NO: 47964, SEQ ID NO: 47979, SEQ ID NO: 47984, SEQ ID NO: 48034, SEQ ID NO: 48113, SEQ ID NO: 48118, SEQ ID NO: 48300, SEQ ID NO: 48436, SEQ ID NOs: 48461 to 48462, SEQ ID NO: 48469, SEQ ID NO: 48574, SEQ ID NO: 48680, SEQ ID NO: 48796, SEQ ID NO: 48832, SEQ ID NO: 48838, SEQ ID NO: 48845, SEQ ID NO: 48877, SEQ ID NO: 48947, SEQ ID NO: 49019, SEQ ID NO: 49111, SEQ ID NO: 49176, SEQ ID NO: 49263, SEQ ID NO: 49395, SEQ ID NO: 49462, SEQ ID NO: 49557, SEQ ID NO: 49823, SEQ ID NO: 49883, SEQ ID NO: 50062, SEQ ID NO: 50167, SEQ ID NO: 50305, SEQ ID NO: 50394, SEQ ID NO: 50401, SEQ ID NO: 50423, SEQ ID NO: 50428, SEQ ID NO: 50443, SEQ ID NO: 50450, SEQ ID NO: 50564, SEQ ID NO: 50574, SEQ ID NO: 50632, SEQ ID NO: 50678, and SEQ ID NOs: 68238 to 95592. In some embodiments, any one of the peptides in the MAGC1 vaccine comprise an amino acid sequence 80, 81, 82, 83, 84, 85, 86, 87, 88, 89, 90, 91, 92, 93, 94, 95, 96, 97, 98 or 99% identical to SEQ ID NO: 41352, SEQ ID NO: 41478, SEQ ID NO: 41495, SEQ ID NO: 41725, SEQ ID NO: 41847, SEQ ID NO: 42129, SEQ ID NO: 42135, SEQ ID NO: 42168, SEQ ID NO: 42170, SEQ ID NO: 42195, SEQ ID NO: 42218, SEQ ID NO: 42229, SEQ ID NO: 42458, SEQ ID NO: 42545, SEQ ID NO: 42628, SEQ ID NO: 42653, SEQ ID NO: 42685, SEQ ID NO: 42703, SEQ ID NO: 42872, SEQ ID NO: 43008, SEQ ID NO: 43046, SEQ ID NO: 43083, SEQ ID NO: 43333, SEQ ID NO: 43429, SEQ ID NO: 43564, SEQ ID NO: 43780, SEQ ID NO: 43836, SEQ ID NO: 43881, SEQ ID NO: 43898, SEQ ID NO: 43932, SEQ ID NO: 44048, SEQ ID NO: 44181, SEQ ID NO: 44328, SEQ ID NO: 44456, SEQ ID NO: 44523, SEQ ID NO: 44566, SEQ ID NO: 44773, SEQ ID NO: 44877, SEQ ID NO: 45197, SEQ ID NO: 45385, SEQ ID NO: 45450, SEQ ID NO: 45556, SEQ ID NO: 45580, SEQ ID NO: 45584, SEQ ID NO: 45599, SEQ ID NO: 45765, SEQ ID NO: 45829, SEQ ID NO: 45894, SEQ ID NO: 45915, SEQ ID NO: 46273, SEQ ID NO: 46400, SEQ ID NO: 46421, SEQ ID NO: 46457, SEQ ID NO: 46459, SEQ ID NO: 46484, SEQ ID NO: 46666, SEQ ID NO: 46678, SEQ ID NO: 46689, SEQ ID NO: 46981, SEQ ID NO: 46991, SEQ ID NO: 46993, SEQ ID NO: 47047, SEQ ID NO: 47151, SEQ ID NO: 47324, SEQ ID NO: 47432, SEQ ID NO: 47592, SEQ ID NO: 47673, SEQ ID NO: 47895, SEQ ID NO: 47960, SEQ ID NO: 47964, SEQ ID NO: 47979, SEQ ID NO: 47984, SEQ ID NO: 48034, SEQ ID NO: 48113, SEQ ID NO: 48118, SEQ ID NO: 48300, SEQ ID NO: 48436, SEQ ID NOs: 48461 to 48462, SEQ ID NO: 48469, SEQ ID NO: 48574, SEQ ID NO: 48680, SEQ ID NO: 48796, SEQ ID NO: 48832, SEQ ID NO: 48838, SEQ ID NO: 48845, SEQ ID NO: 48877, SEQ ID NO: 48947, SEQ ID NO: 49019, SEQ ID NO: 49111, SEQ ID NO: 49176, SEQ ID NO: 49263, SEQ ID NO: 49395, SEQ ID NO: 49462, SEQ ID NO: 49557, SEQ ID NO: 49823, SEQ ID NO: 49883, SEQ ID NO: 50062, SEQ ID NO: 50167, SEQ ID NO: 50305, SEQ ID NO: 50394, SEQ ID NO: 50401, SEQ ID NO: 50423, SEQ ID NO: 50428, SEQ ID NO: 50443, SEQ ID NO: 50450, SEQ ID NO: 50564, SEQ ID NO: 50574, SEQ ID NO: 50632, SEQ ID NO: 50678, or SEQ ID NOs: 68238 to 95592.

In some embodiments, the amino acid sequence for a MHC class I peptide vaccine for the MAGC3 protein comprises one or more of the SEQ ID NO: 68285, SEQ ID NO: 68290, SEQ ID NO: 68305, SEQ ID NO: 77091, SEQ ID NO: 77210, SEQ ID NO: 84188, SEQ ID NO: 87951, SEQ ID NO: 88144, and SEQ ID NOs: 95593 to 95664. In some embodiments, any one of the peptides in the MAGC3 vaccine comprise an amino acid sequence 80, 81, 82, 83, 84, 85, 86, 87, 88, 89, 90, 91, 92, 93, 94, 95, 96, 97, 98 or 99% identical to SEQ ID NO: 68285, SEQ ID NO: 68290, SEQ ID NO: 68305, SEQ ID NO: 77091, SEQ ID NO: 77210, SEQ ID NO: 84188, SEQ ID NO: 87951, SEQ ID NO: 88144, or SEQ ID NOs: 95593 to 95664.

In some embodiments, the amino acid sequence for a MHC class I peptide vaccine for the MAGC3 protein comprises one or more of the SEQ ID NO: 41647, SEQ ID NO: 50668, SEQ ID NO: 50905, SEQ ID NOs: 51039 to 51040, SEQ ID NO: 68257, SEQ ID NO: 68285, SEQ ID NO: 68288, SEQ ID NO: 68290, SEQ ID NO: 68305, SEQ ID NO: 68389, SEQ ID NO: 68419, SEQ ID NO: 68470, SEQ ID NO: 68510, SEQ ID NO: 68519, SEQ ID NO: 68592, SEQ ID NO: 68603, SEQ ID NO: 68684, SEQ ID NO: 68688, SEQ ID NO: 68747, SEQ ID NO: 68760, SEQ ID NO: 68778, SEQ ID NO: 68786, SEQ ID NO: 68855, SEQ ID NO: 68898, SEQ ID NO: 68900, SEQ ID NO: 68927, SEQ ID NO: 68961, SEQ ID NO: 69026, SEQ ID NO: 69041, SEQ ID NO: 69047, SEQ ID NO: 69148, SEQ ID NO: 69173, SEQ ID NO: 69180, SEQ ID NO: 69192, SEQ ID NO: 69227, SEQ ID NO: 69311, SEQ ID NO: 69330, SEQ ID NO: 69333, SEQ ID NO: 69346, SEQ ID NO: 69356, SEQ ID NO: 69393, SEQ ID NO: 69421, SEQ ID NO: 69437, SEQ ID NO: 69451, SEQ ID NO: 69500, SEQ ID NO: 69505, SEQ ID NO: 69517, SEQ ID NO: 69540, SEQ ID NO: 69559, SEQ ID NO: 69571, SEQ ID NO: 69586, SEQ ID NO: 69589, SEQ ID NO: 69591, SEQ ID NO: 69619, SEQ ID NO: 69631, SEQ ID NO: 69633, SEQ ID NO: 69644, SEQ ID NO: 69649, SEQ ID NO: 69747, SEQ ID NO: 69764, SEQ ID NO: 69767, SEQ ID NO: 69790, SEQ ID NO: 69832, SEQ ID NO: 69836, SEQ ID NO: 69882, SEQ ID NO: 69999, SEQ ID NO: 70012, SEQ ID NO: 70036, SEQ ID NO: 70050, SEQ ID NO: 70066, SEQ ID NO: 70069, SEQ ID NO: 70109, SEQ ID NO: 70159, SEQ ID NO: 70165, SEQ ID NO: 70175, SEQ ID NO: 70177, SEQ ID NO: 70188, SEQ ID NO: 70284, SEQ ID NO: 70323, SEQ ID NO: 70326, SEQ ID NO: 70428, SEQ ID NO: 70455, SEQ ID NO: 70570, SEQ ID NO: 70606, SEQ ID NO: 70635, SEQ ID NO: 70676, SEQ ID NO: 70692, SEQ ID NO: 70716, SEQ ID NO: 70728, SEQ ID NO: 70735, SEQ ID NO: 70750, SEQ ID NO: 70764, SEQ ID NO: 70770, SEQ ID NO: 70806, SEQ ID NO: 70968, SEQ ID NO: 70997, SEQ ID NO: 71049, SEQ ID NO: 71075, SEQ ID NO: 71090, SEQ ID NO: 71117, SEQ ID NO: 71151, SEQ ID NO: 71176, SEQ ID NO: 71193, SEQ ID NO: 71203, SEQ ID NO: 71239, SEQ ID NO: 71247, SEQ ID NO: 71249, SEQ ID NO: 71275, SEQ ID NO: 71287, SEQ ID NO: 71328, SEQ ID NOs: 71359 to 71360, SEQ ID NOs: 71367 to 71368, SEQ ID NO: 71392, SEQ ID NO: 71414, SEQ ID NO: 71449, SEQ ID NO: 71476, SEQ ID NO: 71482, SEQ ID NO: 71543, SEQ ID NO: 71547, SEQ ID NO: 71560, SEQ ID NO: 71585, SEQ ID NO: 71612, SEQ ID NO: 71620, SEQ ID NO: 71628, SEQ ID NO: 71636, SEQ ID NO: 71673, SEQ ID NOs: 71688 to 71689, SEQ ID NO: 71696, SEQ ID NO: 71700, SEQ ID NO: 71718, SEQ ID NO: 71725, SEQ ID NO: 71807, SEQ ID NO: 71919, SEQ ID NO: 71935, SEQ ID NO: 71943, SEQ ID NO: 71948, SEQ ID NOs: 71987 to 71988, SEQ ID NO: 72045, SEQ ID NO: 72055, SEQ ID NO: 72076, SEQ ID NO: 72085, SEQ ID NO: 72102, SEQ ID NO: 72159, SEQ ID NO: 72183, SEQ ID NO: 72216, SEQ ID NO: 72241, SEQ ID NO: 72331, SEQ ID NO: 72364, SEQ ID NO: 72372, SEQ ID NO: 72390, SEQ ID NO: 72448, SEQ ID NO: 72528, SEQ ID NO: 72595, SEQ ID NO: 72604, SEQ ID NO: 72648, SEQ ID NO: 72667, SEQ ID NO: 72685, SEQ ID NO: 72721, SEQ ID NO: 72751, SEQ ID NO: 72755, SEQ ID NO: 72805, SEQ ID NO: 72810, SEQ ID NO: 72831, SEQ ID NO: 72837, SEQ ID NO: 72862, SEQ ID NO: 72885, SEQ ID NO: 72989, SEQ ID NO: 73014, SEQ ID NOs: 73045 to 73046, SEQ ID NO: 73086, SEQ ID NO: 73094, SEQ ID NO: 73113, SEQ ID NO: 73122, SEQ ID NO: 73161, SEQ ID NO: 73191, SEQ ID NO: 73224, SEQ ID NOs: 73232 to 73233, SEQ ID NO: 73238, SEQ ID NO: 73290, SEQ ID NO: 73327, SEQ ID NO: 73377, SEQ ID NO: 73382, SEQ ID NO: 73404, SEQ ID NO: 73406, SEQ ID NO: 73422, SEQ ID NOs: 73428 to 73429, SEQ ID NO: 73466, SEQ ID NO: 73475, SEQ ID NO: 73521, SEQ ID NO: 73523, SEQ ID NO: 73532, SEQ ID NO: 73550, SEQ ID NO: 73560, SEQ ID NO: 73591, SEQ ID NO: 73597, SEQ ID NO: 73644, SEQ ID NO: 73657, SEQ ID NO: 73660, SEQ ID NO: 73689, SEQ ID NO: 73729, SEQ ID NO: 73733, SEQ ID NO: 73873, SEQ ID NO: 73886, SEQ ID NO: 73930, SEQ ID NO: 73957, SEQ ID NOs: 73991 to 73992, SEQ ID NO: 74045, SEQ ID NO: 74047, SEQ ID NO: 74072, SEQ ID NO: 74080, SEQ ID NOs: 74096 to 74097, SEQ ID NO: 74107, SEQ ID NO: 74203, SEQ ID NO: 74208, SEQ ID NO: 74210, SEQ ID NO: 74238, SEQ ID NO: 74302, SEQ ID NO: 74350, SEQ ID NO: 74352, SEQ ID NO: 74411, SEQ ID NO: 74448, SEQ ID NO: 74473, SEQ ID NO: 74482, SEQ ID NO: 74515, SEQ ID NO: 74527, SEQ ID NO: 74560, SEQ ID NO: 74616, SEQ ID NO: 74649, SEQ ID NO: 74672, SEQ ID NO: 74674, SEQ ID NO: 74737, SEQ ID NO: 74782, SEQ ID NO: 74808, SEQ ID NO: 74810, SEQ ID NO: 74835, SEQ ID NO: 74886, SEQ ID NO: 74901, SEQ ID NO: 74946, SEQ ID NOs: 74975 to 74976, SEQ ID NO: 75017, SEQ ID NO: 75021, SEQ ID NO: 75040, SEQ ID NO: 75049, SEQ ID NO: 75063, SEQ ID NO: 75066, SEQ ID NO: 75072, SEQ ID NO: 75092, SEQ ID NO: 75094, SEQ ID NO: 75099, SEQ ID NO: 75111, SEQ ID NO: 75148, SEQ ID NO: 75245, SEQ ID NO: 75269, SEQ ID NO: 75388, SEQ ID NO: 75403, SEQ ID NO: 75429, SEQ ID NO: 75455, SEQ ID NO: 75470, SEQ ID NO: 75489, SEQ ID NO: 75506, SEQ ID NO: 75529, SEQ ID NO: 75547, SEQ ID NO: 75551, SEQ ID NOs: 75576 to 75577, SEQ ID NO: 75595, SEQ ID NO: 75701, SEQ ID NO: 75716, SEQ ID NO: 75747, SEQ ID NO: 75757, SEQ ID NO: 75762, SEQ ID NO: 75766, SEQ ID NO: 75874, SEQ ID NO: 75915, SEQ ID NO: 75933, SEQ ID NO: 75975, SEQ ID NO: 75979, SEQ ID NO: 76016, SEQ ID NO: 76023, SEQ ID NO: 76034, SEQ ID NO: 76040, SEQ ID NO: 76064, SEQ ID NO: 76076, SEQ ID NO: 76102, SEQ ID NOs: 76147 to 76148, SEQ ID NO: 76189, SEQ ID NO: 76199, SEQ ID NO: 76369, SEQ ID NO: 76375, SEQ ID NO: 76397, SEQ ID NO: 76410, SEQ ID NO: 76435, SEQ ID NO: 76446, SEQ ID NO: 76451, SEQ ID NOs: 76456 to 76458, SEQ ID NO: 76492, SEQ ID NO: 76544, SEQ ID NO: 76569, SEQ ID NO: 76574, SEQ ID NO: 76611, SEQ ID NO: 76654, SEQ ID NO: 76710, SEQ ID NO: 76753, SEQ ID NO: 76769, SEQ ID NO: 76781, SEQ ID NO: 76797, SEQ ID NO: 76803, SEQ ID NO: 76858, SEQ ID NO: 76860, SEQ ID NO: 76879, SEQ ID NO: 76943, SEQ ID NO: 76971, SEQ ID NO: 76981, SEQ ID NO: 77091, SEQ ID NO: 77133, SEQ ID NOs: 77193 to 77194, SEQ ID NO: 77210, SEQ ID NO: 77219, SEQ ID NO: 77237, SEQ ID NO: 77246, SEQ ID NO: 77251, SEQ ID NO: 77281, SEQ ID NO: 77293, SEQ ID NO: 77323, SEQ ID NO: 77334, SEQ ID NO: 77339, SEQ ID NO: 77396, SEQ ID NO: 77423, SEQ ID NO: 77433, SEQ ID NO: 77437, SEQ ID NO: 77442, SEQ ID NO: 77453, SEQ ID NO: 77485, SEQ ID NO: 77579, SEQ ID NO: 77627, SEQ ID NO: 77639, SEQ ID NO: 77644, SEQ ID NO: 77703, SEQ ID NO: 77773, SEQ ID NO: 77814, SEQ ID NO: 77868, SEQ ID NO: 77874, SEQ ID NO: 77900, SEQ ID NO: 77925, SEQ ID NO: 77995, SEQ ID NO: 78017, SEQ ID NO: 78083, SEQ ID NO: 78086, SEQ ID NO: 78090, SEQ ID NO: 78131, SEQ ID NO: 78139, SEQ ID NO: 78228, SEQ ID NO: 78248, SEQ ID NO: 78260, SEQ ID NO: 78346, SEQ ID NO: 78352, SEQ ID NO: 78377, SEQ ID NO: 78416, SEQ ID NO: 78421, SEQ ID NO: 78440, SEQ ID NO: 78521, SEQ ID NO: 78530, SEQ ID NO: 78532, SEQ ID NO: 78546, SEQ ID NO: 78600, SEQ ID NO: 78631, SEQ ID NO: 78671, SEQ ID NO: 78709, SEQ ID NO: 78714, SEQ ID NO: 78730, SEQ ID NO: 78738, SEQ ID NO: 78810, SEQ ID NO: 78855, SEQ ID NO: 78883, SEQ ID NO: 78917, SEQ ID NOs: 78919 to 78920, SEQ ID NO: 78928, SEQ ID NO: 79035, SEQ ID NO: 79048, SEQ ID NO: 79056, SEQ ID NO: 79086, SEQ ID NO: 79091, SEQ ID NO: 79095, SEQ ID NO: 79107, SEQ ID NO: 79109, SEQ ID NO: 79136, SEQ ID NO: 79142, SEQ ID NO: 79147, SEQ ID NO: 79151, SEQ ID NO: 79194, SEQ ID NO: 79196, SEQ ID NO: 79227, SEQ ID NO: 79247, SEQ ID NO: 79253, SEQ ID NO: 79255, SEQ ID NO: 79269, SEQ ID NO: 79310, SEQ ID NO: 79331, SEQ ID NO: 79357, SEQ ID NO: 79406, SEQ ID NO: 79437, SEQ ID NO: 79448, SEQ ID NO: 79453, SEQ ID NO: 79480, SEQ ID NO: 79483, SEQ ID NO: 79486, SEQ ID NO: 79504, SEQ ID NO: 79508, SEQ ID NO: 79516, SEQ ID NO: 79548, SEQ ID NO: 79575, SEQ ID NO: 79588, SEQ ID NO: 79592, SEQ ID NO: 79609, SEQ ID NO: 79626, SEQ ID NO: 79640, SEQ ID NO: 79697, SEQ ID NO: 79746, SEQ ID NO: 79751, SEQ ID NO: 79766, SEQ ID NO: 79784, SEQ ID NO: 79787, SEQ ID NO: 79816, SEQ ID NO: 79834, SEQ ID NO: 79853, SEQ ID NO: 79858, SEQ ID NO: 79861, SEQ ID NO: 79874, SEQ ID NO: 79877, SEQ ID NO: 79906, SEQ ID NO: 79909, SEQ ID NO: 79939, SEQ ID NO: 79958, SEQ ID NO: 79987, SEQ ID NO: 80000, SEQ ID NO: 80027, SEQ ID NO: 80040, SEQ ID NO: 80139, SEQ ID NO: 80141, SEQ ID NO: 80212, SEQ ID NO: 80232, SEQ ID NO: 80237, SEQ ID NO: 80241, SEQ ID NO: 80318, SEQ ID NO: 80320, SEQ ID NOs: 80367 to 80368, SEQ ID NO: 80398, SEQ ID NO: 80421, SEQ ID NO: 80461, SEQ ID NO: 80486, SEQ ID NO: 80513, SEQ ID NO: 80527, SEQ ID NO: 80555, SEQ ID NO: 80574, SEQ ID NO: 80583, SEQ ID NO: 80627, SEQ ID NO: 80673, SEQ ID NOs: 80703 to 80704, SEQ ID NOs: 80718 to 80719, SEQ ID NO: 80725, SEQ ID NO: 80796, SEQ ID NO: 80804, SEQ ID NO: 80833, SEQ ID NO: 80869, SEQ ID NO: 80903, SEQ ID NO: 80931, SEQ ID NO: 80936, SEQ ID NO: 80946, SEQ ID NO: 80990, SEQ ID NO: 81021, SEQ ID NO: 81042, SEQ ID NO: 81046, SEQ ID NO: 81054, SEQ ID NO: 81066, SEQ ID NO: 81145, SEQ ID NO: 81166, SEQ ID NO: 81168, SEQ ID NO: 81175, SEQ ID NO: 81185, SEQ ID NO: 81207, SEQ ID NO: 81251, SEQ ID NO: 81259, SEQ ID NO: 81302, SEQ ID NO: 81337, SEQ ID NO: 81342, SEQ ID NO: 81386, SEQ ID NO: 81428, SEQ ID NO: 81446, SEQ ID NO: 81458, SEQ ID NO: 81488, SEQ ID NO: 81505, SEQ ID NO: 81517, SEQ ID NO: 81566, SEQ ID NO: 81687, SEQ ID NO: 81690, SEQ ID NO: 81694, SEQ ID NO: 81713, SEQ ID NO: 81755, SEQ ID NO: 81825, SEQ ID NO: 81856, SEQ ID NO: 81873, SEQ ID NO: 81904, SEQ ID NO: 81916, SEQ ID NO: 81938, SEQ ID NO: 81951, SEQ ID NO: 81963, SEQ ID NO: 82045, SEQ ID NO: 82085, SEQ ID NO: 82117, SEQ ID NO: 82136, SEQ ID NO: 82193, SEQ ID NO: 82239, SEQ ID NO: 82241, SEQ ID NO: 82259, SEQ ID NO: 82320, SEQ ID NO: 82382, SEQ ID NO: 82417, SEQ ID NO: 82459, SEQ ID NO: 82474, SEQ ID NO: 82514, SEQ ID NO: 82556, SEQ ID NO: 82581, SEQ ID NO: 82596, SEQ ID NO: 82633, SEQ ID NO: 82644, SEQ ID NO: 82649, SEQ ID NO: 82676, SEQ ID NO: 82681, SEQ ID NO: 82718, SEQ ID NO: 82731, SEQ ID NO: 82769, SEQ ID NO: 82817, SEQ ID NO: 82870, SEQ ID NO: 82872, SEQ ID NO: 82885, SEQ ID NOs: 82920 to 82921, SEQ ID NO: 82955, SEQ ID NO: 82960, SEQ ID NO: 82985, SEQ ID NO: 82988, SEQ ID NO: 83013, SEQ ID NO: 83018, SEQ ID NO: 83051, SEQ ID NO: 83062, SEQ ID NO: 83099, SEQ ID NO: 83149, SEQ ID NO: 83185, SEQ ID NO: 83193, SEQ ID NO: 83208, SEQ ID NO: 83225, SEQ ID NO: 83235, SEQ ID NO: 83243, SEQ ID NO: 83260, SEQ ID NO: 83269, SEQ ID NO: 83286, SEQ ID NO: 83293, SEQ ID NO: 83349, SEQ ID NO: 83383, SEQ ID NO: 83409, SEQ ID NO: 83426, SEQ ID NO: 83438, SEQ ID NO: 83549, SEQ ID NO: 83605, SEQ ID NO: 83686, SEQ ID NO: 83704, SEQ ID NO: 83714, SEQ ID NO: 83806, SEQ ID NO: 83811, SEQ ID NO: 83821, SEQ ID NOs: 83863 to 83864, SEQ ID NO: 83872, SEQ ID NO: 83891, SEQ ID NO: 83899, SEQ ID NO: 83901, SEQ ID NO: 83921, SEQ ID NO: 83970, SEQ ID NO: 83974, SEQ ID NO: 83988, SEQ ID NO: 84002, SEQ ID NO: 84025, SEQ ID NO: 84070, SEQ ID NO: 84090, SEQ ID NO: 84154, SEQ ID NO: 84182, SEQ ID NOs: 84187 to 84188, SEQ ID NO: 84201, SEQ ID NO: 84212, SEQ ID NO: 84232, SEQ ID NO: 84238, SEQ ID NO: 84248, SEQ ID NO: 84306, SEQ ID NO: 84324, SEQ ID NO: 84348, SEQ ID NO: 84376, SEQ ID NO: 84387, SEQ ID NO: 84390, SEQ ID NO: 84422, SEQ ID NO: 84428, SEQ ID NO: 84437, SEQ ID NO: 84445, SEQ ID NO: 84489, SEQ ID NO: 84501, SEQ ID NO: 84534, SEQ ID NO: 84558, SEQ ID NO: 84593, SEQ ID NO: 84676, SEQ ID NO: 84782, SEQ ID NO: 84795, SEQ ID NO: 84822, SEQ ID NO: 84885, SEQ ID NO: 84991, SEQ ID NO: 85010, SEQ ID NO: 85024, SEQ ID NO: 85054, SEQ ID NO: 85056, SEQ ID NO: 85060, SEQ ID NO: 85101, SEQ ID NO: 85117, SEQ ID NO: 85146, SEQ ID NO: 85219, SEQ ID NOs: 85242 to 85243, SEQ ID NO: 85266, SEQ ID NO: 85310, SEQ ID NO: 85349, SEQ ID NO: 85361, SEQ ID NO: 85370, SEQ ID NO: 85379, SEQ ID NO: 85399, SEQ ID NO: 85417, SEQ ID NO: 85435, SEQ ID NO: 85447, SEQ ID NO: 85463, SEQ ID NO: 85519, SEQ ID NO: 85528, SEQ ID NO: 85530, SEQ ID NO: 85602, SEQ ID NO: 85624, SEQ ID NO: 85629, SEQ ID NO: 85725, SEQ ID NO: 85737, SEQ ID NO: 85848, SEQ ID NO: 85878, SEQ ID NO: 85910, SEQ ID NO: 85959, SEQ ID NO: 85963, SEQ ID NO: 85967, SEQ ID NOs: 85985 to 85986, SEQ ID NO: 86003, SEQ ID NO: 86076, SEQ ID NO: 86159, SEQ ID NO: 86208, SEQ ID NO: 86248, SEQ ID NO: 86279, SEQ ID NO: 86343, SEQ ID NO: 86366, SEQ ID NO: 86417, SEQ ID NO: 86431, SEQ ID NO: 86433, SEQ ID NO: 86473, SEQ ID NO: 86523, SEQ ID NOs: 86526 to 86527, SEQ ID NO: 86541, SEQ ID NO: 86567, SEQ ID NO: 86586, SEQ ID NO: 86589, SEQ ID NO: 86599, SEQ ID NO: 86633, SEQ ID NO: 86665, SEQ ID NO: 86688, SEQ ID NO: 86698, SEQ ID NO: 86725, SEQ ID NO: 86761, SEQ ID NO: 86775, SEQ ID NO: 86825, SEQ ID NO: 86914, SEQ ID NO: 86929, SEQ ID NO: 86940, SEQ ID NO: 86969, SEQ ID NO: 86994, SEQ ID NO: 87027, SEQ ID NO: 87041, SEQ ID NO: 87157, SEQ ID NO: 87160, SEQ ID NO: 87185, SEQ ID NO: 87251, SEQ ID NO: 87255, SEQ ID NO: 87300, SEQ ID NO: 87321, SEQ ID NO: 87358, SEQ ID NO: 87425, SEQ ID NO: 87427, SEQ ID NO: 87431, SEQ ID NO: 87474, SEQ ID NO: 87536, SEQ ID NO: 87550, SEQ ID NO: 87576, SEQ ID NO: 87603, SEQ ID NO: 87623, SEQ ID NO: 87626, SEQ ID NO: 87638, SEQ ID NO: 87708, SEQ ID NO: 87733, SEQ ID NO: 87785, SEQ ID NO: 87799, SEQ ID NO: 87818, SEQ ID NOs: 87865 to 87866, SEQ ID NO: 87875, SEQ ID NO: 87917, SEQ ID NO: 87946, SEQ ID NO: 87951, SEQ ID NO: 88016, SEQ ID NO: 88061, SEQ ID NO: 88120, SEQ ID NO: 88122, SEQ ID NO: 88125, SEQ ID NO: 88144, SEQ ID NO: 88178, SEQ ID NO: 88180, SEQ ID NO: 88186, SEQ ID NO: 88203, SEQ ID NO: 88241, SEQ ID NO: 88272, SEQ ID NO: 88285, SEQ ID NO: 88288, SEQ ID NO: 88359, SEQ ID NO: 88384, SEQ ID NO: 88390, SEQ ID NO: 88474, SEQ ID NO: 88522, SEQ ID NO: 88563, SEQ ID NO: 88643, SEQ ID NO: 88659, SEQ ID NO: 88708, SEQ ID NO: 88710, SEQ ID NO: 88731, SEQ ID NO: 88751, SEQ ID NO: 88806, SEQ ID NO: 88975, SEQ ID NO: 88999, SEQ ID NO: 89010, SEQ ID NO: 89012, SEQ ID NO: 89028, SEQ ID NO: 89035, SEQ ID NO: 89037, SEQ ID NO: 89039, SEQ ID NO: 89045, SEQ ID NO: 89073, SEQ ID NO: 89118, SEQ ID NO: 89126, SEQ ID NO: 89135, SEQ ID NO: 89138, SEQ ID NO: 89147, SEQ ID NO: 89168, SEQ ID NO: 89193, SEQ ID NO: 89228, SEQ ID NO: 89235, SEQ ID NO: 89269, SEQ ID NO: 89286, SEQ ID NO: 89291, SEQ ID NO: 89339, SEQ ID NO: 89342, SEQ ID NO: 89394, SEQ ID NO: 89453, SEQ ID NO: 89492, SEQ ID NO: 89510, SEQ ID NO: 89555, SEQ ID NO: 89595, SEQ ID NO: 89670, SEQ ID NO: 89695, SEQ ID NO: 89785, SEQ ID NO: 89836, SEQ ID NO: 89842, SEQ ID NO: 89921, SEQ ID NO: 89929, SEQ ID NO: 89935, SEQ ID NO: 89938, SEQ ID NO: 89950, SEQ ID NO: 89953, SEQ ID NO: 89960, SEQ ID NO: 89987, SEQ ID NO: 89992, SEQ ID NO: 90030, SEQ ID NO: 90056, SEQ ID NO: 90066, SEQ ID NO: 90085, SEQ ID NO: 90089, SEQ ID NO: 90115, SEQ ID NO: 90120, SEQ ID NO: 90133, SEQ ID NO: 90157, SEQ ID NO: 90159, SEQ ID NO: 90191, SEQ ID NO: 90268, SEQ ID NO: 90274, SEQ ID NO: 90280, SEQ ID NO: 90287, SEQ ID NO: 90315, SEQ ID NO: 90408, SEQ ID NO: 90417, SEQ ID NO: 90443, SEQ ID NO: 90466, SEQ ID NO: 90507, SEQ ID NO: 90555, SEQ ID NO: 90593, SEQ ID NO: 90599, SEQ ID NO: 90621, SEQ ID NO: 90634, SEQ ID NO: 90653, SEQ ID NO: 90696, SEQ ID NO: 90758, SEQ ID NO: 90777, SEQ ID NO: 90835, SEQ ID NO: 90882, SEQ ID NO: 90898, SEQ ID NO: 90938, SEQ ID NO: 90954, SEQ ID NO: 90999, SEQ ID NO: 91045, SEQ ID NO: 91060, SEQ ID NO: 91072, SEQ ID NO: 91076, SEQ ID NO: 91105, SEQ ID NO: 91132, SEQ ID NO: 91222, SEQ ID NO: 91226, SEQ ID NO: 91229, SEQ ID NO: 91306, SEQ ID NO: 91309, SEQ ID NO: 91315, SEQ ID NO: 91346, SEQ ID NO: 91419, SEQ ID NO: 91449, SEQ ID NO: 91498, SEQ ID NO: 91563, SEQ ID NO: 91588, SEQ ID NO: 91681, SEQ ID NO: 91766, SEQ ID NOs: 91775 to 91776, SEQ ID NO: 91780, SEQ ID NO: 91799, SEQ ID NO: 91845, SEQ ID NO: 91852, SEQ ID NOs: 91885 to 91886, SEQ ID NO: 91930, SEQ ID NO: 91935, SEQ ID NO: 91953, SEQ ID NO: 91966, SEQ ID NO: 91984, SEQ ID NO: 92026, SEQ ID NO: 92030, SEQ ID NO: 92069, SEQ ID NO: 92100, SEQ ID NO: 92111, SEQ ID NO: 92189, SEQ ID NO: 92249, SEQ ID NO: 92296, SEQ ID NO: 92400, SEQ ID NO: 92404, SEQ ID NO: 92409, SEQ ID NO: 92429, SEQ ID NO: 92474, SEQ ID NO: 92500, SEQ ID NO: 92515, SEQ ID NO: 92538, SEQ ID NO: 92646, SEQ ID NO: 92659, SEQ ID NO: 92671, SEQ ID NO: 92673, SEQ ID NO: 92675, SEQ ID NO: 92684, SEQ ID NO: 92704, SEQ ID NO: 92832, SEQ ID NO: 92835, SEQ ID NO: 92854, SEQ ID NO: 92858, SEQ ID NO: 92877, SEQ ID NO: 92918, SEQ ID NO: 92920, SEQ ID NO: 93004, SEQ ID NO: 93036, SEQ ID NO: 93042, SEQ ID NO: 93071, SEQ ID NO: 93089, SEQ ID NO: 93136, SEQ ID NO: 93180, SEQ ID NO: 93251, SEQ ID NO: 93325, SEQ ID NO: 93335, SEQ ID NO: 93344, SEQ ID NO: 93356, SEQ ID NO: 93382, SEQ ID NO: 93408, SEQ ID NO: 93420, SEQ ID NO: 93503, SEQ ID NO: 93537, SEQ ID NO: 93617, SEQ ID NO: 93658, SEQ ID NO: 93697, SEQ ID NO: 93710, SEQ ID NO: 93877, SEQ ID NO: 93885, SEQ ID NO: 93888, SEQ ID NO: 93893, SEQ ID NO: 93903, SEQ ID NO: 93912, SEQ ID NO: 93926, SEQ ID NO: 93933, SEQ ID NO: 93982, SEQ ID NO: 93987, SEQ ID NO: 94000, SEQ ID NO: 94054, SEQ ID NO: 94058, SEQ ID NO: 94087, SEQ ID NO: 94090, SEQ ID NO: 94102, SEQ ID NO: 94143, SEQ ID NO: 94269, SEQ ID NO: 94367, SEQ ID NO: 94465, SEQ ID NO: 94477, SEQ ID NO: 94525, SEQ ID NO: 94587, and SEQ ID NOs: 95593 to 113807. In some embodiments, any one of the peptides in the MAGC3 vaccine comprise an amino acid sequence 80, 81, 82, 83, 84, 85, 86, 87, 88, 89, 90, 91, 92, 93, 94, 95, 96, 97, 98 or 99% identical to SEQ ID NO: 41647, SEQ ID NO: 50668, SEQ ID NO: 50905, SEQ ID NOs: 51039 to 51040, SEQ ID NO: 68257, SEQ ID NO: 68285, SEQ ID NO: 68288, SEQ ID NO: 68290, SEQ ID NO: 68305, SEQ ID NO: 68389, SEQ ID NO: 68419, SEQ ID NO: 68470, SEQ ID NO: 68510, SEQ ID NO: 68519, SEQ ID NO: 68592, SEQ ID NO: 68603, SEQ ID NO: 68684, SEQ ID NO: 68688, SEQ ID NO: 68747, SEQ ID NO: 68760, SEQ ID NO: 68778, SEQ ID NO: 68786, SEQ ID NO: 68855, SEQ ID NO: 68898, SEQ ID NO: 68900, SEQ ID NO: 68927, SEQ ID NO: 68961, SEQ ID NO: 69026, SEQ ID NO: 69041, SEQ ID NO: 69047, SEQ ID NO: 69148, SEQ ID NO: 69173, SEQ ID NO: 69180, SEQ ID NO: 69192, SEQ ID NO: 69227, SEQ ID NO: 69311, SEQ ID NO: 69330, SEQ ID NO: 69333, SEQ ID NO: 69346, SEQ ID NO: 69356, SEQ ID NO: 69393, SEQ ID NO: 69421, SEQ ID NO: 69437, SEQ ID NO: 69451, SEQ ID NO: 69500, SEQ ID NO: 69505, SEQ ID NO: 69517, SEQ ID NO: 69540, SEQ ID NO: 69559, SEQ ID NO: 69571, SEQ ID NO: 69586, SEQ ID NO: 69589, SEQ ID NO: 69591, SEQ ID NO: 69619, SEQ ID NO: 69631, SEQ ID NO: 69633, SEQ ID NO: 69644, SEQ ID NO: 69649, SEQ ID NO: 69747, SEQ ID NO: 69764, SEQ ID NO: 69767, SEQ ID NO: 69790, SEQ ID NO: 69832, SEQ ID NO: 69836, SEQ ID NO: 69882, SEQ ID NO: 69999, SEQ ID NO: 70012, SEQ ID NO: 70036, SEQ ID NO: 70050, SEQ ID NO: 70066, SEQ ID NO: 70069, SEQ ID NO: 70109, SEQ ID NO: 70159, SEQ ID NO: 70165, SEQ ID NO: 70175, SEQ ID NO: 70177, SEQ ID NO: 70188, SEQ ID NO: 70284, SEQ ID NO: 70323, SEQ ID NO: 70326, SEQ ID NO: 70428, SEQ ID NO: 70455, SEQ ID NO: 70570, SEQ ID NO: 70606, SEQ ID NO: 70635, SEQ ID NO: 70676, SEQ ID NO: 70692, SEQ ID NO: 70716, SEQ ID NO: 70728, SEQ ID NO: 70735, SEQ ID NO: 70750, SEQ ID NO: 70764, SEQ ID NO: 70770, SEQ ID NO: 70806, SEQ ID NO: 70968, SEQ ID NO: 70997, SEQ ID NO: 71049, SEQ ID NO: 71075, SEQ ID NO: 71090, SEQ ID NO: 71117, SEQ ID NO: 71151, SEQ ID NO: 71176, SEQ ID NO: 71193, SEQ ID NO: 71203, SEQ ID NO: 71239, SEQ ID NO: 71247, SEQ ID NO: 71249, SEQ ID NO: 71275, SEQ ID NO: 71287, SEQ ID NO: 71328, SEQ ID NOs: 71359 to 71360, SEQ ID NOs: 71367 to 71368, SEQ ID NO: 71392, SEQ ID NO: 71414, SEQ ID NO: 71449, SEQ ID NO: 71476, SEQ ID NO: 71482, SEQ ID NO: 71543, SEQ ID NO: 71547, SEQ ID NO: 71560, SEQ ID NO: 71585, SEQ ID NO: 71612, SEQ ID NO: 71620, SEQ ID NO: 71628, SEQ ID NO: 71636, SEQ ID NO: 71673, SEQ ID NOs: 71688 to 71689, SEQ ID NO: 71696, SEQ ID NO: 71700, SEQ ID NO: 71718, SEQ ID NO: 71725, SEQ ID NO: 71807, SEQ ID NO: 71919, SEQ ID NO: 71935, SEQ ID NO: 71943, SEQ ID NO: 71948, SEQ ID NOs: 71987 to 71988, SEQ ID NO: 72045, SEQ ID NO: 72055, SEQ ID NO: 72076, SEQ ID NO: 72085, SEQ ID NO: 72102, SEQ ID NO: 72159, SEQ ID NO: 72183, SEQ ID NO: 72216, SEQ ID NO: 72241, SEQ ID NO: 72331, SEQ ID NO: 72364, SEQ ID NO: 72372, SEQ ID NO: 72390, SEQ ID NO: 72448, SEQ ID NO: 72528, SEQ ID NO: 72595, SEQ ID NO: 72604, SEQ ID NO: 72648, SEQ ID NO: 72667, SEQ ID NO: 72685, SEQ ID NO: 72721, SEQ ID NO: 72751, SEQ ID NO: 72755, SEQ ID NO: 72805, SEQ ID NO: 72810, SEQ ID NO: 72831, SEQ ID NO: 72837, SEQ ID NO: 72862, SEQ ID NO: 72885, SEQ ID NO: 72989, SEQ ID NO: 73014, SEQ ID NOs: 73045 to 73046, SEQ ID NO: 73086, SEQ ID NO: 73094, SEQ ID NO: 73113, SEQ ID NO: 73122, SEQ ID NO: 73161, SEQ ID NO: 73191, SEQ ID NO: 73224, SEQ ID NOs: 73232 to 73233, SEQ ID NO: 73238, SEQ ID NO: 73290, SEQ ID NO: 73327, SEQ ID NO: 73377, SEQ ID NO: 73382, SEQ ID NO: 73404, SEQ ID NO: 73406, SEQ ID NO: 73422, SEQ ID NOs: 73428 to 73429, SEQ ID NO: 73466, SEQ ID NO: 73475, SEQ ID NO: 73521, SEQ ID NO: 73523, SEQ ID NO: 73532, SEQ ID NO: 73550, SEQ ID NO: 73560, SEQ ID NO: 73591, SEQ ID NO: 73597, SEQ ID NO: 73644, SEQ ID NO: 73657, SEQ ID NO: 73660, SEQ ID NO: 73689, SEQ ID NO: 73729, SEQ ID NO: 73733, SEQ ID NO: 73873, SEQ ID NO: 73886, SEQ ID NO: 73930, SEQ ID NO: 73957, SEQ ID NOs: 73991 to 73992, SEQ ID NO: 74045, SEQ ID NO: 74047, SEQ ID NO: 74072, SEQ ID NO: 74080, SEQ ID NOs: 74096 to 74097, SEQ ID NO: 74107, SEQ ID NO: 74203, SEQ ID NO: 74208, SEQ ID NO: 74210, SEQ ID NO: 74238, SEQ ID NO: 74302, SEQ ID NO: 74350, SEQ ID NO: 74352, SEQ ID NO: 74411, SEQ ID NO: 74448, SEQ ID NO: 74473, SEQ ID NO: 74482, SEQ ID NO: 74515, SEQ ID NO: 74527, SEQ ID NO: 74560, SEQ ID NO: 74616, SEQ ID NO: 74649, SEQ ID NO: 74672, SEQ ID NO: 74674, SEQ ID NO: 74737, SEQ ID NO: 74782, SEQ ID NO: 74808, SEQ ID NO: 74810, SEQ ID NO: 74835, SEQ ID NO: 74886, SEQ ID NO: 74901, SEQ ID NO: 74946, SEQ ID NOs: 74975 to 74976, SEQ ID NO: 75017, SEQ ID NO: 75021, SEQ ID NO: 75040, SEQ ID NO: 75049, SEQ ID NO: 75063, SEQ ID NO: 75066, SEQ ID NO: 75072, SEQ ID NO: 75092, SEQ ID NO: 75094, SEQ ID NO: 75099, SEQ ID NO: 75111, SEQ ID NO: 75148, SEQ ID NO: 75245, SEQ ID NO: 75269, SEQ ID NO: 75388, SEQ ID NO: 75403, SEQ ID NO: 75429, SEQ ID NO: 75455, SEQ ID NO: 75470, SEQ ID NO: 75489, SEQ ID NO: 75506, SEQ ID NO: 75529, SEQ ID NO: 75547, SEQ ID NO: 75551, SEQ ID NOs: 75576 to 75577, SEQ ID NO: 75595, SEQ ID NO: 75701, SEQ ID NO: 75716, SEQ ID NO: 75747, SEQ ID NO: 75757, SEQ ID NO: 75762, SEQ ID NO: 75766, SEQ ID NO: 75874, SEQ ID NO: 75915, SEQ ID NO: 75933, SEQ ID NO: 75975, SEQ ID NO: 75979, SEQ ID NO: 76016, SEQ ID NO: 76023, SEQ ID NO: 76034, SEQ ID NO: 76040, SEQ ID NO: 76064, SEQ ID NO: 76076, SEQ ID NO: 76102, SEQ ID NOs: 76147 to 76148, SEQ ID NO: 76189, SEQ ID NO: 76199, SEQ ID NO: 76369, SEQ ID NO: 76375, SEQ ID NO: 76397, SEQ ID NO: 76410, SEQ ID NO: 76435, SEQ ID NO: 76446, SEQ ID NO: 76451, SEQ ID NOs: 76456 to 76458, SEQ ID NO: 76492, SEQ ID NO: 76544, SEQ ID NO: 76569, SEQ ID NO: 76574, SEQ ID NO: 76611, SEQ ID NO: 76654, SEQ ID NO: 76710, SEQ ID NO: 76753, SEQ ID NO: 76769, SEQ ID NO: 76781, SEQ ID NO: 76797, SEQ ID NO: 76803, SEQ ID NO: 76858, SEQ ID NO: 76860, SEQ ID NO: 76879, SEQ ID NO: 76943, SEQ ID NO: 76971, SEQ ID NO: 76981, SEQ ID NO: 77091, SEQ ID NO: 77133, SEQ ID NOs: 77193 to 77194, SEQ ID NO: 77210, SEQ ID NO: 77219, SEQ ID NO: 77237, SEQ ID NO: 77246, SEQ ID NO: 77251, SEQ ID NO: 77281, SEQ ID NO: 77293, SEQ ID NO: 77323, SEQ ID NO: 77334, SEQ ID NO: 77339, SEQ ID NO: 77396, SEQ ID NO: 77423, SEQ ID NO: 77433, SEQ ID NO: 77437, SEQ ID NO: 77442, SEQ ID NO: 77453, SEQ ID NO: 77485, SEQ ID NO: 77579, SEQ ID NO: 77627, SEQ ID NO: 77639, SEQ ID NO: 77644, SEQ ID NO: 77703, SEQ ID NO: 77773, SEQ ID NO: 77814, SEQ ID NO: 77868, SEQ ID NO: 77874, SEQ ID NO: 77900, SEQ ID NO: 77925, SEQ ID NO: 77995, SEQ ID NO: 78017, SEQ ID NO: 78083, SEQ ID NO: 78086, SEQ ID NO: 78090, SEQ ID NO: 78131, SEQ ID NO: 78139, SEQ ID NO: 78228, SEQ ID NO: 78248, SEQ ID NO: 78260, SEQ ID NO: 78346, SEQ ID NO: 78352, SEQ ID NO: 78377, SEQ ID NO: 78416, SEQ ID NO: 78421, SEQ ID NO: 78440, SEQ ID NO: 78521, SEQ ID NO: 78530, SEQ ID NO: 78532, SEQ ID NO: 78546, SEQ ID NO: 78600, SEQ ID NO: 78631, SEQ ID NO: 78671, SEQ ID NO: 78709, SEQ ID NO: 78714, SEQ ID NO: 78730, SEQ ID NO: 78738, SEQ ID NO: 78810, SEQ ID NO: 78855, SEQ ID NO: 78883, SEQ ID NO: 78917, SEQ ID NOs: 78919 to 78920, SEQ ID NO: 78928, SEQ ID NO: 79035, SEQ ID NO: 79048, SEQ ID NO: 79056, SEQ ID NO: 79086, SEQ ID NO: 79091, SEQ ID NO: 79095, SEQ ID NO: 79107, SEQ ID NO: 79109, SEQ ID NO: 79136, SEQ ID NO: 79142, SEQ ID NO: 79147, SEQ ID NO: 79151, SEQ ID NO: 79194, SEQ ID NO: 79196, SEQ ID NO: 79227, SEQ ID NO: 79247, SEQ ID NO: 79253, SEQ ID NO: 79255, SEQ ID NO: 79269, SEQ ID NO: 79310, SEQ ID NO: 79331, SEQ ID NO: 79357, SEQ ID NO: 79406, SEQ ID NO: 79437, SEQ ID NO: 79448, SEQ ID NO: 79453, SEQ ID NO: 79480, SEQ ID NO: 79483, SEQ ID NO: 79486, SEQ ID NO: 79504, SEQ ID NO: 79508, SEQ ID NO: 79516, SEQ ID NO: 79548, SEQ ID NO: 79575, SEQ ID NO: 79588, SEQ ID NO: 79592, SEQ ID NO: 79609, SEQ ID NO: 79626, SEQ ID NO: 79640, SEQ ID NO: 79697, SEQ ID NO: 79746, SEQ ID NO: 79751, SEQ ID NO: 79766, SEQ ID NO: 79784, SEQ ID NO: 79787, SEQ ID NO: 79816, SEQ ID NO: 79834, SEQ ID NO: 79853, SEQ ID NO: 79858, SEQ ID NO: 79861, SEQ ID NO: 79874, SEQ ID NO: 79877, SEQ ID NO: 79906, SEQ ID NO: 79909, SEQ ID NO: 79939, SEQ ID NO: 79958, SEQ ID NO: 79987, SEQ ID NO: 80000, SEQ ID NO: 80027, SEQ ID NO: 80040, SEQ ID NO: 80139, SEQ ID NO: 80141, SEQ ID NO: 80212, SEQ ID NO: 80232, SEQ ID NO: 80237, SEQ ID NO: 80241, SEQ ID NO: 80318, SEQ ID NO: 80320, SEQ ID NOs: 80367 to 80368, SEQ ID NO: 80398, SEQ ID NO: 80421, SEQ ID NO: 80461, SEQ ID NO: 80486, SEQ ID NO: 80513, SEQ ID NO: 80527, SEQ ID NO: 80555, SEQ ID NO: 80574, SEQ ID NO: 80583, SEQ ID NO: 80627, SEQ ID NO: 80673, SEQ ID NOs: 80703 to 80704, SEQ ID NOs: 80718 to 80719, SEQ ID NO: 80725, SEQ ID NO: 80796, SEQ ID NO: 80804, SEQ ID NO: 80833, SEQ ID NO: 80869, SEQ ID NO: 80903, SEQ ID NO: 80931, SEQ ID NO: 80936, SEQ ID NO: 80946, SEQ ID NO: 80990, SEQ ID NO: 81021, SEQ ID NO: 81042, SEQ ID NO: 81046, SEQ ID NO: 81054, SEQ ID NO: 81066, SEQ ID NO: 81145, SEQ ID NO: 81166, SEQ ID NO: 81168, SEQ ID NO: 81175, SEQ ID NO: 81185, SEQ ID NO: 81207, SEQ ID NO: 81251, SEQ ID NO: 81259, SEQ ID NO: 81302, SEQ ID NO: 81337, SEQ ID NO: 81342, SEQ ID NO: 81386, SEQ ID NO: 81428, SEQ ID NO: 81446, SEQ ID NO: 81458, SEQ ID NO: 81488, SEQ ID NO: 81505, SEQ ID NO: 81517, SEQ ID NO: 81566, SEQ ID NO: 81687, SEQ ID NO: 81690, SEQ ID NO: 81694, SEQ ID NO: 81713, SEQ ID NO: 81755, SEQ ID NO: 81825, SEQ ID NO: 81856, SEQ ID NO: 81873, SEQ ID NO: 81904, SEQ ID NO: 81916, SEQ ID NO: 81938, SEQ ID NO: 81951, SEQ ID NO: 81963, SEQ ID NO: 82045, SEQ ID NO: 82085, SEQ ID NO: 82117, SEQ ID NO: 82136, SEQ ID NO: 82193, SEQ ID NO: 82239, SEQ ID NO: 82241, SEQ ID NO: 82259, SEQ ID NO: 82320, SEQ ID NO: 82382, SEQ ID NO: 82417, SEQ ID NO: 82459, SEQ ID NO: 82474, SEQ ID NO: 82514, SEQ ID NO: 82556, SEQ ID NO: 82581, SEQ ID NO: 82596, SEQ ID NO: 82633, SEQ ID NO: 82644, SEQ ID NO: 82649, SEQ ID NO: 82676, SEQ ID NO: 82681, SEQ ID NO: 82718, SEQ ID NO: 82731, SEQ ID NO: 82769, SEQ ID NO: 82817, SEQ ID NO: 82870, SEQ ID NO: 82872, SEQ ID NO: 82885, SEQ ID NOs: 82920 to 82921, SEQ ID NO: 82955, SEQ ID NO: 82960, SEQ ID NO: 82985, SEQ ID NO: 82988, SEQ ID NO: 83013, SEQ ID NO: 83018, SEQ ID NO: 83051, SEQ ID NO: 83062, SEQ ID NO: 83099, SEQ ID NO: 83149, SEQ ID NO: 83185, SEQ ID NO: 83193, SEQ ID NO: 83208, SEQ ID NO: 83225, SEQ ID NO: 83235, SEQ ID NO: 83243, SEQ ID NO: 83260, SEQ ID NO: 83269, SEQ ID NO: 83286, SEQ ID NO: 83293, SEQ ID NO: 83349, SEQ ID NO: 83383, SEQ ID NO: 83409, SEQ ID NO: 83426, SEQ ID NO: 83438, SEQ ID NO: 83549, SEQ ID NO: 83605, SEQ ID NO: 83686, SEQ ID NO: 83704, SEQ ID NO: 83714, SEQ ID NO: 83806, SEQ ID NO: 83811, SEQ ID NO: 83821, SEQ ID NOs: 83863 to 83864, SEQ ID NO: 83872, SEQ ID NO: 83891, SEQ ID NO: 83899, SEQ ID NO: 83901, SEQ ID NO: 83921, SEQ ID NO: 83970, SEQ ID NO: 83974, SEQ ID NO: 83988, SEQ ID NO: 84002, SEQ ID NO: 84025, SEQ ID NO: 84070, SEQ ID NO: 84090, SEQ ID NO: 84154, SEQ ID NO: 84182, SEQ ID NOs: 84187 to 84188, SEQ ID NO: 84201, SEQ ID NO: 84212, SEQ ID NO: 84232, SEQ ID NO: 84238, SEQ ID NO: 84248, SEQ ID NO: 84306, SEQ ID NO: 84324, SEQ ID NO: 84348, SEQ ID NO: 84376, SEQ ID NO: 84387, SEQ ID NO: 84390, SEQ ID NO: 84422, SEQ ID NO: 84428, SEQ ID NO: 84437, SEQ ID NO: 84445, SEQ ID NO: 84489, SEQ ID NO: 84501, SEQ ID NO: 84534, SEQ ID NO: 84558, SEQ ID NO: 84593, SEQ ID NO: 84676, SEQ ID NO: 84782, SEQ ID NO: 84795, SEQ ID NO: 84822, SEQ ID NO: 84885, SEQ ID NO: 84991, SEQ ID NO: 85010, SEQ ID NO: 85024, SEQ ID NO: 85054, SEQ ID NO: 85056, SEQ ID NO: 85060, SEQ ID NO: 85101, SEQ ID NO: 85117, SEQ ID NO: 85146, SEQ ID NO: 85219, SEQ ID NOs: 85242 to 85243, SEQ ID NO: 85266, SEQ ID NO: 85310, SEQ ID NO: 85349, SEQ ID NO: 85361, SEQ ID NO: 85370, SEQ ID NO: 85379, SEQ ID NO: 85399, SEQ ID NO: 85417, SEQ ID NO: 85435, SEQ ID NO: 85447, SEQ ID NO: 85463, SEQ ID NO: 85519, SEQ ID NO: 85528, SEQ ID NO: 85530, SEQ ID NO: 85602, SEQ ID NO: 85624, SEQ ID NO: 85629, SEQ ID NO: 85725, SEQ ID NO: 85737, SEQ ID NO: 85848, SEQ ID NO: 85878, SEQ ID NO: 85910, SEQ ID NO: 85959, SEQ ID NO: 85963, SEQ ID NO: 85967, SEQ ID NOs: 85985 to 85986, SEQ ID NO: 86003, SEQ ID NO: 86076, SEQ ID NO: 86159, SEQ ID NO: 86208, SEQ ID NO: 86248, SEQ ID NO: 86279, SEQ ID NO: 86343, SEQ ID NO: 86366, SEQ ID NO: 86417, SEQ ID NO: 86431, SEQ ID NO: 86433, SEQ ID NO: 86473, SEQ ID NO: 86523, SEQ ID NOs: 86526 to 86527, SEQ ID NO: 86541, SEQ ID NO: 86567, SEQ ID NO: 86586, SEQ ID NO: 86589, SEQ ID NO: 86599, SEQ ID NO: 86633, SEQ ID NO: 86665, SEQ ID NO: 86688, SEQ ID NO: 86698, SEQ ID NO: 86725, SEQ ID NO: 86761, SEQ ID NO: 86775, SEQ ID NO: 86825, SEQ ID NO: 86914, SEQ ID NO: 86929, SEQ ID NO: 86940, SEQ ID NO: 86969, SEQ ID NO: 86994, SEQ ID NO: 87027, SEQ ID NO: 87041, SEQ ID NO: 87157, SEQ ID NO: 87160, SEQ ID NO: 87185, SEQ ID NO: 87251, SEQ ID NO: 87255, SEQ ID NO: 87300, SEQ ID NO: 87321, SEQ ID NO: 87358, SEQ ID NO: 87425, SEQ ID NO: 87427, SEQ ID NO: 87431, SEQ ID NO: 87474, SEQ ID NO: 87536, SEQ ID NO: 87550, SEQ ID NO: 87576, SEQ ID NO: 87603, SEQ ID NO: 87623, SEQ ID NO: 87626, SEQ ID NO: 87638, SEQ ID NO: 87708, SEQ ID NO: 87733, SEQ ID NO: 87785, SEQ ID NO: 87799, SEQ ID NO: 87818, SEQ ID NOs: 87865 to 87866, SEQ ID NO: 87875, SEQ ID NO: 87917, SEQ ID NO: 87946, SEQ ID NO: 87951, SEQ ID NO: 88016, SEQ ID NO: 88061, SEQ ID NO: 88120, SEQ ID NO: 88122, SEQ ID NO: 88125, SEQ ID NO: 88144, SEQ ID NO: 88178, SEQ ID NO: 88180, SEQ ID NO: 88186, SEQ ID NO: 88203, SEQ ID NO: 88241, SEQ ID NO: 88272, SEQ ID NO: 88285, SEQ ID NO: 88288, SEQ ID NO: 88359, SEQ ID NO: 88384, SEQ ID NO: 88390, SEQ ID NO: 88474, SEQ ID NO: 88522, SEQ ID NO: 88563, SEQ ID NO: 88643, SEQ ID NO: 88659, SEQ ID NO: 88708, SEQ ID NO: 88710, SEQ ID NO: 88731, SEQ ID NO: 88751, SEQ ID NO: 88806, SEQ ID NO: 88975, SEQ ID NO: 88999, SEQ ID NO: 89010, SEQ ID NO: 89012, SEQ ID NO: 89028, SEQ ID NO: 89035, SEQ ID NO: 89037, SEQ ID NO: 89039, SEQ ID NO: 89045, SEQ ID NO: 89073, SEQ ID NO: 89118, SEQ ID NO: 89126, SEQ ID NO: 89135, SEQ ID NO: 89138, SEQ ID NO: 89147, SEQ ID NO: 89168, SEQ ID NO: 89193, SEQ ID NO: 89228, SEQ ID NO: 89235, SEQ ID NO: 89269, SEQ ID NO: 89286, SEQ ID NO: 89291, SEQ ID NO: 89339, SEQ ID NO: 89342, SEQ ID NO: 89394, SEQ ID NO: 89453, SEQ ID NO: 89492, SEQ ID NO: 89510, SEQ ID NO: 89555, SEQ ID NO: 89595, SEQ ID NO: 89670, SEQ ID NO: 89695, SEQ ID NO: 89785, SEQ ID NO: 89836, SEQ ID NO: 89842, SEQ ID NO: 89921, SEQ ID NO: 89929, SEQ ID NO: 89935, SEQ ID NO: 89938, SEQ ID NO: 89950, SEQ ID NO: 89953, SEQ ID NO: 89960, SEQ ID NO: 89987, SEQ ID NO: 89992, SEQ ID NO: 90030, SEQ ID NO: 90056, SEQ ID NO: 90066, SEQ ID NO: 90085, SEQ ID NO: 90089, SEQ ID NO: 90115, SEQ ID NO: 90120, SEQ ID NO: 90133, SEQ ID NO: 90157, SEQ ID NO: 90159, SEQ ID NO: 90191, SEQ ID NO: 90268, SEQ ID NO: 90274, SEQ ID NO: 90280, SEQ ID NO: 90287, SEQ ID NO: 90315, SEQ ID NO: 90408, SEQ ID NO: 90417, SEQ ID NO: 90443, SEQ ID NO: 90466, SEQ ID NO: 90507, SEQ ID NO: 90555, SEQ ID NO: 90593, SEQ ID NO: 90599, SEQ ID NO: 90621, SEQ ID NO: 90634, SEQ ID NO: 90653, SEQ ID NO: 90696, SEQ ID NO: 90758, SEQ ID NO: 90777, SEQ ID NO: 90835, SEQ ID NO: 90882, SEQ ID NO: 90898, SEQ ID NO: 90938, SEQ ID NO: 90954, SEQ ID NO: 90999, SEQ ID NO: 91045, SEQ ID NO: 91060, SEQ ID NO: 91072, SEQ ID NO: 91076, SEQ ID NO: 91105, SEQ ID NO: 91132, SEQ ID NO: 91222, SEQ ID NO: 91226, SEQ ID NO: 91229, SEQ ID NO: 91306, SEQ ID NO: 91309, SEQ ID NO: 91315, SEQ ID NO: 91346, SEQ ID NO: 91419, SEQ ID NO: 91449, SEQ ID NO: 91498, SEQ ID NO: 91563, SEQ ID NO: 91588, SEQ ID NO: 91681, SEQ ID NO: 91766, SEQ ID NOs: 91775 to 91776, SEQ ID NO: 91780, SEQ ID NO: 91799, SEQ ID NO: 91845, SEQ ID NO: 91852, SEQ ID NOs: 91885 to 91886, SEQ ID NO: 91930, SEQ ID NO: 91935, SEQ ID NO: 91953, SEQ ID NO: 91966, SEQ ID NO: 91984, SEQ ID NO: 92026, SEQ ID NO: 92030, SEQ ID NO: 92069, SEQ ID NO: 92100, SEQ ID NO: 92111, SEQ ID NO: 92189, SEQ ID NO: 92249, SEQ ID NO: 92296, SEQ ID NO: 92400, SEQ ID NO: 92404, SEQ ID NO: 92409, SEQ ID NO: 92429, SEQ ID NO: 92474, SEQ ID NO: 92500, SEQ ID NO: 92515, SEQ ID NO: 92538, SEQ ID NO: 92646, SEQ ID NO: 92659, SEQ ID NO: 92671, SEQ ID NO: 92673, SEQ ID NO: 92675, SEQ ID NO: 92684, SEQ ID NO: 92704, SEQ ID NO: 92832, SEQ ID NO: 92835, SEQ ID NO: 92854, SEQ ID NO: 92858, SEQ ID NO: 92877, SEQ ID NO: 92918, SEQ ID NO: 92920, SEQ ID NO: 93004, SEQ ID NO: 93036, SEQ ID NO: 93042, SEQ ID NO: 93071, SEQ ID NO: 93089, SEQ ID NO: 93136, SEQ ID NO: 93180, SEQ ID NO: 93251, SEQ ID NO: 93325, SEQ ID NO: 93335, SEQ ID NO: 93344, SEQ ID NO: 93356, SEQ ID NO: 93382, SEQ ID NO: 93408, SEQ ID NO: 93420, SEQ ID NO: 93503, SEQ ID NO: 93537, SEQ ID NO: 93617, SEQ ID NO: 93658, SEQ ID NO: 93697, SEQ ID NO: 93710, SEQ ID NO: 93877, SEQ ID NO: 93885, SEQ ID NO: 93888, SEQ ID NO: 93893, SEQ ID NO: 93903, SEQ ID NO: 93912, SEQ ID NO: 93926, SEQ ID NO: 93933, SEQ ID NO: 93982, SEQ ID NO: 93987, SEQ ID NO: 94000, SEQ ID NO: 94054, SEQ ID NO: 94058, SEQ ID NO: 94087, SEQ ID NO: 94090, SEQ ID NO: 94102, SEQ ID NO: 94143, SEQ ID NO: 94269, SEQ ID NO: 94367, SEQ ID NO: 94465, SEQ ID NO: 94477, SEQ ID NO: 94525, SEQ ID NO: 94587, or SEQ ID NOs: 95593 to 113807.

In some embodiments, the amino acid sequence for a MHC class I peptide vaccine for the MAGC3 protein comprises two or more of the SEQ ID NO: 68285, SEQ ID NO: 68290, SEQ ID NO: 68305, SEQ ID NO: 77091, SEQ ID NO: 77210, SEQ ID NO: 84188, SEQ ID NO: 87951, SEQ ID NO: 88144, and SEQ ID NOs: 95593 to 95664. In some embodiments, any one of the peptides in the MAGC3 vaccine comprise an amino acid sequence 80, 81, 82, 83, 84, 85, 86, 87, 88, 89, 90, 91, 92, 93, 94, 95, 96, 97, 98 or 99% identical to SEQ ID NO: 68285, SEQ ID NO: 68290, SEQ ID NO: 68305, SEQ ID NO: 77091, SEQ ID NO: 77210, SEQ ID NO: 84188, SEQ ID NO: 87951, SEQ ID NO: 88144, or SEQ ID NOs: 95593 to 95664.

In some embodiments, the amino acid sequence for a MHC class I peptide vaccine for the MAGC3 protein comprises two or more of the SEQ ID NO: 41647, SEQ ID NO: 50668, SEQ ID NO: 50905, SEQ ID NOs: 51039 to 51040, SEQ ID NO: 68257, SEQ ID NO: 68285, SEQ ID NO: 68288, SEQ ID NO: 68290, SEQ ID NO: 68305, SEQ ID NO: 68389, SEQ ID NO: 68419, SEQ ID NO: 68470, SEQ ID NO: 68510, SEQ ID NO: 68519, SEQ ID NO: 68592, SEQ ID NO: 68603, SEQ ID NO: 68684, SEQ ID NO: 68688, SEQ ID NO: 68747, SEQ ID NO: 68760, SEQ ID NO: 68778, SEQ ID NO: 68786, SEQ ID NO: 68855, SEQ ID NO: 68898, SEQ ID NO: 68900, SEQ ID NO: 68927, SEQ ID NO: 68961, SEQ ID NO: 69026, SEQ ID NO: 69041, SEQ ID NO: 69047, SEQ ID NO: 69148, SEQ ID NO: 69173, SEQ ID NO: 69180, SEQ ID NO: 69192, SEQ ID NO: 69227, SEQ ID NO: 69311, SEQ ID NO: 69330, SEQ ID NO: 69333, SEQ ID NO: 69346, SEQ ID NO: 69356, SEQ ID NO: 69393, SEQ ID NO: 69421, SEQ ID NO: 69437, SEQ ID NO: 69451, SEQ ID NO: 69500, SEQ ID NO: 69505, SEQ ID NO: 69517, SEQ ID NO: 69540, SEQ ID NO: 69559, SEQ ID NO: 69571, SEQ ID NO: 69586, SEQ ID NO: 69589, SEQ ID NO: 69591, SEQ ID NO: 69619, SEQ ID NO: 69631, SEQ ID NO: 69633, SEQ ID NO: 69644, SEQ ID NO: 69649, SEQ ID NO: 69747, SEQ ID NO: 69764, SEQ ID NO: 69767, SEQ ID NO: 69790, SEQ ID NO: 69832, SEQ ID NO: 69836, SEQ ID NO: 69882, SEQ ID NO: 69999, SEQ ID NO: 70012, SEQ ID NO: 70036, SEQ ID NO: 70050, SEQ ID NO: 70066, SEQ ID NO: 70069, SEQ ID NO: 70109, SEQ ID NO: 70159, SEQ ID NO: 70165, SEQ ID NO: 70175, SEQ ID NO: 70177, SEQ ID NO: 70188, SEQ ID NO: 70284, SEQ ID NO: 70323, SEQ ID NO: 70326, SEQ ID NO: 70428, SEQ ID NO: 70455, SEQ ID NO: 70570, SEQ ID NO: 70606, SEQ ID NO: 70635, SEQ ID NO: 70676, SEQ ID NO: 70692, SEQ ID NO: 70716, SEQ ID NO: 70728, SEQ ID NO: 70735, SEQ ID NO: 70750, SEQ ID NO: 70764, SEQ ID NO: 70770, SEQ ID NO: 70806, SEQ ID NO: 70968, SEQ ID NO: 70997, SEQ ID NO: 71049, SEQ ID NO: 71075, SEQ ID NO: 71090, SEQ ID NO: 71117, SEQ ID NO: 71151, SEQ ID NO: 71176, SEQ ID NO: 71193, SEQ ID NO: 71203, SEQ ID NO: 71239, SEQ ID NO: 71247, SEQ ID NO: 71249, SEQ ID NO: 71275, SEQ ID NO: 71287, SEQ ID NO: 71328, SEQ ID NOs: 71359 to 71360, SEQ ID NOs: 71367 to 71368, SEQ ID NO: 71392, SEQ ID NO: 71414, SEQ ID NO: 71449, SEQ ID NO: 71476, SEQ ID NO: 71482, SEQ ID NO: 71543, SEQ ID NO: 71547, SEQ ID NO: 71560, SEQ ID NO: 71585, SEQ ID NO: 71612, SEQ ID NO: 71620, SEQ ID NO: 71628, SEQ ID NO: 71636, SEQ ID NO: 71673, SEQ ID NOs: 71688 to 71689, SEQ ID NO: 71696, SEQ ID NO: 71700, SEQ ID NO: 71718, SEQ ID NO: 71725, SEQ ID NO: 71807, SEQ ID NO: 71919, SEQ ID NO: 71935, SEQ ID NO: 71943, SEQ ID NO: 71948, SEQ ID NOs: 71987 to 71988, SEQ ID NO: 72045, SEQ ID NO: 72055, SEQ ID NO: 72076, SEQ ID NO: 72085, SEQ ID NO: 72102, SEQ ID NO: 72159, SEQ ID NO: 72183, SEQ ID NO: 72216, SEQ ID NO: 72241, SEQ ID NO: 72331, SEQ ID NO: 72364, SEQ ID NO: 72372, SEQ ID NO: 72390, SEQ ID NO: 72448, SEQ ID NO: 72528, SEQ ID NO: 72595, SEQ ID NO: 72604, SEQ ID NO: 72648, SEQ ID NO: 72667, SEQ ID NO: 72685, SEQ ID NO: 72721, SEQ ID NO: 72751, SEQ ID NO: 72755, SEQ ID NO: 72805, SEQ ID NO: 72810, SEQ ID NO: 72831, SEQ ID NO: 72837, SEQ ID NO: 72862, SEQ ID NO: 72885, SEQ ID NO: 72989, SEQ ID NO: 73014, SEQ ID NOs: 73045 to 73046, SEQ ID NO: 73086, SEQ ID NO: 73094, SEQ ID NO: 73113, SEQ ID NO: 73122, SEQ ID NO: 73161, SEQ ID NO: 73191, SEQ ID NO: 73224, SEQ ID NOs: 73232 to 73233, SEQ ID NO: 73238, SEQ ID NO: 73290, SEQ ID NO: 73327, SEQ ID NO: 73377, SEQ ID NO: 73382, SEQ ID NO: 73404, SEQ ID NO: 73406, SEQ ID NO: 73422, SEQ ID NOs: 73428 to 73429, SEQ ID NO: 73466, SEQ ID NO: 73475, SEQ ID NO: 73521, SEQ ID NO: 73523, SEQ ID NO: 73532, SEQ ID NO: 73550, SEQ ID NO: 73560, SEQ ID NO: 73591, SEQ ID NO: 73597, SEQ ID NO: 73644, SEQ ID NO: 73657, SEQ ID NO: 73660, SEQ ID NO: 73689, SEQ ID NO: 73729, SEQ ID NO: 73733, SEQ ID NO: 73873, SEQ ID NO: 73886, SEQ ID NO: 73930, SEQ ID NO: 73957, SEQ ID NOs: 73991 to 73992, SEQ ID NO: 74045, SEQ ID NO: 74047, SEQ ID NO: 74072, SEQ ID NO: 74080, SEQ ID NOs: 74096 to 74097, SEQ ID NO: 74107, SEQ ID NO: 74203, SEQ ID NO: 74208, SEQ ID NO: 74210, SEQ ID NO: 74238, SEQ ID NO: 74302, SEQ ID NO: 74350, SEQ ID NO: 74352, SEQ ID NO: 74411, SEQ ID NO: 74448, SEQ ID NO: 74473, SEQ ID NO: 74482, SEQ ID NO: 74515, SEQ ID NO: 74527, SEQ ID NO: 74560, SEQ ID NO: 74616, SEQ ID NO: 74649, SEQ ID NO: 74672, SEQ ID NO: 74674, SEQ ID NO: 74737, SEQ ID NO: 74782, SEQ ID NO: 74808, SEQ ID NO: 74810, SEQ ID NO: 74835, SEQ ID NO: 74886, SEQ ID NO: 74901, SEQ ID NO: 74946, SEQ ID NOs: 74975 to 74976, SEQ ID NO: 75017, SEQ ID NO: 75021, SEQ ID NO: 75040, SEQ ID NO: 75049, SEQ ID NO: 75063, SEQ ID NO: 75066, SEQ ID NO: 75072, SEQ ID NO: 75092, SEQ ID NO: 75094, SEQ ID NO: 75099, SEQ ID NO: 75111, SEQ ID NO: 75148, SEQ ID NO: 75245, SEQ ID NO: 75269, SEQ ID NO: 75388, SEQ ID NO: 75403, SEQ ID NO: 75429, SEQ ID NO: 75455, SEQ ID NO: 75470, SEQ ID NO: 75489, SEQ ID NO: 75506, SEQ ID NO: 75529, SEQ ID NO: 75547, SEQ ID NO: 75551, SEQ ID NOs: 75576 to 75577, SEQ ID NO: 75595, SEQ ID NO: 75701, SEQ ID NO: 75716, SEQ ID NO: 75747, SEQ ID NO: 75757, SEQ ID NO: 75762, SEQ ID NO: 75766, SEQ ID NO: 75874, SEQ ID NO: 75915, SEQ ID NO: 75933, SEQ ID NO: 75975, SEQ ID NO: 75979, SEQ ID NO: 76016, SEQ ID NO: 76023, SEQ ID NO: 76034, SEQ ID NO: 76040, SEQ ID NO: 76064, SEQ ID NO: 76076, SEQ ID NO: 76102, SEQ ID NOs: 76147 to 76148, SEQ ID NO: 76189, SEQ ID NO: 76199, SEQ ID NO: 76369, SEQ ID NO: 76375, SEQ ID NO: 76397, SEQ ID NO: 76410, SEQ ID NO: 76435, SEQ ID NO: 76446, SEQ ID NO: 76451, SEQ ID NOs: 76456 to 76458, SEQ ID NO: 76492, SEQ ID NO: 76544, SEQ ID NO: 76569, SEQ ID NO: 76574, SEQ ID NO: 76611, SEQ ID NO: 76654, SEQ ID NO: 76710, SEQ ID NO: 76753, SEQ ID NO: 76769, SEQ ID NO: 76781, SEQ ID NO: 76797, SEQ ID NO: 76803, SEQ ID NO: 76858, SEQ ID NO: 76860, SEQ ID NO: 76879, SEQ ID NO: 76943, SEQ ID NO: 76971, SEQ ID NO: 76981, SEQ ID NO: 77091, SEQ ID NO: 77133, SEQ ID NOs: 77193 to 77194, SEQ ID NO: 77210, SEQ ID NO: 77219, SEQ ID NO: 77237, SEQ ID NO: 77246, SEQ ID NO: 77251, SEQ ID NO: 77281, SEQ ID NO: 77293, SEQ ID NO: 77323, SEQ ID NO: 77334, SEQ ID NO: 77339, SEQ ID NO: 77396, SEQ ID NO: 77423, SEQ ID NO: 77433, SEQ ID NO: 77437, SEQ ID NO: 77442, SEQ ID NO: 77453, SEQ ID NO: 77485, SEQ ID NO: 77579, SEQ ID NO: 77627, SEQ ID NO: 77639, SEQ ID NO: 77644, SEQ ID NO: 77703, SEQ ID NO: 77773, SEQ ID NO: 77814, SEQ ID NO: 77868, SEQ ID NO: 77874, SEQ ID NO: 77900, SEQ ID NO: 77925, SEQ ID NO: 77995, SEQ ID NO: 78017, SEQ ID NO: 78083, SEQ ID NO: 78086, SEQ ID NO: 78090, SEQ ID NO: 78131, SEQ ID NO: 78139, SEQ ID NO: 78228, SEQ ID NO: 78248, SEQ ID NO: 78260, SEQ ID NO: 78346, SEQ ID NO: 78352, SEQ ID NO: 78377, SEQ ID NO: 78416, SEQ ID NO: 78421, SEQ ID NO: 78440, SEQ ID NO: 78521, SEQ ID NO: 78530, SEQ ID NO: 78532, SEQ ID NO: 78546, SEQ ID NO: 78600, SEQ ID NO: 78631, SEQ ID NO: 78671, SEQ ID NO: 78709, SEQ ID NO: 78714, SEQ ID NO: 78730, SEQ ID NO: 78738, SEQ ID NO: 78810, SEQ ID NO: 78855, SEQ ID NO: 78883, SEQ ID NO: 78917, SEQ ID NOs: 78919 to 78920, SEQ ID NO: 78928, SEQ ID NO: 79035, SEQ ID NO: 79048, SEQ ID NO: 79056, SEQ ID NO: 79086, SEQ ID NO: 79091, SEQ ID NO: 79095, SEQ ID NO: 79107, SEQ ID NO: 79109, SEQ ID NO: 79136, SEQ ID NO: 79142, SEQ ID NO: 79147, SEQ ID NO: 79151, SEQ ID NO: 79194, SEQ ID NO: 79196, SEQ ID NO: 79227, SEQ ID NO: 79247, SEQ ID NO: 79253, SEQ ID NO: 79255, SEQ ID NO: 79269, SEQ ID NO: 79310, SEQ ID NO: 79331, SEQ ID NO: 79357, SEQ ID NO: 79406, SEQ ID NO: 79437, SEQ ID NO: 79448, SEQ ID NO: 79453, SEQ ID NO: 79480, SEQ ID NO: 79483, SEQ ID NO: 79486, SEQ ID NO: 79504, SEQ ID NO: 79508, SEQ ID NO: 79516, SEQ ID NO: 79548, SEQ ID NO: 79575, SEQ ID NO: 79588, SEQ ID NO: 79592, SEQ ID NO: 79609, SEQ ID NO: 79626, SEQ ID NO: 79640, SEQ ID NO: 79697, SEQ ID NO: 79746, SEQ ID NO: 79751, SEQ ID NO: 79766, SEQ ID NO: 79784, SEQ ID NO: 79787, SEQ ID NO: 79816, SEQ ID NO: 79834, SEQ ID NO: 79853, SEQ ID NO: 79858, SEQ ID NO: 79861, SEQ ID NO: 79874, SEQ ID NO: 79877, SEQ ID NO: 79906, SEQ ID NO: 79909, SEQ ID NO: 79939, SEQ ID NO: 79958, SEQ ID NO: 79987, SEQ ID NO: 80000, SEQ ID NO: 80027, SEQ ID NO: 80040, SEQ ID NO: 80139, SEQ ID NO: 80141, SEQ ID NO: 80212, SEQ ID NO: 80232, SEQ ID NO: 80237, SEQ ID NO: 80241, SEQ ID NO: 80318, SEQ ID NO: 80320, SEQ ID NOs: 80367 to 80368, SEQ ID NO: 80398, SEQ ID NO: 80421, SEQ ID NO: 80461, SEQ ID NO: 80486, SEQ ID NO: 80513, SEQ ID NO: 80527, SEQ ID NO: 80555, SEQ ID NO: 80574, SEQ ID NO: 80583, SEQ ID NO: 80627, SEQ ID NO: 80673, SEQ ID NOs: 80703 to 80704, SEQ ID NOs: 80718 to 80719, SEQ ID NO: 80725, SEQ ID NO: 80796, SEQ ID NO: 80804, SEQ ID NO: 80833, SEQ ID NO: 80869, SEQ ID NO: 80903, SEQ ID NO: 80931, SEQ ID NO: 80936, SEQ ID NO: 80946, SEQ ID NO: 80990, SEQ ID NO: 81021, SEQ ID NO: 81042, SEQ ID NO: 81046, SEQ ID NO: 81054, SEQ ID NO: 81066, SEQ ID NO: 81145, SEQ ID NO: 81166, SEQ ID NO: 81168, SEQ ID NO: 81175, SEQ ID NO: 81185, SEQ ID NO: 81207, SEQ ID NO: 81251, SEQ ID NO: 81259, SEQ ID NO: 81302, SEQ ID NO: 81337, SEQ ID NO: 81342, SEQ ID NO: 81386, SEQ ID NO: 81428, SEQ ID NO: 81446, SEQ ID NO: 81458, SEQ ID NO: 81488, SEQ ID NO: 81505, SEQ ID NO: 81517, SEQ ID NO: 81566, SEQ ID NO: 81687, SEQ ID NO: 81690, SEQ ID NO: 81694, SEQ ID NO: 81713, SEQ ID NO: 81755, SEQ ID NO: 81825, SEQ ID NO: 81856, SEQ ID NO: 81873, SEQ ID NO: 81904, SEQ ID NO: 81916, SEQ ID NO: 81938, SEQ ID NO: 81951, SEQ ID NO: 81963, SEQ ID NO: 82045, SEQ ID NO: 82085, SEQ ID NO: 82117, SEQ ID NO: 82136, SEQ ID NO: 82193, SEQ ID NO: 82239, SEQ ID NO: 82241, SEQ ID NO: 82259, SEQ ID NO: 82320, SEQ ID NO: 82382, SEQ ID NO: 82417, SEQ ID NO: 82459, SEQ ID NO: 82474, SEQ ID NO: 82514, SEQ ID NO: 82556, SEQ ID NO: 82581, SEQ ID NO: 82596, SEQ ID NO: 82633, SEQ ID NO: 82644, SEQ ID NO: 82649, SEQ ID NO: 82676, SEQ ID NO: 82681, SEQ ID NO: 82718, SEQ ID NO: 82731, SEQ ID NO: 82769, SEQ ID NO: 82817, SEQ ID NO: 82870, SEQ ID NO: 82872, SEQ ID NO: 82885, SEQ ID NOs: 82920 to 82921, SEQ ID NO: 82955, SEQ ID NO: 82960, SEQ ID NO: 82985, SEQ ID NO: 82988, SEQ ID NO: 83013, SEQ ID NO: 83018, SEQ ID NO: 83051, SEQ ID NO: 83062, SEQ ID NO: 83099, SEQ ID NO: 83149, SEQ ID NO: 83185, SEQ ID NO: 83193, SEQ ID NO: 83208, SEQ ID NO: 83225, SEQ ID NO: 83235, SEQ ID NO: 83243, SEQ ID NO: 83260, SEQ ID NO: 83269, SEQ ID NO: 83286, SEQ ID NO: 83293, SEQ ID NO: 83349, SEQ ID NO: 83383, SEQ ID NO: 83409, SEQ ID NO: 83426, SEQ ID NO: 83438, SEQ ID NO: 83549, SEQ ID NO: 83605, SEQ ID NO: 83686, SEQ ID NO: 83704, SEQ ID NO: 83714, SEQ ID NO: 83806, SEQ ID NO: 83811, SEQ ID NO: 83821, SEQ ID NOs: 83863 to 83864, SEQ ID NO: 83872, SEQ ID NO: 83891, SEQ ID NO: 83899, SEQ ID NO: 83901, SEQ ID NO: 83921, SEQ ID NO: 83970, SEQ ID NO: 83974, SEQ ID NO: 83988, SEQ ID NO: 84002, SEQ ID NO: 84025, SEQ ID NO: 84070, SEQ ID NO: 84090, SEQ ID NO: 84154, SEQ ID NO: 84182, SEQ ID NOs: 84187 to 84188, SEQ ID NO: 84201, SEQ ID NO: 84212, SEQ ID NO: 84232, SEQ ID NO: 84238, SEQ ID NO: 84248, SEQ ID NO: 84306, SEQ ID NO: 84324, SEQ ID NO: 84348, SEQ ID NO: 84376, SEQ ID NO: 84387, SEQ ID NO: 84390, SEQ ID NO: 84422, SEQ ID NO: 84428, SEQ ID NO: 84437, SEQ ID NO: 84445, SEQ ID NO: 84489, SEQ ID NO: 84501, SEQ ID NO: 84534, SEQ ID NO: 84558, SEQ ID NO: 84593, SEQ ID NO: 84676, SEQ ID NO: 84782, SEQ ID NO: 84795, SEQ ID NO: 84822, SEQ ID NO: 84885, SEQ ID NO: 84991, SEQ ID NO: 85010, SEQ ID NO: 85024, SEQ ID NO: 85054, SEQ ID NO: 85056, SEQ ID NO: 85060, SEQ ID NO: 85101, SEQ ID NO: 85117, SEQ ID NO: 85146, SEQ ID NO: 85219, SEQ ID NOs: 85242 to 85243, SEQ ID NO: 85266, SEQ ID NO: 85310, SEQ ID NO: 85349, SEQ ID NO: 85361, SEQ ID NO: 85370, SEQ ID NO: 85379, SEQ ID NO: 85399, SEQ ID NO: 85417, SEQ ID NO: 85435, SEQ ID NO: 85447, SEQ ID NO: 85463, SEQ ID NO: 85519, SEQ ID NO: 85528, SEQ ID NO: 85530, SEQ ID NO: 85602, SEQ ID NO: 85624, SEQ ID NO: 85629, SEQ ID NO: 85725, SEQ ID NO: 85737, SEQ ID NO: 85848, SEQ ID NO: 85878, SEQ ID NO: 85910, SEQ ID NO: 85959, SEQ ID NO: 85963, SEQ ID NO: 85967, SEQ ID NOs: 85985 to 85986, SEQ ID NO: 86003, SEQ ID NO: 86076, SEQ ID NO: 86159, SEQ ID NO: 86208, SEQ ID NO: 86248, SEQ ID NO: 86279, SEQ ID NO: 86343, SEQ ID NO: 86366, SEQ ID NO: 86417, SEQ ID NO: 86431, SEQ ID NO: 86433, SEQ ID NO: 86473, SEQ ID NO: 86523, SEQ ID NOs: 86526 to 86527, SEQ ID NO: 86541, SEQ ID NO: 86567, SEQ ID NO: 86586, SEQ ID NO: 86589, SEQ ID NO: 86599, SEQ ID NO: 86633, SEQ ID NO: 86665, SEQ ID NO: 86688, SEQ ID NO: 86698, SEQ ID NO: 86725, SEQ ID NO: 86761, SEQ ID NO: 86775, SEQ ID NO: 86825, SEQ ID NO: 86914, SEQ ID NO: 86929, SEQ ID NO: 86940, SEQ ID NO: 86969, SEQ ID NO: 86994, SEQ ID NO: 87027, SEQ ID NO: 87041, SEQ ID NO: 87157, SEQ ID NO: 87160, SEQ ID NO: 87185, SEQ ID NO: 87251, SEQ ID NO: 87255, SEQ ID NO: 87300, SEQ ID NO: 87321, SEQ ID NO: 87358, SEQ ID NO: 87425, SEQ ID NO: 87427, SEQ ID NO: 87431, SEQ ID NO: 87474, SEQ ID NO: 87536, SEQ ID NO: 87550, SEQ ID NO: 87576, SEQ ID NO: 87603, SEQ ID NO: 87623, SEQ ID NO: 87626, SEQ ID NO: 87638, SEQ ID NO: 87708, SEQ ID NO: 87733, SEQ ID NO: 87785, SEQ ID NO: 87799, SEQ ID NO: 87818, SEQ ID NOs: 87865 to 87866, SEQ ID NO: 87875, SEQ ID NO: 87917, SEQ ID NO: 87946, SEQ ID NO: 87951, SEQ ID NO: 88016, SEQ ID NO: 88061, SEQ ID NO: 88120, SEQ ID NO: 88122, SEQ ID NO: 88125, SEQ ID NO: 88144, SEQ ID NO: 88178, SEQ ID NO: 88180, SEQ ID NO: 88186, SEQ ID NO: 88203, SEQ ID NO: 88241, SEQ ID NO: 88272, SEQ ID NO: 88285, SEQ ID NO: 88288, SEQ ID NO: 88359, SEQ ID NO: 88384, SEQ ID NO: 88390, SEQ ID NO: 88474, SEQ ID NO: 88522, SEQ ID NO: 88563, SEQ ID NO: 88643, SEQ ID NO: 88659, SEQ ID NO: 88708, SEQ ID NO: 88710, SEQ ID NO: 88731, SEQ ID NO: 88751, SEQ ID NO: 88806, SEQ ID NO: 88975, SEQ ID NO: 88999, SEQ ID NO: 89010, SEQ ID NO: 89012, SEQ ID NO: 89028, SEQ ID NO: 89035, SEQ ID NO: 89037, SEQ ID NO: 89039, SEQ ID NO: 89045, SEQ ID NO: 89073, SEQ ID NO: 89118, SEQ ID NO: 89126, SEQ ID NO: 89135, SEQ ID NO: 89138, SEQ ID NO: 89147, SEQ ID NO: 89168, SEQ ID NO: 89193, SEQ ID NO: 89228, SEQ ID NO: 89235, SEQ ID NO: 89269, SEQ ID NO: 89286, SEQ ID NO: 89291, SEQ ID NO: 89339, SEQ ID NO: 89342, SEQ ID NO: 89394, SEQ ID NO: 89453, SEQ ID NO: 89492, SEQ ID NO: 89510, SEQ ID NO: 89555, SEQ ID NO: 89595, SEQ ID NO: 89670, SEQ ID NO: 89695, SEQ ID NO: 89785, SEQ ID NO: 89836, SEQ ID NO: 89842, SEQ ID NO: 89921, SEQ ID NO: 89929, SEQ ID NO: 89935, SEQ ID NO: 89938, SEQ ID NO: 89950, SEQ ID NO: 89953, SEQ ID NO: 89960, SEQ ID NO: 89987, SEQ ID NO: 89992, SEQ ID NO: 90030, SEQ ID NO: 90056, SEQ ID NO: 90066, SEQ ID NO: 90085, SEQ ID NO: 90089, SEQ ID NO: 90115, SEQ ID NO: 90120, SEQ ID NO: 90133, SEQ ID NO: 90157, SEQ ID NO: 90159, SEQ ID NO: 90191, SEQ ID NO: 90268, SEQ ID NO: 90274, SEQ ID NO: 90280, SEQ ID NO: 90287, SEQ ID NO: 90315, SEQ ID NO: 90408, SEQ ID NO: 90417, SEQ ID NO: 90443, SEQ ID NO: 90466, SEQ ID NO: 90507, SEQ ID NO: 90555, SEQ ID NO: 90593, SEQ ID NO: 90599, SEQ ID NO: 90621, SEQ ID NO: 90634, SEQ ID NO: 90653, SEQ ID NO: 90696, SEQ ID NO: 90758, SEQ ID NO: 90777, SEQ ID NO: 90835, SEQ ID NO: 90882, SEQ ID NO: 90898, SEQ ID NO: 90938, SEQ ID NO: 90954, SEQ ID NO: 90999, SEQ ID NO: 91045, SEQ ID NO: 91060, SEQ ID NO: 91072, SEQ ID NO: 91076, SEQ ID NO: 91105, SEQ ID NO: 91132, SEQ ID NO: 91222, SEQ ID NO: 91226, SEQ ID NO: 91229, SEQ ID NO: 91306, SEQ ID NO: 91309, SEQ ID NO: 91315, SEQ ID NO: 91346, SEQ ID NO: 91419, SEQ ID NO: 91449, SEQ ID NO: 91498, SEQ ID NO: 91563, SEQ ID NO: 91588, SEQ ID NO: 91681, SEQ ID NO: 91766, SEQ ID NOs: 91775 to 91776, SEQ ID NO: 91780, SEQ ID NO: 91799, SEQ ID NO: 91845, SEQ ID NO: 91852, SEQ ID NOs: 91885 to 91886, SEQ ID NO: 91930, SEQ ID NO: 91935, SEQ ID NO: 91953, SEQ ID NO: 91966, SEQ ID NO: 91984, SEQ ID NO: 92026, SEQ ID NO: 92030, SEQ ID NO: 92069, SEQ ID NO: 92100, SEQ ID NO: 92111, SEQ ID NO: 92189, SEQ ID NO: 92249, SEQ ID NO: 92296, SEQ ID NO: 92400, SEQ ID NO: 92404, SEQ ID NO: 92409, SEQ ID NO: 92429, SEQ ID NO: 92474, SEQ ID NO: 92500, SEQ ID NO: 92515, SEQ ID NO: 92538, SEQ ID NO: 92646, SEQ ID NO: 92659, SEQ ID NO: 92671, SEQ ID NO: 92673, SEQ ID NO: 92675, SEQ ID NO: 92684, SEQ ID NO: 92704, SEQ ID NO: 92832, SEQ ID NO: 92835, SEQ ID NO: 92854, SEQ ID NO: 92858, SEQ ID NO: 92877, SEQ ID NO: 92918, SEQ ID NO: 92920, SEQ ID NO: 93004, SEQ ID NO: 93036, SEQ ID NO: 93042, SEQ ID NO: 93071, SEQ ID NO: 93089, SEQ ID NO: 93136, SEQ ID NO: 93180, SEQ ID NO: 93251, SEQ ID NO: 93325, SEQ ID NO: 93335, SEQ ID NO: 93344, SEQ ID NO: 93356, SEQ ID NO: 93382, SEQ ID NO: 93408, SEQ ID NO: 93420, SEQ ID NO: 93503, SEQ ID NO: 93537, SEQ ID NO: 93617, SEQ ID NO: 93658, SEQ ID NO: 93697, SEQ ID NO: 93710, SEQ ID NO: 93877, SEQ ID NO: 93885, SEQ ID NO: 93888, SEQ ID NO: 93893, SEQ ID NO: 93903, SEQ ID NO: 93912, SEQ ID NO: 93926, SEQ ID NO: 93933, SEQ ID NO: 93982, SEQ ID NO: 93987, SEQ ID NO: 94000, SEQ ID NO: 94054, SEQ ID NO: 94058, SEQ ID NO: 94087, SEQ ID NO: 94090, SEQ ID NO: 94102, SEQ ID NO: 94143, SEQ ID NO: 94269, SEQ ID NO: 94367, SEQ ID NO: 94465, SEQ ID NO: 94477, SEQ ID NO: 94525, SEQ ID NO: 94587, and SEQ ID NOs: 95593 to 113807. In some embodiments, any one of the peptides in the MAGC3 vaccine comprise an amino acid sequence 80, 81, 82, 83, 84, 85, 86, 87, 88, 89, 90, 91, 92, 93, 94, 95, 96, 97, 98 or 99% identical to SEQ ID NO: 41647, SEQ ID NO: 50668, SEQ ID NO: 50905, SEQ ID NOs: 51039 to 51040, SEQ ID NO: 68257, SEQ ID NO: 68285, SEQ ID NO: 68288, SEQ ID NO: 68290, SEQ ID NO: 68305, SEQ ID NO: 68389, SEQ ID NO: 68419, SEQ ID NO: 68470, SEQ ID NO: 68510, SEQ ID NO: 68519, SEQ ID NO: 68592, SEQ ID NO: 68603, SEQ ID NO: 68684, SEQ ID NO: 68688, SEQ ID NO: 68747, SEQ ID NO: 68760, SEQ ID NO: 68778, SEQ ID NO: 68786, SEQ ID NO: 68855, SEQ ID NO: 68898, SEQ ID NO: 68900, SEQ ID NO: 68927, SEQ ID NO: 68961, SEQ ID NO: 69026, SEQ ID NO: 69041, SEQ ID NO: 69047, SEQ ID NO: 69148, SEQ ID NO: 69173, SEQ ID NO: 69180, SEQ ID NO: 69192, SEQ ID NO: 69227, SEQ ID NO: 69311, SEQ ID NO: 69330, SEQ ID NO: 69333, SEQ ID NO: 69346, SEQ ID NO: 69356, SEQ ID NO: 69393, SEQ ID NO: 69421, SEQ ID NO: 69437, SEQ ID NO: 69451, SEQ ID NO: 69500, SEQ ID NO: 69505, SEQ ID NO: 69517, SEQ ID NO: 69540, SEQ ID NO: 69559, SEQ ID NO: 69571, SEQ ID NO: 69586, SEQ ID NO: 69589, SEQ ID NO: 69591, SEQ ID NO: 69619, SEQ ID NO: 69631, SEQ ID NO: 69633, SEQ ID NO: 69644, SEQ ID NO: 69649, SEQ ID NO: 69747, SEQ ID NO: 69764, SEQ ID NO: 69767, SEQ ID NO: 69790, SEQ ID NO: 69832, SEQ ID NO: 69836, SEQ ID NO: 69882, SEQ ID NO: 69999, SEQ ID NO: 70012, SEQ ID NO: 70036, SEQ ID NO: 70050, SEQ ID NO: 70066, SEQ ID NO: 70069, SEQ ID NO: 70109, SEQ ID NO: 70159, SEQ ID NO: 70165, SEQ ID NO: 70175, SEQ ID NO: 70177, SEQ ID NO: 70188, SEQ ID NO: 70284, SEQ ID NO: 70323, SEQ ID NO: 70326, SEQ ID NO: 70428, SEQ ID NO: 70455, SEQ ID NO: 70570, SEQ ID NO: 70606, SEQ ID NO: 70635, SEQ ID NO: 70676, SEQ ID NO: 70692, SEQ ID NO: 70716, SEQ ID NO: 70728, SEQ ID NO: 70735, SEQ ID NO: 70750, SEQ ID NO: 70764, SEQ ID NO: 70770, SEQ ID NO: 70806, SEQ ID NO: 70968, SEQ ID NO: 70997, SEQ ID NO: 71049, SEQ ID NO: 71075, SEQ ID NO: 71090, SEQ ID NO: 71117, SEQ ID NO: 71151, SEQ ID NO: 71176, SEQ ID NO: 71193, SEQ ID NO: 71203, SEQ ID NO: 71239, SEQ ID NO: 71247, SEQ ID NO: 71249, SEQ ID NO: 71275, SEQ ID NO: 71287, SEQ ID NO: 71328, SEQ ID NOs: 71359 to 71360, SEQ ID NOs: 71367 to 71368, SEQ ID NO: 71392, SEQ ID NO: 71414, SEQ ID NO: 71449, SEQ ID NO: 71476, SEQ ID NO: 71482, SEQ ID NO: 71543, SEQ ID NO: 71547, SEQ ID NO: 71560, SEQ ID NO: 71585, SEQ ID NO: 71612, SEQ ID NO: 71620, SEQ ID NO: 71628, SEQ ID NO: 71636, SEQ ID NO: 71673, SEQ ID NOs: 71688 to 71689, SEQ ID NO: 71696, SEQ ID NO: 71700, SEQ ID NO: 71718, SEQ ID NO: 71725, SEQ ID NO: 71807, SEQ ID NO: 71919, SEQ ID NO: 71935, SEQ ID NO: 71943, SEQ ID NO: 71948, SEQ ID NOs: 71987 to 71988, SEQ ID NO: 72045, SEQ ID NO: 72055, SEQ ID NO: 72076, SEQ ID NO: 72085, SEQ ID NO: 72102, SEQ ID NO: 72159, SEQ ID NO: 72183, SEQ ID NO: 72216, SEQ ID NO: 72241, SEQ ID NO: 72331, SEQ ID NO: 72364, SEQ ID NO: 72372, SEQ ID NO: 72390, SEQ ID NO: 72448, SEQ ID NO: 72528, SEQ ID NO: 72595, SEQ ID NO: 72604, SEQ ID NO: 72648, SEQ ID NO: 72667, SEQ ID NO: 72685, SEQ ID NO: 72721, SEQ ID NO: 72751, SEQ ID NO: 72755, SEQ ID NO: 72805, SEQ ID NO: 72810, SEQ ID NO: 72831, SEQ ID NO: 72837, SEQ ID NO: 72862, SEQ ID NO: 72885, SEQ ID NO: 72989, SEQ ID NO: 73014, SEQ ID NOs: 73045 to 73046, SEQ ID NO: 73086, SEQ ID NO: 73094, SEQ ID NO: 73113, SEQ ID NO: 73122, SEQ ID NO: 73161, SEQ ID NO: 73191, SEQ ID NO: 73224, SEQ ID NOs: 73232 to 73233, SEQ ID NO: 73238, SEQ ID NO: 73290, SEQ ID NO: 73327, SEQ ID NO: 73377, SEQ ID NO: 73382, SEQ ID NO: 73404, SEQ ID NO: 73406, SEQ ID NO: 73422, SEQ ID NOs: 73428 to 73429, SEQ ID NO: 73466, SEQ ID NO: 73475, SEQ ID NO: 73521, SEQ ID NO: 73523, SEQ ID NO: 73532, SEQ ID NO: 73550, SEQ ID NO: 73560, SEQ ID NO: 73591, SEQ ID NO: 73597, SEQ ID NO: 73644, SEQ ID NO: 73657, SEQ ID NO: 73660, SEQ ID NO: 73689, SEQ ID NO: 73729, SEQ ID NO: 73733, SEQ ID NO: 73873, SEQ ID NO: 73886, SEQ ID NO: 73930, SEQ ID NO: 73957, SEQ ID NOs: 73991 to 73992, SEQ ID NO: 74045, SEQ ID NO: 74047, SEQ ID NO: 74072, SEQ ID NO: 74080, SEQ ID NOs: 74096 to 74097, SEQ ID NO: 74107, SEQ ID NO: 74203, SEQ ID NO: 74208, SEQ ID NO: 74210, SEQ ID NO: 74238, SEQ ID NO: 74302, SEQ ID NO: 74350, SEQ ID NO: 74352, SEQ ID NO: 74411, SEQ ID NO: 74448, SEQ ID NO: 74473, SEQ ID NO: 74482, SEQ ID NO: 74515, SEQ ID NO: 74527, SEQ ID NO: 74560, SEQ ID NO: 74616, SEQ ID NO: 74649, SEQ ID NO: 74672, SEQ ID NO: 74674, SEQ ID NO: 74737, SEQ ID NO: 74782, SEQ ID NO: 74808, SEQ ID NO: 74810, SEQ ID NO: 74835, SEQ ID NO: 74886, SEQ ID NO: 74901, SEQ ID NO: 74946, SEQ ID NOs: 74975 to 74976, SEQ ID NO: 75017, SEQ ID NO: 75021, SEQ ID NO: 75040, SEQ ID NO: 75049, SEQ ID NO: 75063, SEQ ID NO: 75066, SEQ ID NO: 75072, SEQ ID NO: 75092, SEQ ID NO: 75094, SEQ ID NO: 75099, SEQ ID NO: 75111, SEQ ID NO: 75148, SEQ ID NO: 75245, SEQ ID NO: 75269, SEQ ID NO: 75388, SEQ ID NO: 75403, SEQ ID NO: 75429, SEQ ID NO: 75455, SEQ ID NO: 75470, SEQ ID NO: 75489, SEQ ID NO: 75506, SEQ ID NO: 75529, SEQ ID NO: 75547, SEQ ID NO: 75551, SEQ ID NOs: 75576 to 75577, SEQ ID NO: 75595, SEQ ID NO: 75701, SEQ ID NO: 75716, SEQ ID NO: 75747, SEQ ID NO: 75757, SEQ ID NO: 75762, SEQ ID NO: 75766, SEQ ID NO: 75874, SEQ ID NO: 75915, SEQ ID NO: 75933, SEQ ID NO: 75975, SEQ ID NO: 75979, SEQ ID NO: 76016, SEQ ID NO: 76023, SEQ ID NO: 76034, SEQ ID NO: 76040, SEQ ID NO: 76064, SEQ ID NO: 76076, SEQ ID NO: 76102, SEQ ID NOs: 76147 to 76148, SEQ ID NO: 76189, SEQ ID NO: 76199, SEQ ID NO: 76369, SEQ ID NO: 76375, SEQ ID NO: 76397, SEQ ID NO: 76410, SEQ ID NO: 76435, SEQ ID NO: 76446, SEQ ID NO: 76451, SEQ ID NOs: 76456 to 76458, SEQ ID NO: 76492, SEQ ID NO: 76544, SEQ ID NO: 76569, SEQ ID NO: 76574, SEQ ID NO: 76611, SEQ ID NO: 76654, SEQ ID NO: 76710, SEQ ID NO: 76753, SEQ ID NO: 76769, SEQ ID NO: 76781, SEQ ID NO: 76797, SEQ ID NO: 76803, SEQ ID NO: 76858, SEQ ID NO: 76860, SEQ ID NO: 76879, SEQ ID NO: 76943, SEQ ID NO: 76971, SEQ ID NO: 76981, SEQ ID NO: 77091, SEQ ID NO: 77133, SEQ ID NOs: 77193 to 77194, SEQ ID NO: 77210, SEQ ID NO: 77219, SEQ ID NO: 77237, SEQ ID NO: 77246, SEQ ID NO: 77251, SEQ ID NO: 77281, SEQ ID NO: 77293, SEQ ID NO: 77323, SEQ ID NO: 77334, SEQ ID NO: 77339, SEQ ID NO: 77396, SEQ ID NO: 77423, SEQ ID NO: 77433, SEQ ID NO: 77437, SEQ ID NO: 77442, SEQ ID NO: 77453, SEQ ID NO: 77485, SEQ ID NO: 77579, SEQ ID NO: 77627, SEQ ID NO: 77639, SEQ ID NO: 77644, SEQ ID NO: 77703, SEQ ID NO: 77773, SEQ ID NO: 77814, SEQ ID NO: 77868, SEQ ID NO: 77874, SEQ ID NO: 77900, SEQ ID NO: 77925, SEQ ID NO: 77995, SEQ ID NO: 78017, SEQ ID NO: 78083, SEQ ID NO: 78086, SEQ ID NO: 78090, SEQ ID NO: 78131, SEQ ID NO: 78139, SEQ ID NO: 78228, SEQ ID NO: 78248, SEQ ID NO: 78260, SEQ ID NO: 78346, SEQ ID NO: 78352, SEQ ID NO: 78377, SEQ ID NO: 78416, SEQ ID NO: 78421, SEQ ID NO: 78440, SEQ ID NO: 78521, SEQ ID NO: 78530, SEQ ID NO: 78532, SEQ ID NO: 78546, SEQ ID NO: 78600, SEQ ID NO: 78631, SEQ ID NO: 78671, SEQ ID NO: 78709, SEQ ID NO: 78714, SEQ ID NO: 78730, SEQ ID NO: 78738, SEQ ID NO: 78810, SEQ ID NO: 78855, SEQ ID NO: 78883, SEQ ID NO: 78917, SEQ ID NOs: 78919 to 78920, SEQ ID NO: 78928, SEQ ID NO: 79035, SEQ ID NO: 79048, SEQ ID NO: 79056, SEQ ID NO: 79086, SEQ ID NO: 79091, SEQ ID NO: 79095, SEQ ID NO: 79107, SEQ ID NO: 79109, SEQ ID NO: 79136, SEQ ID NO: 79142, SEQ ID NO: 79147, SEQ ID NO: 79151, SEQ ID NO: 79194, SEQ ID NO: 79196, SEQ ID NO: 79227, SEQ ID NO: 79247, SEQ ID NO: 79253, SEQ ID NO: 79255, SEQ ID NO: 79269, SEQ ID NO: 79310, SEQ ID NO: 79331, SEQ ID NO: 79357, SEQ ID NO: 79406, SEQ ID NO: 79437, SEQ ID NO: 79448, SEQ ID NO: 79453, SEQ ID NO: 79480, SEQ ID NO: 79483, SEQ ID NO: 79486, SEQ ID NO: 79504, SEQ ID NO: 79508, SEQ ID NO: 79516, SEQ ID NO: 79548, SEQ ID NO: 79575, SEQ ID NO: 79588, SEQ ID NO: 79592, SEQ ID NO: 79609, SEQ ID NO: 79626, SEQ ID NO: 79640, SEQ ID NO: 79697, SEQ ID NO: 79746, SEQ ID NO: 79751, SEQ ID NO: 79766, SEQ ID NO: 79784, SEQ ID NO: 79787, SEQ ID NO: 79816, SEQ ID NO: 79834, SEQ ID NO: 79853, SEQ ID NO: 79858, SEQ ID NO: 79861, SEQ ID NO: 79874, SEQ ID NO: 79877, SEQ ID NO: 79906, SEQ ID NO: 79909, SEQ ID NO: 79939, SEQ ID NO: 79958, SEQ ID NO: 79987, SEQ ID NO: 80000, SEQ ID NO: 80027, SEQ ID NO: 80040, SEQ ID NO: 80139, SEQ ID NO: 80141, SEQ ID NO: 80212, SEQ ID NO: 80232, SEQ ID NO: 80237, SEQ ID NO: 80241, SEQ ID NO: 80318, SEQ ID NO: 80320, SEQ ID NOs: 80367 to 80368, SEQ ID NO: 80398, SEQ ID NO: 80421, SEQ ID NO: 80461, SEQ ID NO: 80486, SEQ ID NO: 80513, SEQ ID NO: 80527, SEQ ID NO: 80555, SEQ ID NO: 80574, SEQ ID NO: 80583, SEQ ID NO: 80627, SEQ ID NO: 80673, SEQ ID NOs: 80703 to 80704, SEQ ID NOs: 80718 to 80719, SEQ ID NO: 80725, SEQ ID NO: 80796, SEQ ID NO: 80804, SEQ ID NO: 80833, SEQ ID NO: 80869, SEQ ID NO: 80903, SEQ ID NO: 80931, SEQ ID NO: 80936, SEQ ID NO: 80946, SEQ ID NO: 80990, SEQ ID NO: 81021, SEQ ID NO: 81042, SEQ ID NO: 81046, SEQ ID NO: 81054, SEQ ID NO: 81066, SEQ ID NO: 81145, SEQ ID NO: 81166, SEQ ID NO: 81168, SEQ ID NO: 81175, SEQ ID NO: 81185, SEQ ID NO: 81207, SEQ ID NO: 81251, SEQ ID NO: 81259, SEQ ID NO: 81302, SEQ ID NO: 81337, SEQ ID NO: 81342, SEQ ID NO: 81386, SEQ ID NO: 81428, SEQ ID NO: 81446, SEQ ID NO: 81458, SEQ ID NO: 81488, SEQ ID NO: 81505, SEQ ID NO: 81517, SEQ ID NO: 81566, SEQ ID NO: 81687, SEQ ID NO: 81690, SEQ ID NO: 81694, SEQ ID NO: 81713, SEQ ID NO: 81755, SEQ ID NO: 81825, SEQ ID NO: 81856, SEQ ID NO: 81873, SEQ ID NO: 81904, SEQ ID NO: 81916, SEQ ID NO: 81938, SEQ ID NO: 81951, SEQ ID NO: 81963, SEQ ID NO: 82045, SEQ ID NO: 82085, SEQ ID NO: 82117, SEQ ID NO: 82136, SEQ ID NO: 82193, SEQ ID NO: 82239, SEQ ID NO: 82241, SEQ ID NO: 82259, SEQ ID NO: 82320, SEQ ID NO: 82382, SEQ ID NO: 82417, SEQ ID NO: 82459, SEQ ID NO: 82474, SEQ ID NO: 82514, SEQ ID NO: 82556, SEQ ID NO: 82581, SEQ ID NO: 82596, SEQ ID NO: 82633, SEQ ID NO: 82644, SEQ ID NO: 82649, SEQ ID NO: 82676, SEQ ID NO: 82681, SEQ ID NO: 82718, SEQ ID NO: 82731, SEQ ID NO: 82769, SEQ ID NO: 82817, SEQ ID NO: 82870, SEQ ID NO: 82872, SEQ ID NO: 82885, SEQ ID NOs: 82920 to 82921, SEQ ID NO: 82955, SEQ ID NO: 82960, SEQ ID NO: 82985, SEQ ID NO: 82988, SEQ ID NO: 83013, SEQ ID NO: 83018, SEQ ID NO: 83051, SEQ ID NO: 83062, SEQ ID NO: 83099, SEQ ID NO: 83149, SEQ ID NO: 83185, SEQ ID NO: 83193, SEQ ID NO: 83208, SEQ ID NO: 83225, SEQ ID NO: 83235, SEQ ID NO: 83243, SEQ ID NO: 83260, SEQ ID NO: 83269, SEQ ID NO: 83286, SEQ ID NO: 83293, SEQ ID NO: 83349, SEQ ID NO: 83383, SEQ ID NO: 83409, SEQ ID NO: 83426, SEQ ID NO: 83438, SEQ ID NO: 83549, SEQ ID NO: 83605, SEQ ID NO: 83686, SEQ ID NO: 83704, SEQ ID NO: 83714, SEQ ID NO: 83806, SEQ ID NO: 83811, SEQ ID NO: 83821, SEQ ID NOs: 83863 to 83864, SEQ ID NO: 83872, SEQ ID NO: 83891, SEQ ID NO: 83899, SEQ ID NO: 83901, SEQ ID NO: 83921, SEQ ID NO: 83970, SEQ ID NO: 83974, SEQ ID NO: 83988, SEQ ID NO: 84002, SEQ ID NO: 84025, SEQ ID NO: 84070, SEQ ID NO: 84090, SEQ ID NO: 84154, SEQ ID NO: 84182, SEQ ID NOs: 84187 to 84188, SEQ ID NO: 84201, SEQ ID NO: 84212, SEQ ID NO: 84232, SEQ ID NO: 84238, SEQ ID NO: 84248, SEQ ID NO: 84306, SEQ ID NO: 84324, SEQ ID NO: 84348, SEQ ID NO: 84376, SEQ ID NO: 84387, SEQ ID NO: 84390, SEQ ID NO: 84422, SEQ ID NO: 84428, SEQ ID NO: 84437, SEQ ID NO: 84445, SEQ ID NO: 84489, SEQ ID NO: 84501, SEQ ID NO: 84534, SEQ ID NO: 84558, SEQ ID NO: 84593, SEQ ID NO: 84676, SEQ ID NO: 84782, SEQ ID NO: 84795, SEQ ID NO: 84822, SEQ ID NO: 84885, SEQ ID NO: 84991, SEQ ID NO: 85010, SEQ ID NO: 85024, SEQ ID NO: 85054, SEQ ID NO: 85056, SEQ ID NO: 85060, SEQ ID NO: 85101, SEQ ID NO: 85117, SEQ ID NO: 85146, SEQ ID NO: 85219, SEQ ID NOs: 85242 to 85243, SEQ ID NO: 85266, SEQ ID NO: 85310, SEQ ID NO: 85349, SEQ ID NO: 85361, SEQ ID NO: 85370, SEQ ID NO: 85379, SEQ ID NO: 85399, SEQ ID NO: 85417, SEQ ID NO: 85435, SEQ ID NO: 85447, SEQ ID NO: 85463, SEQ ID NO: 85519, SEQ ID NO: 85528, SEQ ID NO: 85530, SEQ ID NO: 85602, SEQ ID NO: 85624, SEQ ID NO: 85629, SEQ ID NO: 85725, SEQ ID NO: 85737, SEQ ID NO: 85848, SEQ ID NO: 85878, SEQ ID NO: 85910, SEQ ID NO: 85959, SEQ ID NO: 85963, SEQ ID NO: 85967, SEQ ID NOs: 85985 to 85986, SEQ ID NO: 86003, SEQ ID NO: 86076, SEQ ID NO: 86159, SEQ ID NO: 86208, SEQ ID NO: 86248, SEQ ID NO: 86279, SEQ ID NO: 86343, SEQ ID NO: 86366, SEQ ID NO: 86417, SEQ ID NO: 86431, SEQ ID NO: 86433, SEQ ID NO: 86473, SEQ ID NO: 86523, SEQ ID NOs: 86526 to 86527, SEQ ID NO: 86541, SEQ ID NO: 86567, SEQ ID NO: 86586, SEQ ID NO: 86589, SEQ ID NO: 86599, SEQ ID NO: 86633, SEQ ID NO: 86665, SEQ ID NO: 86688, SEQ ID NO: 86698, SEQ ID NO: 86725, SEQ ID NO: 86761, SEQ ID NO: 86775, SEQ ID NO: 86825, SEQ ID NO: 86914, SEQ ID NO: 86929, SEQ ID NO: 86940, SEQ ID NO: 86969, SEQ ID NO: 86994, SEQ ID NO: 87027, SEQ ID NO: 87041, SEQ ID NO: 87157, SEQ ID NO: 87160, SEQ ID NO: 87185, SEQ ID NO: 87251, SEQ ID NO: 87255, SEQ ID NO: 87300, SEQ ID NO: 87321, SEQ ID NO: 87358, SEQ ID NO: 87425, SEQ ID NO: 87427, SEQ ID NO: 87431, SEQ ID NO: 87474, SEQ ID NO: 87536, SEQ ID NO: 87550, SEQ ID NO: 87576, SEQ ID NO: 87603, SEQ ID NO: 87623, SEQ ID NO: 87626, SEQ ID NO: 87638, SEQ ID NO: 87708, SEQ ID NO: 87733, SEQ ID NO: 87785, SEQ ID NO: 87799, SEQ ID NO: 87818, SEQ ID NOs: 87865 to 87866, SEQ ID NO: 87875, SEQ ID NO: 87917, SEQ ID NO: 87946, SEQ ID NO: 87951, SEQ ID NO: 88016, SEQ ID NO: 88061, SEQ ID NO: 88120, SEQ ID NO: 88122, SEQ ID NO: 88125, SEQ ID NO: 88144, SEQ ID NO: 88178, SEQ ID NO: 88180, SEQ ID NO: 88186, SEQ ID NO: 88203, SEQ ID NO: 88241, SEQ ID NO: 88272, SEQ ID NO: 88285, SEQ ID NO: 88288, SEQ ID NO: 88359, SEQ ID NO: 88384, SEQ ID NO: 88390, SEQ ID NO: 88474, SEQ ID NO: 88522, SEQ ID NO: 88563, SEQ ID NO: 88643, SEQ ID NO: 88659, SEQ ID NO: 88708, SEQ ID NO: 88710, SEQ ID NO: 88731, SEQ ID NO: 88751, SEQ ID NO: 88806, SEQ ID NO: 88975, SEQ ID NO: 88999, SEQ ID NO: 89010, SEQ ID NO: 89012, SEQ ID NO: 89028, SEQ ID NO: 89035, SEQ ID NO: 89037, SEQ ID NO: 89039, SEQ ID NO: 89045, SEQ ID NO: 89073, SEQ ID NO: 89118, SEQ ID NO: 89126, SEQ ID NO: 89135, SEQ ID NO: 89138, SEQ ID NO: 89147, SEQ ID NO: 89168, SEQ ID NO: 89193, SEQ ID NO: 89228, SEQ ID NO: 89235, SEQ ID NO: 89269, SEQ ID NO: 89286, SEQ ID NO: 89291, SEQ ID NO: 89339, SEQ ID NO: 89342, SEQ ID NO: 89394, SEQ ID NO: 89453, SEQ ID NO: 89492, SEQ ID NO: 89510, SEQ ID NO: 89555, SEQ ID NO: 89595, SEQ ID NO: 89670, SEQ ID NO: 89695, SEQ ID NO: 89785, SEQ ID NO: 89836, SEQ ID NO: 89842, SEQ ID NO: 89921, SEQ ID NO: 89929, SEQ ID NO: 89935, SEQ ID NO: 89938, SEQ ID NO: 89950, SEQ ID NO: 89953, SEQ ID NO: 89960, SEQ ID NO: 89987, SEQ ID NO: 89992, SEQ ID NO: 90030, SEQ ID NO: 90056, SEQ ID NO: 90066, SEQ ID NO: 90085, SEQ ID NO: 90089, SEQ ID NO: 90115, SEQ ID NO: 90120, SEQ ID NO: 90133, SEQ ID NO: 90157, SEQ ID NO: 90159, SEQ ID NO: 90191, SEQ ID NO: 90268, SEQ ID NO: 90274, SEQ ID NO: 90280, SEQ ID NO: 90287, SEQ ID NO: 90315, SEQ ID NO: 90408, SEQ ID NO: 90417, SEQ ID NO: 90443, SEQ ID NO: 90466, SEQ ID NO: 90507, SEQ ID NO: 90555, SEQ ID NO: 90593, SEQ ID NO: 90599, SEQ ID NO: 90621, SEQ ID NO: 90634, SEQ ID NO: 90653, SEQ ID NO: 90696, SEQ ID NO: 90758, SEQ ID NO: 90777, SEQ ID NO: 90835, SEQ ID NO: 90882, SEQ ID NO: 90898, SEQ ID NO: 90938, SEQ ID NO: 90954, SEQ ID NO: 90999, SEQ ID NO: 91045, SEQ ID NO: 91060, SEQ ID NO: 91072, SEQ ID NO: 91076, SEQ ID NO: 91105, SEQ ID NO: 91132, SEQ ID NO: 91222, SEQ ID NO: 91226, SEQ ID NO: 91229, SEQ ID NO: 91306, SEQ ID NO: 91309, SEQ ID NO: 91315, SEQ ID NO: 91346, SEQ ID NO: 91419, SEQ ID NO: 91449, SEQ ID NO: 91498, SEQ ID NO: 91563, SEQ ID NO: 91588, SEQ ID NO: 91681, SEQ ID NO: 91766, SEQ ID NOs: 91775 to 91776, SEQ ID NO: 91780, SEQ ID NO: 91799, SEQ ID NO: 91845, SEQ ID NO: 91852, SEQ ID NOs: 91885 to 91886, SEQ ID NO: 91930, SEQ ID NO: 91935, SEQ ID NO: 91953, SEQ ID NO: 91966, SEQ ID NO: 91984, SEQ ID NO: 92026, SEQ ID NO: 92030, SEQ ID NO: 92069, SEQ ID NO: 92100, SEQ ID NO: 92111, SEQ ID NO: 92189, SEQ ID NO: 92249, SEQ ID NO: 92296, SEQ ID NO: 92400, SEQ ID NO: 92404, SEQ ID NO: 92409, SEQ ID NO: 92429, SEQ ID NO: 92474, SEQ ID NO: 92500, SEQ ID NO: 92515, SEQ ID NO: 92538, SEQ ID NO: 92646, SEQ ID NO: 92659, SEQ ID NO: 92671, SEQ ID NO: 92673, SEQ ID NO: 92675, SEQ ID NO: 92684, SEQ ID NO: 92704, SEQ ID NO: 92832, SEQ ID NO: 92835, SEQ ID NO: 92854, SEQ ID NO: 92858, SEQ ID NO: 92877, SEQ ID NO: 92918, SEQ ID NO: 92920, SEQ ID NO: 93004, SEQ ID NO: 93036, SEQ ID NO: 93042, SEQ ID NO: 93071, SEQ ID NO: 93089, SEQ ID NO: 93136, SEQ ID NO: 93180, SEQ ID NO: 93251, SEQ ID NO: 93325, SEQ ID NO: 93335, SEQ ID NO: 93344, SEQ ID NO: 93356, SEQ ID NO: 93382, SEQ ID NO: 93408, SEQ ID NO: 93420, SEQ ID NO: 93503, SEQ ID NO: 93537, SEQ ID NO: 93617, SEQ ID NO: 93658, SEQ ID NO: 93697, SEQ ID NO: 93710, SEQ ID NO: 93877, SEQ ID NO: 93885, SEQ ID NO: 93888, SEQ ID NO: 93893, SEQ ID NO: 93903, SEQ ID NO: 93912, SEQ ID NO: 93926, SEQ ID NO: 93933, SEQ ID NO: 93982, SEQ ID NO: 93987, SEQ ID NO: 94000, SEQ ID NO: 94054, SEQ ID NO: 94058, SEQ ID NO: 94087, SEQ ID NO: 94090, SEQ ID NO: 94102, SEQ ID NO: 94143, SEQ ID NO: 94269, SEQ ID NO: 94367, SEQ ID NO: 94465, SEQ ID NO: 94477, SEQ ID NO: 94525, SEQ ID NO: 94587, or SEQ ID NOs: 95593 to 113807.

In some embodiments, the amino acid sequence for a MHC class I peptide vaccine for the SSX2 protein comprises one or more of the SEQ ID NOs: 162383 to 162453. In some embodiments, any one of the peptides in the SSX2 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 162383 to 162453.

In some embodiments, the amino acid sequence for a MHC class I peptide vaccine for the SSX2 protein comprises one or more of the SEQ ID NOs: 162383 to 166443. In some embodiments, any one of the peptides in the SSX2 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 162383 to 166443.

In some embodiments, the amino acid sequence for a MHC class I peptide vaccine for the SSX2 protein comprises two or more of the SEQ ID NOs: 162383 to 162453. In some embodiments, any one of the peptides in the SSX2 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 162383 to 162453.

In some embodiments, the amino acid sequence for a MHC class I peptide vaccine for the SSX2 protein comprises two or more of the SEQ ID NOs: 162383 to 166443. In some embodiments, any one of the peptides in the SSX2 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 162383 to 166443.

In some embodiments, the amino acid sequence for a MHC class I peptide vaccine for the PRAME protein comprises one or more of the SEQ ID NOs: 144109 to 144188. In some embodiments, any one of the peptides in the PRAME vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 144109 to 144188.

In some embodiments, the amino acid sequence for a MHC class I peptide vaccine for the PRAME protein comprises one or more of the SEQ ID NOs: 144109 to 162382. In some embodiments, any one of the peptides in the PRAME vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 144109 to 162382.

In some embodiments, the amino acid sequence for a MHC class I peptide vaccine for the PRAME protein comprises two or more of the SEQ ID NOs: 144109 to 144188. In some embodiments, any one of the peptides in the PRAME vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 144109 to 144188.

In some embodiments, the amino acid sequence for a MHC class I peptide vaccine for the PRAME protein comprises two or more of the SEQ ID NOs: 144109 to 162382. In some embodiments, any one of the peptides in the PRAME vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 144109 to 162382.

In some embodiments, the amino acid sequence for a MHC class I peptide vaccine for the KKLC1 protein comprises one or more of the SEQ ID NOs: 37110 to 37174. In some embodiments, any one of the peptides in the KKLC1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 37110 to 37174.

In some embodiments, the amino acid sequence for a MHC class I peptide vaccine for the KKLC1 protein comprises one or more of the SEQ ID NOs: 37110 to 41320. In some embodiments, any one of the peptides in the KKLC1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 37110 to 41320.

In some embodiments, the amino acid sequence for a MHC class I peptide vaccine for the KKLC1 protein comprises two or more of the SEQ ID NOs: 37110 to 37174. In some embodiments, any one of the peptides in the KKLC1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 37110 to 37174.

In some embodiments, the amino acid sequence for a MHC class I peptide vaccine for the KKLC1 protein comprises two or more of the SEQ ID NOs: 37110 to 41320. In some embodiments, any one of the peptides in the KKLC1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 37110 to 41320.

In some embodiments, the amino acid sequence for a MHC class I peptide vaccine for the PMEL protein comprises one or more of the SEQ ID NOs: 125134 to 125218. In some embodiments, any one of the peptides in the PMEL vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 125134 to 125218.

In some embodiments, the amino acid sequence for a MHC class I peptide vaccine for the PMEL protein comprises one or more of the SEQ ID NOs: 125134 to 144108. In some embodiments, any one of the peptides in the PMEL vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 125134 to 144108.

In some embodiments, the amino acid sequence for a MHC class I peptide vaccine for the PMEL protein comprises two or more of the SEQ ID NOs: 125134 to 125218. In some embodiments, any one of the peptides in the PMEL vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 125134 to 125218.

In some embodiments, the amino acid sequence for a MHC class I peptide vaccine for the PMEL protein comprises two or more of the SEQ ID NOs: 125134 to 144108. In some embodiments, any one of the peptides in the PMEL vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 125134 to 144108.

In some embodiments, the amino acid sequence for a MHC class I peptide vaccine for the TYRP1 protein comprises one or more of the SEQ ID NOs: 166444 to 166531. In some embodiments, any one of the peptides in the TYRP1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 166444 to 166531.

In some embodiments, the amino acid sequence for a MHC class I peptide vaccine for the TYRP1 protein comprises one or more of the SEQ ID NOs: 166444 to 182573. In some embodiments, any one of the peptides in the TYRP1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 166444 to 182573.

In some embodiments, the amino acid sequence for a MHC class I peptide vaccine for the TYRP1 protein comprises two or more of the SEQ ID NOs: 166444 to 166531. In some embodiments, any one of the peptides in the TYRP1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 166444 to 166531.

In some embodiments, the amino acid sequence for a MHC class I peptide vaccine for the TYRP1 protein comprises two or more of the SEQ ID NOs: 166444 to 182573. In some embodiments, any one of the peptides in the TYRP1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 166444 to 182573.

In some embodiments, the amino acid sequence for a MHC class I peptide vaccine for the TYRP2 protein comprises one or more of the SEQ ID NO: 166476, SEQ ID NO: 167118, SEQ ID NO: 169740, SEQ ID NO: 173412, SEQ ID NO: 179404, and SEQ ID NOs: 182574 to 182654. In some embodiments, any one of the peptides in the TYRP2 vaccine comprise an amino acid sequence 80, 81, 82, 83, 84, 85, 86, 87, 88, 89, 90, 91, 92, 93, 94, 95, 96, 97, 98 or 99% identical to SEQ ID NO: 166476, SEQ ID NO: 167118, SEQ ID NO: 169740, SEQ ID NO: 173412, SEQ ID NO: 179404, or SEQ ID NOs: 182574 to 182654.

In some embodiments, the amino acid sequence for a MHC class I peptide vaccine for the TYRP2 protein comprises one or more of the SEQ ID NOs: 166476 to 166477, SEQ ID NO: 166486, SEQ ID NO: 166513, SEQ ID NO: 166591, SEQ ID NO: 166606, SEQ ID NO: 166629, SEQ ID NO: 166641, SEQ ID NO: 166667, SEQ ID NOs: 166678 to 166679, SEQ ID NO: 166795, SEQ ID NO: 166799, SEQ ID NO: 166834, SEQ ID NO: 166854, SEQ ID NO: 166909, SEQ ID NO: 166912, SEQ ID NO: 166942, SEQ ID NOs:

166991 to 166992, SEQ ID NO: 167062, SEQ ID NO: 167067, SEQ ID NOs: 167073 to 167074, SEQ ID NO: 167106, SEQ ID NO: 167118, SEQ ID NO: 167151, SEQ ID NO: 167177, SEQ ID NO: 167241, SEQ ID NO: 167271, SEQ ID NO: 167395, SEQ ID NO: 167491, SEQ ID NO: 167505, SEQ ID NO: 167687, SEQ ID NO: 167736, SEQ ID NO: 167740, SEQ ID NO: 167743, SEQ ID NO: 167755, SEQ ID NO: 167810, SEQ ID NO: 167831, SEQ ID NO: 167837, SEQ ID NO: 167844, SEQ ID NOs: 167847 to 167848, SEQ ID NO: 167859, SEQ ID NO: 167880, SEQ ID NO: 167891, SEQ ID NO: 167897, SEQ ID NO: 167933, SEQ ID NO: 168094, SEQ ID NOs: 168111 to 168112, SEQ ID NO: 168132, SEQ ID NO: 168144, SEQ ID NO: 168167, SEQ ID NO: 168211, SEQ ID NO: 168252, SEQ ID NO: 168268, SEQ ID NO: 168343, SEQ ID NO: 168354, SEQ ID NO: 168376, SEQ ID NO: 168396, SEQ ID NO: 168410, SEQ ID NO: 168423, SEQ ID NO: 168460, SEQ ID NO: 168484, SEQ ID NO: 168496, SEQ ID NO: 168616, SEQ ID NO: 168626, SEQ ID NO: 168646, SEQ ID NO: 168660, SEQ ID NO: 168681, SEQ ID NO: 168703, SEQ ID NO: 168711, SEQ ID NO: 168725, SEQ ID NO: 168728, SEQ ID NO: 168760, SEQ ID NOs: 168792 to 168793, SEQ ID NO: 168815, SEQ ID NO: 168851, SEQ ID NO: 168863, SEQ ID NO: 168867, SEQ ID NO: 168871, SEQ ID NO: 168924, SEQ ID NO: 168927, SEQ ID NO: 168947, SEQ ID NO: 168974, SEQ ID NO: 169000, SEQ ID NO: 169024, SEQ ID NO: 169035, SEQ ID NO: 169112, SEQ ID NO: 169150, SEQ ID NO: 169187, SEQ ID NO: 169233, SEQ ID NO: 169240, SEQ ID NO: 169247, SEQ ID NO: 169275, SEQ ID NO: 169375, SEQ ID NO: 169403, SEQ ID NO: 169428, SEQ ID NO: 169460, SEQ ID NO: 169474, SEQ ID NO: 169500, SEQ ID NO: 169530, SEQ ID NO: 169542, SEQ ID NO: 169546, SEQ ID NO: 169548, SEQ ID NO: 169553, SEQ ID NO: 169555, SEQ ID NO: 169563, SEQ ID NO: 169565, SEQ ID NO: 169578, SEQ ID NO: 169584, SEQ ID NO: 169605, SEQ ID NO: 169641, SEQ ID NO: 169665, SEQ ID NO: 169673, SEQ ID NO: 169682, SEQ ID NO: 169700, SEQ ID NO: 169704, SEQ ID NO: 169740, SEQ ID NO: 169768, SEQ ID NO: 169850, SEQ ID NO: 169858, SEQ ID NO: 169867, SEQ ID NO: 169871, SEQ ID NO: 169886, SEQ ID NO: 169915, SEQ ID NO: 169966, SEQ ID NO: 170057, SEQ ID NO: 170061, SEQ ID NO: 170081, SEQ ID NOs: 170178 to 170179, SEQ ID NO: 170261, SEQ ID NO: 170268, SEQ ID NO: 170278, SEQ ID NO: 170290, SEQ ID NO: 170320, SEQ ID NO: 170329, SEQ ID NO: 170390, SEQ ID NO: 170443, SEQ ID NO: 170488, SEQ ID NO: 170543, SEQ ID NO: 170574, SEQ ID NO: 170679, SEQ ID NO: 170704, SEQ ID NOs: 170706 to 170707, SEQ ID NO: 170735, SEQ ID NO: 170754, SEQ ID NO: 170771, SEQ ID NOs: 170809 to 170810, SEQ ID NO: 170834, SEQ ID NO: 170847, SEQ ID NO: 170876, SEQ ID NOs: 170902 to 170903, SEQ ID NO: 170964, SEQ ID NO: 170968, SEQ ID NO: 170970, SEQ ID NO: 170976, SEQ ID NO: 170981, SEQ ID NO: 171011, SEQ ID NO: 171029, SEQ ID NO: 171080, SEQ ID NO: 171085, SEQ ID NO: 171091, SEQ ID NO: 171174, SEQ ID NO: 171182, SEQ ID NO: 171212, SEQ ID NO: 171229, SEQ ID NO: 171242, SEQ ID NO: 171256, SEQ ID NO: 171260, SEQ ID NO: 171263, SEQ ID NO: 171291, SEQ ID NO: 171329, SEQ ID NO: 171334, SEQ ID NO: 171340, SEQ ID NO: 171406, SEQ ID NO: 171412, SEQ ID NO: 171428, SEQ ID NO: 171462, SEQ ID NO: 171474, SEQ ID NO: 171485, SEQ ID NO: 171490, SEQ ID NO: 171526, SEQ ID NO: 171536, SEQ ID NO: 171550, SEQ ID NO: 171581, SEQ ID NO: 171608, SEQ ID NO: 171625, SEQ ID NO: 171655, SEQ ID NO: 171662, SEQ ID NO: 171709, SEQ ID NO: 171732, SEQ ID NO: 171746, SEQ ID NO: 171752, SEQ ID NO: 171768, SEQ ID NO: 171786, SEQ ID NO: 171788, SEQ ID NO: 171814, SEQ ID NO: 171855, SEQ ID NO: 171863, SEQ ID NO: 171980, SEQ ID NO: 172007, SEQ ID NO: 172010, SEQ ID NO: 172062, SEQ ID NO: 172161, SEQ ID NO: 172181, SEQ ID NO: 172203, SEQ ID NO: 172225, SEQ ID NO: 172231, SEQ ID NO: 172255, SEQ ID NO: 172272, SEQ ID NO: 172276, SEQ ID NO: 172294, SEQ ID NO: 172348, SEQ ID NO: 172372, SEQ ID NO: 172375, SEQ ID NO: 172378, SEQ ID NO: 172387, SEQ ID NO: 172389, SEQ ID NO: 172421, SEQ ID NOs: 172439 to 172440, SEQ ID NO: 172484, SEQ ID NO: 172495, SEQ ID NO: 172563, SEQ ID NO: 172594, SEQ ID NO: 172660, SEQ ID NO: 172693, SEQ ID NO: 172702, SEQ ID NO: 172704, SEQ ID NO: 172709, SEQ ID NO: 172717, SEQ ID NO: 172726, SEQ ID NO: 172742, SEQ ID NO: 172793, SEQ ID NO: 172801, SEQ ID NO: 172816, SEQ ID NO: 172849, SEQ ID NO: 172862, SEQ ID NO: 172900, SEQ ID NO: 172907, SEQ ID NO: 172919, SEQ ID NO: 172926, SEQ ID NO: 172990, SEQ ID NO: 172994, SEQ ID NO: 172999, SEQ ID NO: 173004, SEQ ID NO: 173007, SEQ ID NO: 173084, SEQ ID NO: 173202, SEQ ID NO: 173206, SEQ ID NO: 173284, SEQ ID NO: 173288, SEQ ID NO: 173318, SEQ ID NO: 173321, SEQ ID NO: 173412, SEQ ID NO: 173433, SEQ ID NO: 173452, SEQ ID NO: 173467, SEQ ID NOs: 173469 to 173470, SEQ ID NO: 173494, SEQ ID NO: 173497, SEQ ID NO: 173516, SEQ ID NO: 173611, SEQ ID NO: 173633, SEQ ID NO: 173713, SEQ ID NO: 173726, SEQ ID NO: 173762, SEQ ID NO: 173792, SEQ ID NO: 173837, SEQ ID NO: 173849, SEQ ID NO: 173858, SEQ ID NO: 173864, SEQ ID NO: 173884, SEQ ID NO: 173918, SEQ ID NO: 173923, SEQ ID NO: 173929, SEQ ID NO: 173958, SEQ ID NO: 173993, SEQ ID NO: 174020, SEQ ID NO: 174026, SEQ ID NO: 174044, SEQ ID NO: 174047, SEQ ID NO: 174110, SEQ ID NO: 174116, SEQ ID NO: 174161, SEQ ID NO: 174164, SEQ ID NO: 174168, SEQ ID NO: 174180, SEQ ID NO: 174190, SEQ ID NO: 174210, SEQ ID NO: 174228, SEQ ID NO: 174260, SEQ ID NO: 174265, SEQ ID NO: 174277, SEQ ID NO: 174283, SEQ ID NO: 174301, SEQ ID NO: 174311, SEQ ID NO: 174316, SEQ ID NO: 174356, SEQ ID NO: 174387, SEQ ID NO: 174424, SEQ ID NO: 174452, SEQ ID NO: 174486, SEQ ID NO: 174491, SEQ ID NO: 174507, SEQ ID NO: 174510, SEQ ID NO: 174595, SEQ ID NO: 174611, SEQ ID NO: 174633, SEQ ID NO: 174679, SEQ ID NO: 174702, SEQ ID NO: 174724, SEQ ID NO: 174747, SEQ ID NO: 174756, SEQ ID NO: 174779, SEQ ID NO: 174847, SEQ ID NO: 174880, SEQ ID NO: 174904, SEQ ID NO: 174956, SEQ ID NO: 174960, SEQ ID NO: 174978, SEQ ID NO: 175027, SEQ ID NO: 175063, SEQ ID NO: 175076, SEQ ID NO: 175129, SEQ ID NO: 175160, SEQ ID NO: 175175, SEQ ID NO: 175186, SEQ ID NO: 175191, SEQ ID NO: 175251, SEQ ID NO: 175269, SEQ ID NO: 175292, SEQ ID NO: 175295, SEQ ID NO: 175300, SEQ ID NO: 175416, SEQ ID NO: 175423, SEQ ID NO: 175506, SEQ ID NO: 175541, SEQ ID NO: 175557, SEQ ID NO: 175585, SEQ ID NO: 175625, SEQ ID NO: 175649, SEQ ID NO: 175671, SEQ ID NOs: 175721 to 175722, SEQ ID NO: 175820, SEQ ID NO: 175886, SEQ ID NO: 175902, SEQ ID NO: 175951, SEQ ID NOs: 175960 to 175961, SEQ ID NO: 175968, SEQ ID NO: 175975, SEQ ID NO: 175993, SEQ ID NO: 176018, SEQ ID NO: 176041, SEQ ID NO: 176051, SEQ ID NO: 176112, SEQ ID NO: 176118, SEQ ID NO: 176149, SEQ ID NO: 176179, SEQ ID NO: 176248, SEQ ID NO: 176306, SEQ ID NO: 176309, SEQ ID NO: 176312, SEQ ID NO: 176335, SEQ ID NO: 176338, SEQ ID NO: 176355, SEQ ID NO: 176369, SEQ ID NO: 176379, SEQ ID NO: 176452, SEQ ID NO: 176466, SEQ ID NO: 176503, SEQ ID NO:

176548, SEQ ID NO: 176560, SEQ ID NO: 176611, SEQ ID NO: 176621, SEQ ID NO: 176639, SEQ ID NO: 176693, SEQ ID NO: 176700, SEQ ID NO: 176713, SEQ ID NO: 176764, SEQ ID NOs: 176795 to 176796, SEQ ID NO: 176806, SEQ ID NO: 176815, SEQ ID NO: 176953, SEQ ID NO: 176958, SEQ ID NO: 176969, SEQ ID NO: 176980, SEQ ID NO: 176991, SEQ ID NO: 177016, SEQ ID NO: 177033, SEQ ID NO: 177044, SEQ ID NO: 177061, SEQ ID NO: 177065, SEQ ID NO: 177080, SEQ ID NO: 177088, SEQ ID NO: 177102, SEQ ID NO: 177119, SEQ ID NO: 177343, SEQ ID NO: 177358, SEQ ID NO: 177390, SEQ ID NO: 177430, SEQ ID NO: 177437, SEQ ID NO: 177465, SEQ ID NOs: 177482 to 177483, SEQ ID NO: 177492, SEQ ID NO: 177495, SEQ ID NO: 177522, SEQ ID NO: 177585, SEQ ID NO: 177604, SEQ ID NO: 177611, SEQ ID NO: 177664, SEQ ID NO: 177669, SEQ ID NO: 177701, SEQ ID NO: 177707, SEQ ID NO: 177710, SEQ ID NO: 177712, SEQ ID NO: 177714, SEQ ID NO: 177734, SEQ ID NO: 177808, SEQ ID NO: 177841, SEQ ID NO: 177848, SEQ ID NO: 177892, SEQ ID NO: 177918, SEQ ID NO: 177958, SEQ ID NOs: 177989 to 177990, SEQ ID NO: 178023, SEQ ID NO: 178032, SEQ ID NO: 178035, SEQ ID NO: 178039, SEQ ID NO: 178122, SEQ ID NO: 178161, SEQ ID NO: 178195, SEQ ID NO: 178208, SEQ ID NO: 178244, SEQ ID NO: 178272, SEQ ID NO: 178293, SEQ ID NO: 178310, SEQ ID NO: 178338, SEQ ID NO: 178353, SEQ ID NO: 178385, SEQ ID NO: 178399, SEQ ID NO: 178477, SEQ ID NO: 178519, SEQ ID NO: 178568, SEQ ID NO: 178587, SEQ ID NO: 178600, SEQ ID NO: 178612, SEQ ID NO: 178615, SEQ ID NO: 178651, SEQ ID NO: 178726, SEQ ID NO: 178740, SEQ ID NO: 178743, SEQ ID NO: 178750, SEQ ID NO: 178821, SEQ ID NO: 178886, SEQ ID NO: 178895, SEQ ID NO: 178911, SEQ ID NO: 178942, SEQ ID NO: 178946, SEQ ID NO: 178948, SEQ ID NO: 178966, SEQ ID NO: 179020, SEQ ID NO: 179031, SEQ ID NO: 179034, SEQ ID NO: 179130, SEQ ID NO: 179134, SEQ ID NO: 179151, SEQ ID NO: 179154, SEQ ID NO: 179224, SEQ ID NO: 179257, SEQ ID NO: 179387, SEQ ID NO: 179404, SEQ ID NO: 179444, SEQ ID NO: 179455, SEQ ID NO: 179462, SEQ ID NO: 179483, SEQ ID NO: 179544, SEQ ID NO: 179586, SEQ ID NO: 179600, SEQ ID NO: 179612, SEQ ID NO: 179619, SEQ ID NO: 179632, SEQ ID NO: 179677, SEQ ID NO: 179695, SEQ ID NO: 179697, SEQ ID NO: 179760, SEQ ID NO: 179863, SEQ ID NO: 179898, SEQ ID NO: 179904, SEQ ID NO: 179934, SEQ ID NO: 179957, SEQ ID NO: 179981, SEQ ID NO: 180013, SEQ ID NO: 180019, SEQ ID NO: 180036, SEQ ID NO: 180077, SEQ ID NO: 180086, SEQ ID NO: 180167, SEQ ID NO: 180257, SEQ ID NO: 180259, SEQ ID NO: 180271, SEQ ID NO: 180291, SEQ ID NO: 180327, SEQ ID NO: 180348, SEQ ID NO: 180378, SEQ ID NO: 180396, SEQ ID NO: 180430, SEQ ID NO: 180452, SEQ ID NO: 180458, SEQ ID NO: 180481, SEQ ID NO: 180489, SEQ ID NO: 180492, SEQ ID NO: 180528, SEQ ID NO: 180551, SEQ ID NO: 180567, SEQ ID NO: 180577, SEQ ID NO: 180597, SEQ ID NO: 180622, SEQ ID NO: 180683, SEQ ID NO: 180694, SEQ ID NOs: 180720 to 180721, SEQ ID NO: 180772, SEQ ID NO: 180799, SEQ ID NO: 180823, SEQ ID NO: 180843, SEQ ID NO: 180848, SEQ ID NO: 180858, SEQ ID NO: 180866, SEQ ID NO: 180879, SEQ ID NO: 180977, SEQ ID NOs: 181032 to 181033, SEQ ID NO: 181173, SEQ ID NO: 181204, SEQ ID NO: 181259, SEQ ID NO: 181406, SEQ ID NO: 181630, SEQ ID NO: 181685, SEQ ID NO: 181792, SEQ ID NO: 181963, SEQ ID NO: 181984, SEQ ID NOs: 182157 to 182159, SEQ ID NO: 182471, and SEQ ID NOs: 182574 to 197896. In some embodiments, any one of the peptides in the TYRP2 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 166476 to 166477, SEQ ID NO: 166486, SEQ ID NO: 166513, SEQ ID NO: 166591, SEQ ID NO: 166606, SEQ ID NO: 166629, SEQ ID NO: 166641, SEQ ID NO: 166667, SEQ ID NOs: 166678 to 166679, SEQ ID NO: 166795, SEQ ID NO: 166799, SEQ ID NO: 166834, SEQ ID NO: 166854, SEQ ID NO: 166909, SEQ ID NO: 166912, SEQ ID NO: 166942, SEQ ID NOs: 166991 to 166992, SEQ ID NO: 167062, SEQ ID NO: 167067, SEQ ID NOs: 167073 to 167074, SEQ ID NO: 167106, SEQ ID NO: 167118, SEQ ID NO: 167151, SEQ ID NO: 167177, SEQ ID NO: 167241, SEQ ID NO: 167271, SEQ ID NO: 167395, SEQ ID NO: 167491, SEQ ID NO: 167505, SEQ ID NO: 167687, SEQ ID NO: 167736, SEQ ID NO: 167740, SEQ ID NO: 167743, SEQ ID NO: 167755, SEQ ID NO: 167810, SEQ ID NO: 167831, SEQ ID NO: 167837, SEQ ID NO: 167844, SEQ ID NOs: 167847 to 167848, SEQ ID NO: 167859, SEQ ID NO: 167880, SEQ ID NO: 167891, SEQ ID NO: 167897, SEQ ID NO: 167933, SEQ ID NO: 168094, SEQ ID NOs: 168111 to 168112, SEQ ID NO: 168132, SEQ ID NO: 168144, SEQ ID NO: 168167, SEQ ID NO: 168211, SEQ ID NO: 168252, SEQ ID NO: 168268, SEQ ID NO: 168343, SEQ ID NO: 168354, SEQ ID NO: 168376, SEQ ID NO: 168396, SEQ ID NO: 168410, SEQ ID NO: 168423, SEQ ID NO: 168460, SEQ ID NO: 168484, SEQ ID NO: 168496, SEQ ID NO: 168616, SEQ ID NO: 168626, SEQ ID NO: 168646, SEQ ID NO: 168660, SEQ ID NO: 168681, SEQ ID NO: 168703, SEQ ID NO: 168711, SEQ ID NO: 168725, SEQ ID NO: 168728, SEQ ID NO: 168760, SEQ ID NOs: 168792 to 168793, SEQ ID NO: 168815, SEQ ID NO: 168851, SEQ ID NO: 168863, SEQ ID NO: 168867, SEQ ID NO: 168871, SEQ ID NO: 168924, SEQ ID NO: 168927, SEQ ID NO: 168947, SEQ ID NO: 168974, SEQ ID NO: 169000, SEQ ID NO: 169024, SEQ ID NO: 169035, SEQ ID NO: 169112, SEQ ID NO: 169150, SEQ ID NO: 169187, SEQ ID NO: 169233, SEQ ID NO: 169240, SEQ ID NO: 169247, SEQ ID NO: 169275, SEQ ID NO: 169375, SEQ ID NO: 169403, SEQ ID NO: 169428, SEQ ID NO: 169460, SEQ ID NO: 169474, SEQ ID NO: 169500, SEQ ID NO: 169530, SEQ ID NO: 169542, SEQ ID NO: 169546, SEQ ID NO: 169548, SEQ ID NO: 169553, SEQ ID NO: 169555, SEQ ID NO: 169563, SEQ ID NO: 169565, SEQ ID NO: 169578, SEQ ID NO: 169584, SEQ ID NO: 169605, SEQ ID NO: 169641, SEQ ID NO: 169665, SEQ ID NO: 169673, SEQ ID NO: 169682, SEQ ID NO: 169700, SEQ ID NO: 169704, SEQ ID NO: 169740, SEQ ID NO: 169768, SEQ ID NO: 169850, SEQ ID NO: 169858, SEQ ID NO: 169867, SEQ ID NO: 169871, SEQ ID NO: 169886, SEQ ID NO: 169915, SEQ ID NO: 169966, SEQ ID NO: 170057, SEQ ID NO: 170061, SEQ ID NO: 170081, SEQ ID NOs: 170178 to 170179, SEQ ID NO: 170261, SEQ ID NO: 170268, SEQ ID NO: 170278, SEQ ID NO: 170290, SEQ ID NO: 170320, SEQ ID NO: 170329, SEQ ID NO: 170390, SEQ ID NO: 170443, SEQ ID NO: 170488, SEQ ID NO: 170543, SEQ ID NO: 170574, SEQ ID NO: 170679, SEQ ID NO: 170704, SEQ ID NOs: 170706 to 170707, SEQ ID NO: 170735, SEQ ID NO: 170754, SEQ ID NO: 170771, SEQ ID NOs: 170809 to 170810, SEQ ID NO: 170834, SEQ ID NO: 170847, SEQ ID NO: 170876, SEQ ID NOs: 170902 to 170903, SEQ ID NO: 170964, SEQ ID NO: 170968, SEQ ID NO: 170970, SEQ ID NO: 170976, SEQ ID NO: 170981, SEQ ID NO: 171011, SEQ ID NO: 171029, SEQ ID NO: 171080, SEQ ID NO: 171085, SEQ ID NO: 171091, SEQ ID NO: 171174, SEQ ID NO: 171182, SEQ ID NO: 171212, SEQ ID NO: 171229, SEQ ID NO: 171242, SEQ ID NO: 171256, SEQ ID NO: 171260, SEQ ID NO: 171263, SEQ ID NO: 171291, SEQ ID NO: 171329, SEQ ID NO: 171334, SEQ ID NO: 171340, SEQ ID NO: 171406, SEQ ID NO: 171412, SEQ ID NO: 171428, SEQ ID NO: 171462, SEQ ID NO: 171474, SEQ ID NO: 171485, SEQ ID NO: 171490, SEQ ID NO: 171526, SEQ ID NO: 171536, SEQ ID NO: 171550, SEQ ID NO: 171581, SEQ ID NO: 171608, SEQ ID NO: 171625, SEQ ID NO: 171655, SEQ ID NO: 171662, SEQ ID NO: 171709, SEQ ID NO: 171732, SEQ ID NO: 171746, SEQ ID NO: 171752, SEQ ID NO: 171768, SEQ ID NO: 171786, SEQ ID NO: 171788, SEQ ID NO: 171814, SEQ ID NO: 171855, SEQ ID NO: 171863, SEQ ID NO: 171980, SEQ ID NO: 172007, SEQ ID NO: 172010, SEQ ID NO: 172062, SEQ ID NO: 172161, SEQ ID NO: 172181, SEQ ID NO: 172203, SEQ ID NO: 172225, SEQ ID NO: 172231, SEQ ID NO: 172255, SEQ ID NO: 172272, SEQ ID NO: 172276, SEQ ID NO: 172294, SEQ ID NO: 172348, SEQ ID NO: 172372, SEQ ID NO: 172375, SEQ ID NO: 172378, SEQ ID NO: 172387, SEQ ID NO: 172389, SEQ ID NO: 172421, SEQ ID NOs: 172439 to 172440, SEQ ID NO: 172484, SEQ ID NO: 172495, SEQ ID NO: 172563, SEQ ID NO: 172594, SEQ ID NO: 172660, SEQ ID NO: 172693, SEQ ID NO: 172702, SEQ ID NO: 172704, SEQ ID NO: 172709, SEQ ID NO: 172717, SEQ ID NO: 172726, SEQ ID NO: 172742, SEQ ID NO: 172793, SEQ ID NO: 172801, SEQ ID NO: 172816, SEQ ID NO: 172849, SEQ ID NO: 172862, SEQ ID NO: 172900, SEQ ID NO: 172907, SEQ ID NO: 172919, SEQ ID NO: 172926, SEQ ID NO: 172990, SEQ ID NO: 172994, SEQ ID NO: 172999, SEQ ID NO: 173004, SEQ ID NO: 173007, SEQ ID NO: 173084, SEQ ID NO: 173202, SEQ ID NO: 173206, SEQ ID NO: 173284, SEQ ID NO: 173288, SEQ ID NO: 173318, SEQ ID NO: 173321, SEQ ID NO: 173412, SEQ ID NO: 173433, SEQ ID NO: 173452, SEQ ID NO: 173467, SEQ ID NOs: 173469 to 173470, SEQ ID NO: 173494, SEQ ID NO: 173497, SEQ ID NO: 173516, SEQ ID NO: 173611, SEQ ID NO: 173633, SEQ ID NO: 173713, SEQ ID NO: 173726, SEQ ID NO: 173762, SEQ ID NO: 173792, SEQ ID NO: 173837, SEQ ID NO: 173849, SEQ ID NO: 173858, SEQ ID NO: 173864, SEQ ID NO: 173884, SEQ ID NO: 173918, SEQ ID NO: 173923, SEQ ID NO: 173929, SEQ ID NO: 173958, SEQ ID NO: 173993, SEQ ID NO: 174020, SEQ ID NO: 174026, SEQ ID NO: 174044, SEQ ID NO: 174047, SEQ ID NO: 174110, SEQ ID NO: 174116, SEQ ID NO: 174161, SEQ ID NO: 174164, SEQ ID NO: 174168, SEQ ID NO: 174180, SEQ ID NO: 174190, SEQ ID NO: 174210, SEQ ID NO: 174228, SEQ ID NO: 174260, SEQ ID NO: 174265, SEQ ID NO: 174277, SEQ ID NO: 174283, SEQ ID NO: 174301, SEQ ID NO: 174311, SEQ ID NO: 174316, SEQ ID NO: 174356, SEQ ID NO: 174387, SEQ ID NO: 174424, SEQ ID NO: 174452, SEQ ID NO: 174486, SEQ ID NO: 174491, SEQ ID NO: 174507, SEQ ID NO: 174510, SEQ ID NO: 174595, SEQ ID NO: 174611, SEQ ID NO: 174633, SEQ ID NO: 174679, SEQ ID NO: 174702, SEQ ID NO: 174724, SEQ ID NO: 174747, SEQ ID NO: 174756, SEQ ID NO: 174779, SEQ ID NO: 174847, SEQ ID NO: 174880, SEQ ID NO: 174904, SEQ ID NO: 174956, SEQ ID NO: 174960, SEQ ID NO: 174978, SEQ ID NO: 175027, SEQ ID NO: 175063, SEQ ID NO: 175076, SEQ ID NO: 175129, SEQ ID NO: 175160, SEQ ID NO: 175175, SEQ ID NO: 175186, SEQ ID NO: 175191, SEQ ID NO: 175251, SEQ ID NO: 175269, SEQ ID NO: 175292, SEQ ID NO: 175295, SEQ ID NO: 175300, SEQ ID NO: 175416, SEQ ID NO: 175423, SEQ ID NO: 175506, SEQ ID NO: 175541, SEQ ID NO: 175557, SEQ ID NO: 175585, SEQ ID NO: 175625, SEQ ID NO: 175649, SEQ ID NO: 175671, SEQ ID NOs: 175721 to 175722, SEQ ID NO: 175820, SEQ ID NO: 175886, SEQ ID NO: 175902, SEQ ID NO: 175951, SEQ ID NOs: 175960 to 175961, SEQ ID NO: 175968, SEQ ID NO: 175975, SEQ ID NO: 175993, SEQ ID NO: 176018, SEQ ID NO: 176041, SEQ ID NO: 176051, SEQ ID NO: 176112, SEQ ID NO: 176118, SEQ ID NO: 176149, SEQ ID NO: 176179, SEQ ID NO: 176248, SEQ ID NO: 176306, SEQ ID NO: 176309, SEQ ID NO: 176312, SEQ ID NO: 176335, SEQ ID NO: 176338, SEQ ID NO: 176355, SEQ ID NO: 176369, SEQ ID NO: 176379, SEQ ID NO: 176452, SEQ ID NO: 176466, SEQ ID NO: 176503, SEQ ID NO: 176548, SEQ ID NO: 176560, SEQ ID NO: 176611, SEQ ID NO: 176621, SEQ ID NO: 176639, SEQ ID NO: 176693, SEQ ID NO: 176700, SEQ ID NO: 176713, SEQ ID NO: 176764, SEQ ID NOs: 176795 to 176796, SEQ ID NO: 176806, SEQ ID NO: 176815, SEQ ID NO: 176953, SEQ ID NO: 176958, SEQ ID NO: 176969, SEQ ID NO: 176980, SEQ ID NO: 176991, SEQ ID NO: 177016, SEQ ID NO: 177033, SEQ ID NO: 177044, SEQ ID NO: 177061, SEQ ID NO: 177065, SEQ ID NO: 177080, SEQ ID NO: 177088, SEQ ID NO: 177102, SEQ ID NO: 177119, SEQ ID NO: 177343, SEQ ID NO: 177358, SEQ ID NO: 177390, SEQ ID NO: 177430, SEQ ID NO: 177437, SEQ ID NO: 177465, SEQ ID NOs: 177482 to 177483, SEQ ID NO: 177492, SEQ ID NO: 177495, SEQ ID NO: 177522, SEQ ID NO: 177585, SEQ ID NO: 177604, SEQ ID NO: 177611, SEQ ID NO: 177664, SEQ ID NO: 177669, SEQ ID NO: 177701, SEQ ID NO: 177707, SEQ ID NO: 177710, SEQ ID NO: 177712, SEQ ID NO: 177714, SEQ ID NO: 177734, SEQ ID NO: 177808, SEQ ID NO: 177841, SEQ ID NO: 177848, SEQ ID NO: 177892, SEQ ID NO: 177918, SEQ ID NO: 177958, SEQ ID NOs: 177989 to 177990, SEQ ID NO: 178023, SEQ ID NO: 178032, SEQ ID NO: 178035, SEQ ID NO: 178039, SEQ ID NO: 178122, SEQ ID NO: 178161, SEQ ID NO: 178195, SEQ ID NO: 178208, SEQ ID NO: 178244, SEQ ID NO: 178272, SEQ ID NO: 178293, SEQ ID NO: 178310, SEQ ID NO: 178338, SEQ ID NO: 178353, SEQ ID NO: 178385, SEQ ID NO: 178399, SEQ ID NO: 178477, SEQ ID NO: 178519, SEQ ID NO: 178568, SEQ ID NO: 178587, SEQ ID NO: 178600, SEQ ID NO: 178612, SEQ ID NO: 178615, SEQ ID NO: 178651, SEQ ID NO: 178726, SEQ ID NO: 178740, SEQ ID NO: 178743, SEQ ID NO: 178750, SEQ ID NO: 178821, SEQ ID NO: 178886, SEQ ID NO: 178895, SEQ ID NO: 178911, SEQ ID NO: 178942, SEQ ID NO: 178946, SEQ ID NO: 178948, SEQ ID NO: 178966, SEQ ID NO: 179020, SEQ ID NO: 179031, SEQ ID NO: 179034, SEQ ID NO: 179130, SEQ ID NO: 179134, SEQ ID NO: 179151, SEQ ID NO: 179154, SEQ ID NO: 179224, SEQ ID NO: 179257, SEQ ID NO: 179387, SEQ ID NO: 179404, SEQ ID NO: 179444, SEQ ID NO: 179455, SEQ ID NO: 179462, SEQ ID NO: 179483, SEQ ID NO: 179544, SEQ ID NO: 179586, SEQ ID NO: 179600, SEQ ID NO: 179612, SEQ ID NO: 179619, SEQ ID NO: 179632, SEQ ID NO: 179677, SEQ ID NO: 179695, SEQ ID NO: 179697, SEQ ID NO: 179760, SEQ ID NO: 179863, SEQ ID NO: 179898, SEQ ID NO: 179904, SEQ ID NO: 179934, SEQ ID NO: 179957, SEQ ID NO: 179981, SEQ ID NO: 180013, SEQ ID NO: 180019, SEQ ID NO: 180036, SEQ ID NO: 180077, SEQ ID NO: 180086, SEQ ID NO: 180167, SEQ ID NO: 180257, SEQ ID NO: 180259, SEQ ID NO: 180271, SEQ ID NO: 180291, SEQ ID NO: 180327, SEQ ID NO: 180348, SEQ ID NO: 180378, SEQ ID NO: 180396, SEQ ID NO: 180430, SEQ ID NO: 180452, SEQ ID NO: 180458, SEQ ID NO: 180481, SEQ ID NO: 180489, SEQ ID NO: 180492, SEQ ID NO: 180528, SEQ ID NO: 180551, SEQ ID NO: 180567, SEQ ID NO: 180577, SEQ ID NO: 180597, SEQ ID NO: 180622, SEQ ID NO: 180683, SEQ ID NO: 180694, SEQ ID NOs: 180720 to 180721, SEQ ID NO: 180772, SEQ ID NO: 180799, SEQ ID NO: 180823, SEQ ID NO: 180843, SEQ ID NO: 180848, SEQ ID NO: 180858, SEQ ID NO: 180866, SEQ ID NO: 180879, SEQ ID NO: 180977, SEQ ID NOs: 181032 to 181033, SEQ ID NO: 181173, SEQ ID NO: 181204, SEQ ID NO: 181259, SEQ ID NO: 181406, SEQ ID NO: 181630, SEQ ID NO: 181685, SEQ ID NO: 181792, SEQ ID NO: 181963, SEQ ID NO: 181984, SEQ ID NOs: 182157 to 182159, SEQ ID NO: 182471, or SEQ ID NOs: 182574 to 197896.

In some embodiments, the amino acid sequence for a MHC class I peptide vaccine for the TYRP2 protein comprises two or more of the SEQ ID NO: 166476, SEQ ID NO: 167118, SEQ ID NO: 169740, SEQ ID NO: 173412, SEQ ID NO: 179404, and SEQ ID NOs: 182574 to 182654. In some embodiments, any one of the peptides in the TYRP2 vaccine comprise an amino acid sequence 80, 81, 82, 83, 84, 85, 86, 87, 88, 89, 90, 91, 92, 93, 94, 95, 96, 97, 98 or 99% identical to SEQ ID NO: 166476, SEQ ID NO: 167118, SEQ ID NO: 169740, SEQ ID NO: 173412, SEQ ID NO: 179404, or SEQ ID NOs: 182574 to 182654.

In some embodiments, the amino acid sequence for a MHC class I peptide vaccine for the TYRP2 protein comprises two or more of the SEQ ID NOs: 166476 to 166477, SEQ ID NO: 166486, SEQ ID NO: 166513, SEQ ID NO: 166591, SEQ ID NO: 166606, SEQ ID NO: 166629, SEQ ID NO: 166641, SEQ ID NO: 166667, SEQ ID NOs: 166678 to 166679, SEQ ID NO: 166795, SEQ ID NO: 166799, SEQ ID NO: 166834, SEQ ID NO: 166854, SEQ ID NO: 166909, SEQ ID NO: 166912, SEQ ID NO: 166942, SEQ ID NOs: 166991 to 166992, SEQ ID NO: 167062, SEQ ID NO: 167067, SEQ ID NOs: 167073 to 167074, SEQ ID NO: 167106, SEQ ID NO: 167118, SEQ ID NO: 167151, SEQ ID NO: 167177, SEQ ID NO: 167241, SEQ ID NO: 167271, SEQ ID NO: 167395, SEQ ID NO: 167491, SEQ ID NO: 167505, SEQ ID NO: 167687, SEQ ID NO: 167736, SEQ ID NO: 167740, SEQ ID NO: 167743, SEQ ID NO: 167755, SEQ ID NO: 167810, SEQ ID NO: 167831, SEQ ID NO: 167837, SEQ ID NO: 167844, SEQ ID NOs: 167847 to 167848, SEQ ID NO: 167859, SEQ ID NO: 167880, SEQ ID NO: 167891, SEQ ID NO: 167897, SEQ ID NO: 167933, SEQ ID NO: 168094, SEQ ID NOs: 168111 to 168112, SEQ ID NO: 168132, SEQ ID NO: 168144, SEQ ID NO: 168167, SEQ ID NO: 168211, SEQ ID NO: 168252, SEQ ID NO: 168268, SEQ ID NO: 168343, SEQ ID NO: 168354, SEQ ID NO: 168376, SEQ ID NO: 168396, SEQ ID NO: 168410, SEQ ID NO: 168423, SEQ ID NO: 168460, SEQ ID NO: 168484, SEQ ID NO: 168496, SEQ ID NO: 168616, SEQ ID NO: 168626, SEQ ID NO: 168646, SEQ ID NO: 168660, SEQ ID NO: 168681, SEQ ID NO: 168703, SEQ ID NO: 168711, SEQ ID NO: 168725, SEQ ID NO: 168728, SEQ ID NO: 168760, SEQ ID NOs: 168792 to 168793, SEQ ID NO: 168815, SEQ ID NO: 168851, SEQ ID NO: 168863, SEQ ID NO: 168867, SEQ ID NO: 168871, SEQ ID NO: 168924, SEQ ID NO: 168927, SEQ ID NO: 168947, SEQ ID NO: 168974, SEQ ID NO: 169000, SEQ ID NO: 169024, SEQ ID NO: 169035, SEQ ID NO: 169112, SEQ ID NO: 169150, SEQ ID NO: 169187, SEQ ID NO: 169233, SEQ ID NO: 169240, SEQ ID NO: 169247, SEQ ID NO: 169275, SEQ ID NO: 169375, SEQ ID NO: 169403, SEQ ID NO: 169428, SEQ ID NO: 169460, SEQ ID NO: 169474, SEQ ID NO: 169500, SEQ ID NO: 169530, SEQ ID NO: 169542, SEQ ID NO: 169546, SEQ ID NO: 169548, SEQ ID NO: 169553, SEQ ID NO: 169555, SEQ ID NO: 169563, SEQ ID NO: 169565, SEQ ID NO: 169578, SEQ ID NO: 169584, SEQ ID NO: 169605, SEQ ID NO: 169641, SEQ ID NO: 169665, SEQ ID NO: 169673, SEQ ID NO: 169682, SEQ ID NO: 169700, SEQ ID NO: 169704, SEQ ID NO: 169740, SEQ ID NO: 169768, SEQ ID NO: 169850, SEQ ID NO: 169858, SEQ ID NO: 169867, SEQ ID NO: 169871, SEQ ID NO: 169886, SEQ ID NO: 169915, SEQ ID NO: 169966, SEQ ID NO: 170057, SEQ ID NO: 170061, SEQ ID NO: 170081, SEQ ID NOs: 170178 to 170179, SEQ ID NO: 170261, SEQ ID NO: 170268, SEQ ID NO: 170278, SEQ ID NO: 170290, SEQ ID NO: 170320, SEQ ID NO: 170329, SEQ ID NO: 170390, SEQ ID NO: 170443, SEQ ID NO: 170488, SEQ ID NO: 170543, SEQ ID NO: 170574, SEQ ID NO: 170679, SEQ ID NO: 170704, SEQ ID NOs: 170706 to 170707, SEQ ID NO: 170735, SEQ ID NO: 170754, SEQ ID NO: 170771, SEQ ID NOs: 170809 to 170810, SEQ ID NO: 170834, SEQ ID NO: 170847, SEQ ID NO: 170876, SEQ ID NOs: 170902 to 170903, SEQ ID NO: 170964, SEQ ID NO: 170968, SEQ ID NO: 170970, SEQ ID NO: 170976, SEQ ID NO: 170981, SEQ ID NO: 171011, SEQ ID NO: 171029, SEQ ID NO: 171080, SEQ ID NO: 171085, SEQ ID NO: 171091, SEQ ID NO: 171174, SEQ ID NO: 171182, SEQ ID NO: 171212, SEQ ID NO: 171229, SEQ ID NO: 171242, SEQ ID NO: 171256, SEQ ID NO: 171260, SEQ ID NO: 171263, SEQ ID NO: 171291, SEQ ID NO: 171329, SEQ ID NO: 171334, SEQ ID NO: 171340, SEQ ID NO: 171406, SEQ ID NO: 171412, SEQ ID NO: 171428, SEQ ID NO: 171462, SEQ ID NO: 171474, SEQ ID NO: 171485, SEQ ID NO: 171490, SEQ ID NO: 171526, SEQ ID NO: 171536, SEQ ID NO: 171550, SEQ ID NO: 171581, SEQ ID NO: 171608, SEQ ID NO: 171625, SEQ ID NO: 171655, SEQ ID NO: 171662, SEQ ID NO: 171709, SEQ ID NO: 171732, SEQ ID NO: 171746, SEQ ID NO: 171752, SEQ ID NO: 171768, SEQ ID NO: 171786, SEQ ID NO: 171788, SEQ ID NO: 171814, SEQ ID NO: 171855, SEQ ID NO: 171863, SEQ ID NO: 171980, SEQ ID NO: 172007, SEQ ID NO: 172010, SEQ ID NO: 172062, SEQ ID NO: 172161, SEQ ID NO: 172181, SEQ ID NO: 172203, SEQ ID NO: 172225, SEQ ID NO: 172231, SEQ ID NO: 172255, SEQ ID NO: 172272, SEQ ID NO: 172276, SEQ ID NO: 172294, SEQ ID NO: 172348, SEQ ID NO: 172372, SEQ ID NO: 172375, SEQ ID NO: 172378, SEQ ID NO: 172387, SEQ ID NO: 172389, SEQ ID NO: 172421, SEQ ID NOs: 172439 to 172440, SEQ ID NO: 172484, SEQ ID NO: 172495, SEQ ID NO: 172563, SEQ ID NO: 172594, SEQ ID NO: 172660, SEQ ID NO: 172693, SEQ ID NO: 172702, SEQ ID NO: 172704, SEQ ID NO: 172709, SEQ ID NO: 172717, SEQ ID NO: 172726, SEQ ID NO: 172742, SEQ ID NO: 172793, SEQ ID NO: 172801, SEQ ID NO: 172816, SEQ ID NO: 172849, SEQ ID NO: 172862, SEQ ID NO: 172900, SEQ ID NO: 172907, SEQ ID NO: 172919, SEQ ID NO: 172926, SEQ ID NO: 172990, SEQ ID NO: 172994, SEQ ID NO: 172999, SEQ ID NO: 173004, SEQ ID NO: 173007, SEQ ID NO: 173084, SEQ ID NO: 173202, SEQ ID NO: 173206, SEQ ID NO: 173284, SEQ ID NO: 173288, SEQ ID NO: 173318, SEQ ID NO: 173321, SEQ ID NO: 173412, SEQ ID NO: 173433, SEQ ID NO: 173452, SEQ ID NO: 173467, SEQ ID NOs: 173469 to 173470, SEQ ID NO: 173494, SEQ ID NO: 173497, SEQ ID NO: 173516, SEQ ID NO: 173611, SEQ ID NO: 173633, SEQ ID NO: 173713, SEQ ID NO: 173726, SEQ ID NO: 173762, SEQ ID NO: 173792, SEQ ID NO: 173837, SEQ ID NO: 173849, SEQ ID NO: 173858, SEQ ID NO: 173864, SEQ ID NO: 173884, SEQ ID NO: 173918, SEQ ID NO: 173923, SEQ ID NO: 173929, SEQ ID NO: 173958, SEQ ID NO: 173993, SEQ ID NO: 174020, SEQ ID NO: 174026, SEQ ID NO: 174044, SEQ ID NO: 174047, SEQ ID NO: 174110, SEQ ID NO: 174116, SEQ ID NO: 174161, SEQ ID NO: 174164, SEQ ID NO: 174168, SEQ ID NO: 174180, SEQ ID NO: 174190, SEQ ID NO: 174210, SEQ ID NO: 174228, SEQ ID NO: 174260, SEQ ID NO: 174265, SEQ ID NO: 174277, SEQ ID NO: 174283, SEQ ID NO: 174301, SEQ ID NO: 174311, SEQ ID NO: 174316, SEQ ID NO: 174356, SEQ ID NO: 174387, SEQ ID NO: 174424, SEQ ID NO: 174452, SEQ ID NO: 174486, SEQ ID NO: 174491, SEQ ID NO: 174507, SEQ ID NO: 174510, SEQ ID NO: 174595, SEQ ID NO: 174611, SEQ ID NO: 174633, SEQ ID NO: 174679, SEQ ID NO: 174702, SEQ ID NO: 174724, SEQ ID NO: 174747, SEQ ID NO: 174756, SEQ ID NO: 174779, SEQ ID NO: 174847, SEQ ID NO: 174880, SEQ ID NO: 174904, SEQ ID NO: 174956, SEQ ID NO: 174960, SEQ ID NO: 174978, SEQ ID NO: 175027, SEQ ID NO: 175063, SEQ ID NO: 175076, SEQ ID NO: 175129, SEQ ID NO: 175160, SEQ ID NO: 175175, SEQ ID NO: 175186, SEQ ID NO: 175191, SEQ ID NO: 175251, SEQ ID NO: 175269, SEQ ID NO: 175292, SEQ ID NO: 175295, SEQ ID NO: 175300, SEQ ID NO: 175416, SEQ ID NO: 175423, SEQ ID NO: 175506, SEQ ID NO: 175541, SEQ ID NO: 175557, SEQ ID NO: 175585, SEQ ID NO: 175625, SEQ ID NO: 175649, SEQ ID NO: 175671, SEQ ID NOs: 175721 to 175722, SEQ ID NO: 175820, SEQ ID NO: 175886, SEQ ID NO: 175902, SEQ ID NO: 175951, SEQ ID NOs: 175960 to 175961, SEQ ID NO: 175968, SEQ ID NO: 175975, SEQ ID NO: 175993, SEQ ID NO: 176018, SEQ ID NO: 176041, SEQ ID NO: 176051, SEQ ID NO: 176112, SEQ ID NO: 176118, SEQ ID NO: 176149, SEQ ID NO: 176179, SEQ ID NO: 176248, SEQ ID NO: 176306, SEQ ID NO: 176309, SEQ ID NO: 176312, SEQ ID NO: 176335, SEQ ID NO: 176338, SEQ ID NO: 176355, SEQ ID NO: 176369, SEQ ID NO: 176379, SEQ ID NO: 176452, SEQ ID NO: 176466, SEQ ID NO: 176503, SEQ ID NO: 176548, SEQ ID NO: 176560, SEQ ID NO: 176611, SEQ ID NO: 176621, SEQ ID NO: 176639, SEQ ID NO: 176693, SEQ ID NO: 176700, SEQ ID NO: 176713, SEQ ID NO: 176764, SEQ ID NOs: 176795 to 176796, SEQ ID NO: 176806, SEQ ID NO: 176815, SEQ ID NO: 176953, SEQ ID NO: 176958, SEQ ID NO: 176969, SEQ ID NO: 176980, SEQ ID NO: 176991, SEQ ID NO: 177016, SEQ ID NO: 177033, SEQ ID NO: 177044, SEQ ID NO: 177061, SEQ ID NO: 177065, SEQ ID NO: 177080, SEQ ID NO: 177088, SEQ ID NO: 177102, SEQ ID NO: 177119, SEQ ID NO: 177343, SEQ ID NO: 177358, SEQ ID NO: 177390, SEQ ID NO: 177430, SEQ ID NO: 177437, SEQ ID NO: 177465, SEQ ID NOs: 177482 to 177483, SEQ ID NO: 177492, SEQ ID NO: 177495, SEQ ID NO: 177522, SEQ ID NO: 177585, SEQ ID NO: 177604, SEQ ID NO: 177611, SEQ ID NO: 177664, SEQ ID NO: 177669, SEQ ID NO: 177701, SEQ ID NO: 177707, SEQ ID NO: 177710, SEQ ID NO: 177712, SEQ ID NO: 177714, SEQ ID NO: 177734, SEQ ID NO: 177808, SEQ ID NO: 177841, SEQ ID NO: 177848, SEQ ID NO: 177892, SEQ ID NO: 177918, SEQ ID NO: 177958, SEQ ID NOs: 177989 to 177990, SEQ ID NO: 178023, SEQ ID NO: 178032, SEQ ID NO: 178035, SEQ ID NO: 178039, SEQ ID NO: 178122, SEQ ID NO: 178161, SEQ ID NO: 178195, SEQ ID NO: 178208, SEQ ID NO: 178244, SEQ ID NO: 178272, SEQ ID NO: 178293, SEQ ID NO: 178310, SEQ ID NO: 178338, SEQ ID NO: 178353, SEQ ID NO: 178385, SEQ ID NO: 178399, SEQ ID NO: 178477, SEQ ID NO: 178519, SEQ ID NO: 178568, SEQ ID NO: 178587, SEQ ID NO: 178600, SEQ ID NO: 178612, SEQ ID NO: 178615, SEQ ID NO: 178651, SEQ ID NO: 178726, SEQ ID NO: 178740, SEQ ID NO: 178743, SEQ ID NO: 178750, SEQ ID NO: 178821, SEQ ID NO: 178886, SEQ ID NO: 178895, SEQ ID NO: 178911, SEQ ID NO: 178942, SEQ ID NO: 178946, SEQ ID NO: 178948, SEQ ID NO: 178966, SEQ ID NO: 179020, SEQ ID NO: 179031, SEQ ID NO: 179034, SEQ ID NO: 179130, SEQ ID NO: 179134, SEQ ID NO: 179151, SEQ ID NO: 179154, SEQ ID NO: 179224, SEQ ID NO: 179257, SEQ ID NO: 179387, SEQ ID NO: 179404, SEQ ID NO: 179444, SEQ ID NO: 179455, SEQ ID NO: 179462, SEQ ID NO: 179483, SEQ ID NO: 179544, SEQ ID NO: 179586, SEQ ID NO: 179600, SEQ ID NO: 179612, SEQ ID NO: 179619, SEQ ID NO: 179632, SEQ ID NO: 179677, SEQ ID NO: 179695, SEQ ID NO: 179697, SEQ ID NO: 179760, SEQ ID NO: 179863, SEQ ID NO: 179898, SEQ ID NO: 179904, SEQ ID NO: 179934, SEQ ID NO: 179957, SEQ ID NO: 179981, SEQ ID NO: 180013, SEQ ID NO: 180019, SEQ ID NO: 180036, SEQ ID NO: 180077, SEQ ID NO: 180086, SEQ ID NO: 180167, SEQ ID NO: 180257, SEQ ID NO: 180259, SEQ ID NO: 180271, SEQ ID NO: 180291, SEQ ID NO: 180327, SEQ ID NO: 180348, SEQ ID NO: 180378, SEQ ID NO: 180396, SEQ ID NO: 180430, SEQ ID NO: 180452, SEQ ID NO: 180458, SEQ ID NO: 180481, SEQ ID NO: 180489, SEQ ID NO: 180492, SEQ ID NO: 180528, SEQ ID NO: 180551, SEQ ID NO: 180567, SEQ ID NO: 180577, SEQ ID NO: 180597, SEQ ID NO: 180622, SEQ ID NO: 180683, SEQ ID NO: 180694, SEQ ID NOs: 180720 to 180721, SEQ ID NO: 180772, SEQ ID NO: 180799, SEQ ID NO: 180823, SEQ ID NO: 180843, SEQ ID NO: 180848, SEQ ID NO: 180858, SEQ ID NO: 180866, SEQ ID NO: 180879, SEQ ID NO: 180977, SEQ ID NOs: 181032 to 181033, SEQ ID NO: 181173, SEQ ID NO: 181204, SEQ ID NO: 181259, SEQ ID NO: 181406, SEQ ID NO: 181630, SEQ ID NO: 181685, SEQ ID NO: 181792, SEQ ID NO: 181963, SEQ ID NO: 181984, SEQ ID NOs: 182157 to 182159, SEQ ID NO: 182471, and SEQ ID NOs: 182574 to 197896. In some embodiments, any one of the peptides in the TYRP2 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 166476 to 166477, SEQ ID NO: 166486, SEQ ID NO: 166513, SEQ ID NO: 166591, SEQ ID NO: 166606, SEQ ID NO: 166629, SEQ ID NO: 166641, SEQ ID NO: 166667, SEQ ID NOs: 166678 to 166679, SEQ ID NO: 166795, SEQ ID NO: 166799, SEQ ID NO: 166834, SEQ ID NO: 166854, SEQ ID NO: 166909, SEQ ID NO: 166912, SEQ ID NO: 166942, SEQ ID NOs: 166991 to 166992, SEQ ID NO: 167062, SEQ ID NO: 167067, SEQ ID NOs: 167073 to 167074, SEQ ID NO: 167106, SEQ ID NO: 167118, SEQ ID NO: 167151, SEQ ID NO: 167177, SEQ ID NO: 167241, SEQ ID NO: 167271, SEQ ID NO: 167395, SEQ ID NO: 167491, SEQ ID NO: 167505, SEQ ID NO: 167687, SEQ ID NO: 167736, SEQ ID NO: 167740, SEQ ID NO: 167743, SEQ ID NO: 167755, SEQ ID NO: 167810, SEQ ID NO: 167831, SEQ ID NO: 167837, SEQ ID NO: 167844, SEQ ID NOs: 167847 to 167848, SEQ ID NO: 167859, SEQ ID NO: 167880, SEQ ID NO: 167891, SEQ ID NO: 167897, SEQ ID NO: 167933, SEQ ID NO: 168094, SEQ ID NOs: 168111 to 168112, SEQ ID NO: 168132, SEQ ID NO: 168144, SEQ ID NO: 168167, SEQ ID NO: 168211, SEQ ID NO: 168252, SEQ ID NO: 168268, SEQ ID NO: 168343, SEQ ID NO: 168354, SEQ ID NO: 168376, SEQ ID NO: 168396, SEQ ID NO: 168410, SEQ ID NO: 168423, SEQ ID NO: 168460, SEQ ID NO: 168484, SEQ ID NO: 168496, SEQ ID NO: 168616, SEQ ID NO: 168626, SEQ ID NO: 168646, SEQ ID NO: 168660, SEQ ID NO: 168681, SEQ ID NO: 168703, SEQ ID NO: 168711, SEQ ID NO: 168725, SEQ ID NO: 168728, SEQ ID NO: 168760, SEQ ID NOs: 168792 to 168793, SEQ ID NO: 168815, SEQ ID NO: 168851, SEQ ID NO: 168863, SEQ ID NO: 168867, SEQ ID NO: 168871, SEQ ID NO: 168924, SEQ ID NO: 168927, SEQ ID NO: 168947, SEQ ID NO: 168974, SEQ ID NO: 169000, SEQ ID NO: 169024, SEQ ID NO: 169035, SEQ ID NO: 169112, SEQ ID NO: 169150, SEQ ID NO: 169187, SEQ ID NO: 169233, SEQ ID NO: 169240, SEQ ID NO: 169247, SEQ ID NO: 169275, SEQ ID NO: 169375, SEQ ID NO: 169403, SEQ ID NO: 169428, SEQ ID NO: 169460, SEQ ID NO: 169474, SEQ ID NO: 169500, SEQ ID NO: 169530, SEQ ID NO: 169542, SEQ ID NO: 169546, SEQ ID NO: 169548, SEQ ID NO: 169553, SEQ ID NO: 169555, SEQ ID NO: 169563, SEQ ID NO: 169565, SEQ ID NO: 169578, SEQ ID NO: 169584, SEQ ID NO: 169605, SEQ ID NO: 169641, SEQ ID NO: 169665, SEQ ID NO: 169673, SEQ ID NO: 169682, SEQ ID NO: 169700, SEQ ID NO: 169704, SEQ ID NO: 169740, SEQ ID NO: 169768, SEQ ID NO: 169850, SEQ ID NO: 169858, SEQ ID NO: 169867, SEQ ID NO: 169871, SEQ ID NO: 169886, SEQ ID NO: 169915, SEQ ID NO: 169966, SEQ ID NO: 170057, SEQ ID NO: 170061, SEQ ID NO: 170081, SEQ ID NOs: 170178 to 170179, SEQ ID NO: 170261, SEQ ID NO: 170268, SEQ ID NO: 170278, SEQ ID NO: 170290, SEQ ID NO: 170320, SEQ ID NO: 170329, SEQ ID NO: 170390, SEQ ID NO: 170443, SEQ ID NO: 170488, SEQ ID NO: 170543, SEQ ID NO: 170574, SEQ ID NO: 170679, SEQ ID NO: 170704, SEQ ID NOs: 170706 to 170707, SEQ ID NO: 170735, SEQ ID NO: 170754, SEQ ID NO: 170771, SEQ ID NOs: 170809 to 170810, SEQ ID NO: 170834, SEQ ID NO: 170847, SEQ ID NO: 170876, SEQ ID NOs: 170902 to 170903, SEQ ID NO: 170964, SEQ ID NO: 170968, SEQ ID NO: 170970, SEQ ID NO: 170976, SEQ ID NO: 170981, SEQ ID NO: 171011, SEQ ID NO: 171029, SEQ ID NO: 171080, SEQ ID NO: 171085, SEQ ID NO: 171091, SEQ ID NO: 171174, SEQ ID NO: 171182, SEQ ID NO: 171212, SEQ ID NO: 171229, SEQ ID NO: 171242, SEQ ID NO: 171256, SEQ ID NO: 171260, SEQ ID NO: 171263, SEQ ID NO: 171291, SEQ ID NO: 171329, SEQ ID NO: 171334, SEQ ID NO: 171340, SEQ ID NO: 171406, SEQ ID NO: 171412, SEQ ID NO: 171428, SEQ ID NO: 171462, SEQ ID NO: 171474, SEQ ID NO: 171485, SEQ ID NO: 171490, SEQ ID NO: 171526, SEQ ID NO: 171536, SEQ ID NO: 171550, SEQ ID NO: 171581, SEQ ID NO: 171608, SEQ ID NO: 171625, SEQ ID NO: 171655, SEQ ID NO: 171662, SEQ ID NO: 171709, SEQ ID NO: 171732, SEQ ID NO: 171746, SEQ ID NO: 171752, SEQ ID NO: 171768, SEQ ID NO: 171786, SEQ ID NO: 171788, SEQ ID NO: 171814, SEQ ID NO: 171855, SEQ ID NO: 171863, SEQ ID NO: 171980, SEQ ID NO: 172007, SEQ ID NO: 172010, SEQ ID NO: 172062, SEQ ID NO: 172161, SEQ ID NO: 172181, SEQ ID NO: 172203, SEQ ID NO: 172225, SEQ ID NO: 172231, SEQ ID NO: 172255, SEQ ID NO: 172272, SEQ ID NO: 172276, SEQ ID NO: 172294, SEQ ID NO: 172348, SEQ ID NO: 172372, SEQ ID NO: 172375, SEQ ID NO: 172378, SEQ ID NO: 172387, SEQ ID NO: 172389, SEQ ID NO: 172421, SEQ ID NOs: 172439 to 172440, SEQ ID NO: 172484, SEQ ID NO: 172495, SEQ ID NO: 172563, SEQ ID NO: 172594, SEQ ID NO: 172660, SEQ ID NO: 172693, SEQ ID NO: 172702, SEQ ID NO: 172704, SEQ ID NO: 172709, SEQ ID NO: 172717, SEQ ID NO: 172726, SEQ ID NO: 172742, SEQ ID NO: 172793, SEQ ID NO: 172801, SEQ ID NO: 172816, SEQ ID NO: 172849, SEQ ID NO: 172862, SEQ ID NO: 172900, SEQ ID NO: 172907, SEQ ID NO: 172919, SEQ ID NO: 172926, SEQ ID NO: 172990, SEQ ID NO: 172994, SEQ ID NO: 172999, SEQ ID NO: 173004, SEQ ID NO: 173007, SEQ ID NO: 173084, SEQ ID NO: 173202, SEQ ID NO: 173206, SEQ ID NO: 173284, SEQ ID NO: 173288, SEQ ID NO: 173318, SEQ ID NO: 173321, SEQ ID NO: 173412, SEQ ID NO: 173433, SEQ ID NO: 173452, SEQ ID NO: 173467, SEQ ID NOs: 173469 to 173470, SEQ ID NO: 173494, SEQ ID NO: 173497, SEQ ID NO: 173516, SEQ ID NO: 173611, SEQ ID NO: 173633, SEQ ID NO: 173713, SEQ ID NO: 173726, SEQ ID NO: 173762, SEQ ID NO: 173792, SEQ ID NO: 173837, SEQ ID NO: 173849, SEQ ID NO: 173858, SEQ ID NO: 173864, SEQ ID NO: 173884, SEQ ID NO: 173918, SEQ ID NO: 173923, SEQ ID NO: 173929, SEQ ID NO: 173958, SEQ ID NO: 173993, SEQ ID NO: 174020, SEQ ID NO: 174026, SEQ ID NO: 174044, SEQ ID NO: 174047, SEQ ID NO: 174110, SEQ ID NO: 174116, SEQ ID NO: 174161, SEQ ID NO: 174164, SEQ ID NO: 174168, SEQ ID NO: 174180, SEQ ID NO: 174190, SEQ ID NO: 174210, SEQ ID NO: 174228, SEQ ID NO: 174260, SEQ ID NO: 174265, SEQ ID NO: 174277, SEQ ID NO: 174283, SEQ ID NO: 174301, SEQ ID NO: 174311, SEQ ID NO: 174316, SEQ ID NO: 174356, SEQ ID NO: 174387, SEQ ID NO: 174424, SEQ ID NO: 174452, SEQ ID NO: 174486, SEQ ID NO: 174491, SEQ ID NO: 174507, SEQ ID NO: 174510, SEQ ID NO: 174595, SEQ ID NO: 174611, SEQ ID NO: 174633, SEQ ID NO: 174679, SEQ ID NO: 174702, SEQ ID NO: 174724, SEQ ID NO: 174747, SEQ ID NO: 174756, SEQ ID NO: 174779, SEQ ID NO: 174847, SEQ ID NO: 174880, SEQ ID NO: 174904, SEQ ID NO: 174956, SEQ ID NO: 174960, SEQ ID NO: 174978, SEQ ID NO: 175027, SEQ ID NO: 175063, SEQ ID NO: 175076, SEQ ID NO: 175129, SEQ ID NO: 175160, SEQ ID NO: 175175, SEQ ID NO: 175186, SEQ ID NO: 175191, SEQ ID NO: 175251, SEQ ID NO: 175269, SEQ ID NO: 175292, SEQ ID NO: 175295, SEQ ID NO: 175300, SEQ ID NO: 175416, SEQ ID NO: 175423, SEQ ID NO: 175506, SEQ ID NO: 175541, SEQ ID NO: 175557, SEQ ID NO: 175585, SEQ ID NO: 175625, SEQ ID NO: 175649, SEQ ID NO: 175671, SEQ ID NOs: 175721 to 175722, SEQ ID NO: 175820, SEQ ID NO: 175886, SEQ ID NO: 175902, SEQ ID NO: 175951, SEQ ID NOs: 175960 to 175961, SEQ ID NO: 175968, SEQ ID NO: 175975, SEQ ID NO: 175993, SEQ ID NO: 176018, SEQ ID NO: 176041, SEQ ID NO: 176051, SEQ ID NO: 176112, SEQ ID NO: 176118, SEQ ID NO: 176149, SEQ ID NO: 176179, SEQ ID NO: 176248, SEQ ID NO: 176306, SEQ ID NO: 176309, SEQ ID NO: 176312, SEQ ID NO: 176335, SEQ ID NO: 176338, SEQ ID NO: 176355, SEQ ID NO: 176369, SEQ ID NO: 176379, SEQ ID NO: 176452, SEQ ID NO: 176466, SEQ ID NO: 176503, SEQ ID NO: 176548, SEQ ID NO: 176560, SEQ ID NO: 176611, SEQ ID NO: 176621, SEQ ID NO: 176639, SEQ ID NO: 176693, SEQ ID NO: 176700, SEQ ID NO: 176713, SEQ ID NO: 176764, SEQ ID NOs: 176795 to 176796, SEQ ID NO: 176806, SEQ ID NO: 176815, SEQ ID NO: 176953, SEQ ID NO: 176958, SEQ ID NO: 176969, SEQ ID NO: 176980, SEQ ID NO: 176991, SEQ ID NO: 177016, SEQ ID NO: 177033, SEQ ID NO: 177044, SEQ ID NO: 177061, SEQ ID NO: 177065, SEQ ID NO: 177080, SEQ ID NO: 177088, SEQ ID NO: 177102, SEQ ID NO: 177119, SEQ ID NO: 177343, SEQ ID NO: 177358, SEQ ID NO: 177390, SEQ ID NO: 177430, SEQ ID NO: 177437, SEQ ID NO: 177465, SEQ ID NOs: 177482 to 177483, SEQ ID NO: 177492, SEQ ID NO: 177495, SEQ ID NO: 177522, SEQ ID NO: 177585, SEQ ID NO: 177604, SEQ ID NO: 177611, SEQ ID NO: 177664, SEQ ID NO: 177669, SEQ ID NO: 177701, SEQ ID NO: 177707, SEQ ID NO: 177710, SEQ ID NO: 177712, SEQ ID NO: 177714, SEQ ID NO: 177734, SEQ ID NO: 177808, SEQ ID NO: 177841, SEQ ID NO: 177848, SEQ ID NO: 177892, SEQ ID NO: 177918, SEQ ID NO: 177958, SEQ ID NOs: 177989 to 177990, SEQ ID NO: 178023, SEQ ID NO: 178032, SEQ ID NO: 178035, SEQ ID NO: 178039, SEQ ID NO: 178122, SEQ ID NO: 178161, SEQ ID NO: 178195, SEQ ID NO: 178208, SEQ ID NO: 178244, SEQ ID NO: 178272, SEQ ID NO: 178293, SEQ ID NO: 178310, SEQ ID NO: 178338, SEQ ID NO: 178353, SEQ ID NO: 178385, SEQ ID NO: 178399, SEQ ID NO: 178477, SEQ ID NO: 178519, SEQ ID NO: 178568, SEQ ID NO: 178587, SEQ ID NO: 178600, SEQ ID NO: 178612, SEQ ID NO: 178615, SEQ ID NO: 178651, SEQ ID NO: 178726, SEQ ID NO: 178740, SEQ ID NO: 178743, SEQ ID NO: 178750, SEQ ID NO: 178821, SEQ ID NO: 178886, SEQ ID NO: 178895, SEQ ID NO: 178911, SEQ ID NO: 178942, SEQ ID NO: 178946, SEQ ID NO: 178948, SEQ ID NO: 178966, SEQ ID NO: 179020, SEQ ID NO: 179031, SEQ ID NO: 179034, SEQ ID NO: 179130, SEQ ID NO: 179134, SEQ ID NO: 179151, SEQ ID NO: 179154, SEQ ID NO: 179224, SEQ ID NO: 179257, SEQ ID NO: 179387, SEQ ID NO: 179404, SEQ ID NO: 179444, SEQ ID NO: 179455, SEQ ID NO: 179462, SEQ ID NO: 179483, SEQ ID NO: 179544, SEQ ID NO: 179586, SEQ ID NO: 179600, SEQ ID NO: 179612, SEQ ID NO: 179619, SEQ ID NO: 179632, SEQ ID NO: 179677, SEQ ID NO: 179695, SEQ ID NO: 179697, SEQ ID NO: 179760, SEQ ID NO: 179863, SEQ ID NO: 179898, SEQ ID NO: 179904, SEQ ID NO: 179934, SEQ ID NO: 179957, SEQ ID NO: 179981, SEQ ID NO: 180013, SEQ ID NO: 180019, SEQ ID NO: 180036, SEQ ID NO: 180077, SEQ ID NO: 180086, SEQ ID NO: 180167, SEQ ID NO: 180257, SEQ ID NO: 180259, SEQ ID NO: 180271, SEQ ID NO: 180291, SEQ ID NO: 180327, SEQ ID NO: 180348, SEQ ID NO: 180378, SEQ ID NO: 180396, SEQ ID NO: 180430, SEQ ID NO: 180452, SEQ ID NO: 180458, SEQ ID NO: 180481, SEQ ID NO: 180489, SEQ ID NO: 180492, SEQ ID NO: 180528, SEQ ID NO: 180551, SEQ ID NO: 180567, SEQ ID NO: 180577, SEQ ID NO: 180597, SEQ ID NO: 180622, SEQ ID NO: 180683, SEQ ID NO: 180694, SEQ ID NOs: 180720 to 180721, SEQ ID NO: 180772, SEQ ID NO: 180799, SEQ ID NO: 180823, SEQ ID NO: 180843, SEQ ID NO: 180848, SEQ ID NO: 180858, SEQ ID NO: 180866, SEQ ID NO: 180879, SEQ ID NO: 180977, SEQ ID NOs: 181032 to 181033, SEQ ID NO: 181173, SEQ ID NO: 181204, SEQ ID NO: 181259, SEQ ID NO: 181406, SEQ ID NO: 181630, SEQ ID NO: 181685, SEQ ID NO: 181792, SEQ ID NO: 181963, SEQ ID NO: 181984, SEQ ID NOs: 182157 to 182159, SEQ ID NO: 182471, or SEQ ID NOs: 182574 to 197896.

In some embodiments, the amino acid sequence for a MHC class I peptide vaccine for the MAR1 protein comprises one or more of the SEQ ID NOs: 113808 to 113869. In some embodiments, any one of the peptides in the MAR1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 113808 to 113869.

In some embodiments, the amino acid sequence for a MHC class I peptide vaccine for the MAR1 protein comprises one or more of the SEQ ID NOs: 113808 to 116477. In some embodiments, any one of the peptides in the MAR1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 113808 to 116477.

In some embodiments, the amino acid sequence for a MHC class I peptide vaccine for the MAR1 protein comprises two or more of the SEQ ID NOs: 113808 to 113869. In some embodiments, any one of the peptides in the MAR1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 113808 to 113869.

In some embodiments, the amino acid sequence for a MHC class I peptide vaccine for the MAR1 protein comprises two or more of the SEQ ID NOs: 113808 to 116477. In some embodiments, any one of the peptides in the MAR1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 113808 to 116477.

Additional amino acid sequences of MHC class I vaccine peptides are provided in Sequence Listings (SEQ ID NOs: 760 to 22727, SEQ ID NOs: 28865 to 34168, SEQ ID NOs: 37175 to 41320, SEQ ID NO: 41345, SEQ ID NO: 41347, SEQ ID NOs: 41351 to 41352, SEQ ID NO: 41366, SEQ ID NO: 41382, SEQ ID NO: 41392, SEQ ID NO: 41396, SEQ ID NOs: 41398 to 51433, SEQ ID NOs: 51511 to 60455, SEQ ID NOs: 60528 to 68237, SEQ ID NO: 68257, SEQ ID NO: 68288, SEQ ID NOs: 68322 to 95592, SEQ ID NOs: 95665 to 113807, SEQ ID NOs: 113870 to 116477, SEQ ID NOs: 125219 to 144108, SEQ ID NOs: 144189 to 162382, SEQ ID NOs: 162454 to 166443, SEQ ID NO: 166477, SEQ ID NO: 166486, SEQ ID NO: 166513, SEQ ID NOs: 166532 to 182573, and SEQ ID NOs: 182655 to 197896). In some embodiments, any combination of MHC class I peptides disclosed herein (SEQ ID NOs: 1 to 474, SEQ ID NOs: 760 to 22727, SEQ ID NOs: 28796 to 34168, SEQ ID NOs: 37110 to 116477, and SEQ ID NOs: 125134 to 197896) may be used to create a combined peptide vaccine having between about 2 and about 40 peptides. In some embodiments, any one of the peptides (SEQ ID NOs: 1 to 474, SEQ ID NOs: 760 to 22727, SEQ ID NOs: 28796 to 34168, SEQ ID NOs: 37110 to 116477, and SEQ ID NOs: 125134 to 197896) in the combined vaccine comprises or contains an amino acid sequence 80, 81, 82, 83, 84, 85, 86, 87, 88, 89, 90, 91, 92, 93, 94, 95, 96, 97, 98 or 99% identical to any of SEQ ID NOs: 1 to 474, SEQ ID NOs: 760 to 22727, SEQ ID NOs: 28796 to 34168, SEQ ID NOs: 37110 to 116477, or SEQ ID NOs: 125134 to 197896.

MHC Class II Peptide Sequences

In some embodiments, a peptide vaccine (single target or combined multiple target vaccine) comprises about 1 to 40 MHC class II peptides with each peptide consisting of about 20 amino acids. In some embodiments, an MHC class II peptide vaccine is intended for one or more of the CTG1B, KKLC1, MAGA1, MAGA3, MAGA4, MAGC1, MAGC3, MAR1, PMEL, PRAME, SSX2, TYRP1, or TYRP2 protein targets. In some embodiments, an MHC class II peptide vaccine is intended for one or more of the pancreatic cancer, skin cancer, thyroid cancer, brain cancer, colorectal cancer, bronchus and lung cancer, breast cancer, or ovarian cancer indications.

In some embodiments, the amino acid sequence for a MHC class II peptide vaccine for the CTG1B protein comprises one or more of the SEQ ID NOs: 197897 to 197910. In some embodiments, any one of the peptides in the CTG1B vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 197897 to 197910.

In some embodiments, the amino acid sequence for a MHC class II peptide vaccine for the CTG1B protein comprises one or more of the SEQ ID NOs: 197897 to 203516. In some embodiments, any one of the peptides in the CTG1B vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 197897 to 203516.

In some embodiments, the amino acid sequence for a MHC class II peptide vaccine for the CTG1B protein comprises two or more of the SEQ ID NOs: 197897 to 197910. In some embodiments, any one of the peptides in the CTG1B vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 197897 to 197910.

In some embodiments, the amino acid sequence for a MHC class II peptide vaccine for the CTG1B protein comprises two or more of the SEQ ID NOs: 197897 to 203516. In some embodiments, any one of the peptides in the CTG1B vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 197897 to 203516.

In some embodiments, the amino acid sequence for a MHC class II peptide vaccine for the MAGA1 protein comprises one or more of the SEQ ID NOs: 211901 to 211917. In some embodiments, any one of the peptides in the MAGA1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 211901 to 211917.

In some embodiments, the amino acid sequence for a MHC class II peptide vaccine for the MAGA1 protein comprises one or more of the SEQ ID NOs: 211901 to 223622. In some embodiments, any one of the peptides in the MAGA1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 211901 to 223622.

In some embodiments, the amino acid sequence for a MHC class II peptide vaccine for the MAGA1 protein comprises two or more of the SEQ ID NOs: 211901 to 211917. In some embodiments, any one of the peptides in the MAGA1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 211901 to 211917.

In some embodiments, the amino acid sequence for a MHC class II peptide vaccine for the MAGA1 protein comprises two or more of the SEQ ID NOs: 211901 to 223622. In some embodiments, any one of the peptides in the MAGA1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 211901 to 223622.

In some embodiments, the amino acid sequence for a MHC class II peptide vaccine for the MAGA3 protein comprises one or more of the SEQ ID NOs: 223623 to 223640. In some embodiments, any one of the peptides in the MAGA3 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 223623 to 223640.

In some embodiments, the amino acid sequence for a MHC class II peptide vaccine for the MAGA3 protein comprises one or more of the SEQ ID NOs: 212187 to 212190, SEQ ID NOs: 212668 to 212673, SEQ ID NOs: 212836 to 212837, SEQ ID NOs: 213320 to 213323, SEQ ID NO: 213359, SEQ ID NOs: 213380 to 213382, SEQ ID NOs: 213391 to 213395, SEQ ID NO: 213432, SEQ ID NOs: 214285 to 214290, SEQ ID NOs: 215204 to 215205, SEQ ID NOs: 215677 to 215682, SEQ ID NO: 216240, SEQ ID NO: 216385, SEQ ID NO: 216393, SEQ ID NO: 216397, SEQ ID NOs: 217119 to 217137, SEQ ID NO: 217185, SEQ ID NO: 217187, SEQ ID NO: 217190, SEQ ID NOs: 217659 to 217660, SEQ ID NOs: 219238 to 219245, SEQ ID NOs: 219322 to 219323, SEQ ID NOs: 219380 to 219386, SEQ ID NOs: 219432 to 219446, SEQ ID NOs: 219545 to 219546, SEQ ID NO: 219774, SEQ ID NO: 219777, SEQ ID NO: 220091, SEQ ID NOs: 221996 to 222005, SEQ ID NO: 223185, SEQ ID NO: 223187, SEQ ID NO: 223251, SEQ ID NO: 223253, SEQ ID NO: 223258, SEQ ID NO: 223261, SEQ ID NO: 223264, SEQ ID NO: 223268, SEQ ID NO: 223272, SEQ ID NO: 223274, SEQ ID NO: 223277, and SEQ ID NOs: 223623 to 236015. In some embodiments, any one of the peptides in the MAGA3 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 212187 to 212190, SEQ ID NOs: 212668 to 212673, SEQ ID NOs: 212836 to 212837, SEQ ID NOs: 213320 to 213323, SEQ ID NO: 213359, SEQ ID NOs: 213380 to 213382, SEQ ID NOs: 213391 to 213395, SEQ ID NO: 213432, SEQ ID NOs: 214285 to 214290, SEQ ID NOs: 215204 to 215205, SEQ ID NOs: 215677 to 215682, SEQ ID NO: 216240, SEQ ID NO: 216385, SEQ ID NO: 216393, SEQ ID NO: 216397, SEQ ID NOs: 217119 to 217137, SEQ ID NO: 217185, SEQ ID NO: 217187, SEQ ID NO: 217190, SEQ ID NOs: 217659 to 217660, SEQ ID NOs: 219238 to 219245, SEQ ID NOs: 219322 to 219323, SEQ ID NOs: 219380 to 219386, SEQ ID NOs: 219432 to 219446, SEQ ID NOs: 219545 to 219546, SEQ ID NO: 219774, SEQ ID NO: 219777, SEQ ID NO: 220091, SEQ ID NOs: 221996 to 222005, SEQ ID NO: 223185, SEQ ID NO: 223187, SEQ ID NO: 223251, SEQ ID NO: 223253, SEQ ID NO: 223258, SEQ ID NO: 223261, SEQ ID NO: 223264, SEQ ID NO: 223268, SEQ ID NO: 223272, SEQ ID NO: 223274, SEQ ID NO: 223277, or SEQ ID NOs: 223623 to 236015.

In some embodiments, the amino acid sequence for a MHC class II peptide vaccine for the MAGA3 protein comprises two or more of the SEQ ID NOs: 223623 to 223640. In some embodiments, any one of the peptides in the MAGA3 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 223623 to 223640.

In some embodiments, the amino acid sequence for a MHC class II peptide vaccine for the MAGA3 protein comprises two or more of the SEQ ID NOs: 212187 to 212190, SEQ ID NOs: 212668 to 212673, SEQ ID NOs: 212836 to 212837, SEQ ID NOs: 213320 to 213323, SEQ ID NO: 213359, SEQ ID NOs: 213380 to 213382, SEQ ID NOs: 213391 to 213395, SEQ ID NO: 213432, SEQ ID NOs: 214285 to 214290, SEQ ID NOs: 215204 to 215205, SEQ ID NOs: 215677 to 215682, SEQ ID NO: 216240, SEQ ID NO: 216385, SEQ ID NO: 216393, SEQ ID NO: 216397, SEQ ID NOs: 217119 to 217137, SEQ ID NO: 217185, SEQ ID NO: 217187, SEQ ID NO: 217190, SEQ ID NOs: 217659 to 217660, SEQ ID NOs: 219238 to 219245, SEQ ID NOs: 219322 to 219323, SEQ ID NOs: 219380 to 219386, SEQ ID NOs: 219432 to 219446, SEQ ID NOs: 219545 to 219546, SEQ ID NO: 219774, SEQ ID NO: 219777, SEQ ID NO: 220091, SEQ ID NOs: 221996 to 222005, SEQ ID NO: 223185, SEQ ID NO: 223187, SEQ ID NO: 223251, SEQ ID NO: 223253, SEQ ID NO: 223258, SEQ ID NO: 223261, SEQ ID NO: 223264, SEQ ID NO: 223268, SEQ ID NO: 223272, SEQ ID NO: 223274, SEQ ID NO: 223277, or SEQ ID NOs: 223623 to 236015.

In some embodiments, the amino acid sequence for a MHC class II peptide vaccine for the MAGA4 protein comprises one or more of the SEQ ID NOs: 236016 to 236033. In some embodiments, any one of the peptides in the MAGA4 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 236016 to 236033.

In some embodiments, the amino acid sequence for a MHC class II peptide vaccine for the MAGA4 protein comprises one or more of the SEQ ID NO: 211911, SEQ ID NOs: 212086 to 212095, SEQ ID NOs: 212435 to 212440, SEQ ID NOs: 212681 to 212684, SEQ ID NOs: 212858 to 212860, SEQ ID NOs: 213516 to 213517, SEQ ID NOs: 213529 to 213531, SEQ ID NOs: 213602 to 213611, SEQ ID NOs: 213719 to 213720, SEQ ID NO: 213899, SEQ ID NOs: 214004 to 214012, SEQ ID NO: 214607, SEQ ID NOs: 214647 to 214649, SEQ ID NOs: 214672 to 214679, SEQ ID NOs: 214774 to 214775, SEQ ID NO: 214777, SEQ ID NO: 214779, SEQ ID NO: 214782, SEQ ID NOs: 215373 to 215415, SEQ ID NO: 215494, SEQ ID NO: 215497, SEQ ID NO: 215679, SEQ ID NO: 216244, SEQ ID NO: 216246, SEQ ID NOs: 216383 to 216401, SEQ ID NOs: 217184 to 217192, SEQ ID NO: 217200, SEQ ID NO: 217362, SEQ ID NOs: 217708 to 217712, SEQ ID NO: 217719, SEQ ID NO: 219238, SEQ ID NOs: 219742 to 219744, SEQ ID NO: 219747, SEQ ID NO: 219749, SEQ ID NO: 219751, SEQ ID NOs: 219773 to 219781, SEQ ID NOs: 219994 to 220030, SEQ ID NOs: 220318 to 220319, SEQ ID NO: 220327, SEQ ID NO: 220670, SEQ ID NO: 220815, SEQ ID NO: 220820, SEQ ID NOs: 221197 to 221234, SEQ ID NO: 221998, SEQ ID NO: 222000, SEQ ID NO: 223092, SEQ ID NO: 223095, SEQ ID NO: 223097, SEQ ID NO: 223099, SEQ ID NO: 223119, SEQ ID NO: 223121, SEQ ID NOs: 223184 to 223190, SEQ ID NOs: 223250 to 223283, SEQ ID NO: 223319, SEQ ID NO: 230922, SEQ ID NOs: 232805 to 232806, SEQ ID NO: 232846, and SEQ ID NOs: 236016 to 247058. In some embodiments, any one of the peptides in the MAGA4 vaccine comprise an amino acid sequence 80, 81, 82, 83, 84, 85, 86, 87, 88, 89, 90, 91, 92, 93, 94, 95, 96, 97, 98 or 99% identical to SEQ ID NO: 211911, SEQ ID NOs: 212086 to 212095, SEQ ID NOs: 212435 to 212440, SEQ ID NOs: 212681 to 212684, SEQ ID NOs: 212858 to 212860, SEQ ID NOs: 213516 to 213517, SEQ ID NOs: 213529 to 213531, SEQ ID NOs: 213602 to 213611, SEQ ID NOs: 213719 to 213720, SEQ ID NO: 213899, SEQ ID NOs: 214004 to 214012, SEQ ID NO: 214607, SEQ ID NOs: 214647 to 214649, SEQ ID NOs: 214672 to 214679, SEQ ID NOs: 214774 to 214775, SEQ ID NO: 214777, SEQ ID NO: 214779, SEQ ID NO: 214782, SEQ ID NOs: 215373 to 215415, SEQ ID NO: 215494, SEQ ID NO: 215497, SEQ ID NO: 215679, SEQ ID NO: 216244, SEQ ID NO: 216246, SEQ ID NOs: 216383 to 216401, SEQ ID NOs: 217184 to 217192, SEQ ID NO: 217200, SEQ ID NO: 217362, SEQ ID NOs: 217708 to 217712, SEQ ID NO: 217719, SEQ ID NO: 219238, SEQ ID NOs: 219742 to 219744, SEQ ID NO: 219747, SEQ ID NO: 219749, SEQ ID NO: 219751, SEQ ID NOs: 219773 to 219781, SEQ ID NOs: 219994 to 220030, SEQ ID NOs: 220318 to 220319, SEQ ID NO: 220327, SEQ ID NO: 220670, SEQ ID NO: 220815, SEQ ID NO: 220820, SEQ ID NOs: 221197 to 221234, SEQ ID NO: 221998, SEQ ID NO: 222000, SEQ ID NO: 223092, SEQ ID NO: 223095, SEQ ID NO: 223097, SEQ ID NO: 223099, SEQ ID NO: 223119, SEQ ID NO: 223121, SEQ ID NOs: 223184 to 223190, SEQ ID NOs: 223250 to 223283, SEQ ID NO: 223319, SEQ ID NO: 230922, SEQ ID NOs: 232805 to 232806, SEQ ID NO: 232846, or SEQ ID NOs: 236016 to 247058.

In some embodiments, the amino acid sequence for a MHC class II peptide vaccine for the MAGA4 protein comprises two or more of the SEQ ID NOs: 236016 to 236033. In some embodiments, any one of the peptides in the MAGA4 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 236016 to 236033.

In some embodiments, the amino acid sequence for a MHC class II peptide vaccine for the MAGA4 protein comprises two or more of the SEQ ID NO: 211911, SEQ ID NOs: 212086 to 212095, SEQ ID NOs: 212435 to 212440, SEQ ID NOs: 212681 to 212684, SEQ ID NOs: 212858 to 212860, SEQ ID NOs: 213516 to 213517, SEQ ID NOs: 213529 to 213531, SEQ ID NOs: 213602 to 213611, SEQ ID NOs: 213719 to 213720, SEQ ID NO: 213899, SEQ ID NOs: 214004 to 214012, SEQ ID NO: 214607, SEQ ID NOs: 214647 to 214649, SEQ ID NOs: 214672 to 214679, SEQ ID NOs: 214774 to 214775, SEQ ID NO: 214777, SEQ ID NO: 214779, SEQ ID NO: 214782, SEQ ID NOs: 215373 to 215415, SEQ ID NO: 215494, SEQ ID NO: 215497, SEQ ID NO: 215679, SEQ ID NO: 216244, SEQ ID NO: 216246, SEQ ID NOs: 216383 to 216401, SEQ ID NOs: 217184 to 217192, SEQ ID NO: 217200, SEQ ID NO: 217362, SEQ ID NOs: 217708 to 217712, SEQ ID NO: 217719, SEQ ID NO: 219238, SEQ ID NOs: 219742 to 219744, SEQ ID NO: 219747, SEQ ID NO: 219749, SEQ ID NO: 219751, SEQ ID NOs: 219773 to 219781, SEQ ID NOs: 219994 to 220030, SEQ ID NOs: 220318 to 220319, SEQ ID NO: 220327, SEQ ID NO: 220670, SEQ ID NO: 220815, SEQ ID NO: 220820, SEQ ID NOs: 221197 to 221234, SEQ ID NO: 221998, SEQ ID NO: 222000, SEQ ID NO: 223092, SEQ ID NO: 223095, SEQ ID NO: 223097, SEQ ID NO: 223099, SEQ ID NO: 223119, SEQ ID NO: 223121, SEQ ID NOs: 223184 to 223190, SEQ ID NOs: 223250 to 223283, SEQ ID NO: 223319, SEQ ID NO: 230922, SEQ ID NOs: 232805 to 232806, SEQ ID NO: 232846, and SEQ ID NOs: 236016 to 247058. In some embodiments, any one of the peptides in the MAGA4 vaccine comprise an amino acid sequence 80, 81, 82, 83, 84, 85, 86, 87, 88, 89, 90, 91, 92, 93, 94, 95, 96, 97, 98 or 99% identical to SEQ ID NO: 211911, SEQ ID NOs: 212086 to 212095, SEQ ID NOs: 212435 to 212440, SEQ ID NOs: 212681 to 212684, SEQ ID NOs: 212858 to 212860, SEQ ID NOs: 213516 to 213517, SEQ ID NOs: 213529 to 213531, SEQ ID NOs: 213602 to 213611, SEQ ID NOs: 213719 to 213720, SEQ ID NO: 213899, SEQ ID NOs: 214004 to 214012, SEQ ID NO: 214607, SEQ ID NOs: 214647 to 214649, SEQ ID NOs: 214672 to 214679, SEQ ID NOs: 214774 to 214775, SEQ ID NO: 214777, SEQ ID NO: 214779, SEQ ID NO: 214782, SEQ ID NOs: 215373 to 215415, SEQ ID NO: 215494, SEQ ID NO: 215497, SEQ ID NO: 215679, SEQ ID NO: 216244, SEQ ID NO: 216246, SEQ ID NOs: 216383 to 216401, SEQ ID NOs: 217184 to 217192, SEQ ID NO: 217200, SEQ ID NO: 217362, SEQ ID NOs: 217708 to 217712, SEQ ID NO: 217719, SEQ ID NO: 219238, SEQ ID NOs: 219742 to 219744, SEQ ID NO: 219747, SEQ ID NO: 219749, SEQ ID NO: 219751, SEQ ID NOs: 219773 to 219781, SEQ ID NOs: 219994 to 220030, SEQ ID NOs: 220318 to 220319, SEQ ID NO: 220327, SEQ ID NO: 220670, SEQ ID NO: 220815, SEQ ID NO: 220820, SEQ ID NOs: 221197 to 221234, SEQ ID NO: 221998, SEQ ID NO: 222000, SEQ ID NO: 223092, SEQ ID NO: 223095, SEQ ID NO: 223097, SEQ ID NO: 223099, SEQ ID NO: 223119, SEQ ID NO: 223121, SEQ ID NOs: 223184 to 223190, SEQ ID NOs: 223250 to 223283, SEQ ID NO: 223319, SEQ ID NO: 230922, SEQ ID NOs: 232805 to 232806, SEQ ID NO: 232846, or SEQ ID NOs: 236016 to 247058.

In some embodiments, the amino acid sequence for a MHC class II peptide vaccine for the MAGC1 protein comprises one or more of the SEQ ID NOs: 247059 to 247093. In some embodiments, any one of the peptides in the MAGC1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 247059 to 247093.

In some embodiments, the amino acid sequence for a MHC class II peptide vaccine for the MAGC1 protein comprises one or more of the SEQ ID NOs: 247059 to 281349. In some embodiments, any one of the peptides in the MAGC1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 247059 to 281349.

In some embodiments, the amino acid sequence for a MHC class II peptide vaccine for the MAGC1 protein comprises two or more of the SEQ ID NOs: 247059 to 247093. In some embodiments, any one of the peptides in the MAGC1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 247059 to 247093.

In some embodiments, the amino acid sequence for a MHC class II peptide vaccine for the MAGC1 protein comprises two or more of the SEQ ID NOs: 247059 to 281349. In some embodiments, any one of the peptides in the MAGC1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 247059 to 281349.

In some embodiments, the amino acid sequence for a MHC class II peptide vaccine for the MAGC3 protein comprises one or more of the SEQ ID NOs: 281350 to 281378. In some embodiments, any one of the peptides in the MAGC3 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 281350 to 281378.

In some embodiments, the amino acid sequence for a MHC class II peptide vaccine for the MAGC3 protein comprises one or more of the SEQ ID NO: 217120, SEQ ID NO: 247270, SEQ ID NO: 248009, SEQ ID NOs: 248159 to 248160, SEQ ID NOs: 248735 to 248738, SEQ ID NOs: 249358 to 249362, SEQ ID NOs: 249690 to 249691, SEQ ID NOs: 252562 to 252564, SEQ ID NOs: 252836 to 252837, SEQ ID NO: 256214, SEQ ID NO: 256221, SEQ ID NO: 256226, SEQ ID NO: 256229, SEQ ID NO: 256235, SEQ ID NO: 256705, SEQ ID NO: 257337, SEQ ID NO: 257341, SEQ ID NO: 257345, SEQ ID NO: 257995, SEQ ID NO: 258292, SEQ ID NO: 258295, SEQ ID NOs: 258614 to 258616, SEQ ID NO: 259467, SEQ ID NO: 259471, SEQ ID NO: 259474, SEQ ID NO: 260118, SEQ ID NO: 260122, SEQ ID NO: 260126, SEQ ID NO: 260131, SEQ ID NO: 260138, SEQ ID NO: 260145, SEQ ID NO: 260153, SEQ ID NOs: 260367 to 260384, SEQ ID NO: 260407, SEQ ID NO: 260412, SEQ ID NO: 261788, SEQ ID NO: 261790, SEQ ID NOs: 261792 to 261793, SEQ ID NO: 261795, SEQ ID NO: 261798, SEQ ID NO: 261800, SEQ ID NO: 261803, SEQ ID NO: 261805, SEQ ID NO: 261809, SEQ ID NO: 261811, SEQ ID NO: 261814, SEQ ID NO: 261816, SEQ ID NO: 261821, SEQ ID NO: 261823, SEQ ID NO: 261830, SEQ ID NO: 261832, SEQ ID NO: 261837, SEQ ID NO: 261839, SEQ ID NO: 262119, SEQ ID NO: 262122, SEQ ID NOs: 262261 to 262285, SEQ ID NO: 262313, SEQ ID NO: 262318, SEQ ID NOs: 263471 to 263474, SEQ ID NO: 263494, SEQ ID NO: 263498, SEQ ID NOs: 266653 to 266654, SEQ ID NO: 269139, SEQ ID NO: 269143, SEQ ID NO: 269149, SEQ ID NO: 269156, SEQ ID NO: 269169, SEQ ID NOs: 270516 to 270517, SEQ ID NOs: 270519 to 270520, SEQ ID NOs: 270523 to 270524, SEQ ID NOs: 270527 to 270528, SEQ ID NO: 272016, SEQ ID NO: 272020, SEQ ID NOs: 272214 to 272222, SEQ ID NO: 272243, SEQ ID NO: 272248, SEQ ID NO: 272896, SEQ ID NOs: 273018 to 273020, SEQ ID NOs: 278350 to 278351, SEQ ID NO: 278355, SEQ ID NOs: 278358 to 278359, SEQ ID NOs: 278361 to 278362, SEQ ID NO: 278364, SEQ ID NO: 278367, SEQ ID NO: 278369, SEQ ID NO: 278371, SEQ ID NO: 278373, SEQ ID NO: 278375, SEQ ID NO: 278377, SEQ ID NO: 278383, SEQ ID NO: 278385, SEQ ID NO: 278388, SEQ ID NO: 278390, SEQ ID NO: 278394, SEQ ID NO: 278396, SEQ ID NOs: 281013 to 281014, SEQ ID NO: 281018, SEQ ID NO: 281022, SEQ ID NO: 281026, SEQ ID NO: 281031, SEQ ID NOs: 281037 to 281038, SEQ ID NOs: 281044 to 281045, SEQ ID NOs: 281052 to 281053, SEQ ID NOs: 281151 to 281152, SEQ ID NO: 281155, SEQ ID NO: 281159, SEQ ID NOs: 281162 to 281163, SEQ ID NOs: 281165 to 281166, SEQ ID NO: 281169, SEQ ID NO: 281171, SEQ ID NO: 281174, SEQ ID NO: 281176, SEQ ID NO: 281179, SEQ ID NO: 281181, SEQ ID NO: 281184, SEQ ID NO: 281186, SEQ ID NO: 281190, SEQ ID NO: 281192, SEQ ID NO: 281197, SEQ ID NO: 281199, and SEQ ID NOs: 281350 to 305565. In some embodiments, any one of the peptides in the MAGC3 vaccine comprise an amino acid sequence 80, 81, 82, 83, 84, 85, 86, 87, 88, 89, 90, 91, 92, 93, 94, 95, 96, 97, 98 or 99% identical to SEQ ID NO: 217120, SEQ ID NO: 247270, SEQ ID NO: 248009, SEQ ID NOs: 248159 to 248160, SEQ ID NOs: 248735 to 248738, SEQ ID NOs: 249358 to 249362, SEQ ID NOs: 249690 to 249691, SEQ ID NOs: 252562 to 252564, SEQ ID NOs: 252836 to 252837, SEQ ID NO: 256214, SEQ ID NO: 256221, SEQ ID NO: 256226, SEQ ID NO: 256229, SEQ ID NO: 256235, SEQ ID NO: 256705, SEQ ID NO: 257337, SEQ ID NO: 257341, SEQ ID NO: 257345, SEQ ID NO: 257995, SEQ ID NO: 258292, SEQ ID NO: 258295, SEQ ID NOs: 258614 to 258616, SEQ ID NO: 259467, SEQ ID NO: 259471, SEQ ID NO: 259474, SEQ ID NO: 260118, SEQ ID NO: 260122, SEQ ID NO: 260126, SEQ ID NO: 260131, SEQ ID NO: 260138, SEQ ID NO: 260145, SEQ ID NO: 260153, SEQ ID NOs: 260367 to 260384, SEQ ID NO: 260407, SEQ ID NO: 260412, SEQ ID NO: 261788, SEQ ID NO: 261790, SEQ ID NOs: 261792 to 261793, SEQ ID NO: 261795, SEQ ID NO: 261798, SEQ ID NO: 261800, SEQ ID NO: 261803, SEQ ID NO: 261805, SEQ ID NO: 261809, SEQ ID NO: 261811, SEQ ID NO: 261814, SEQ ID NO: 261816, SEQ ID NO: 261821, SEQ ID NO: 261823, SEQ ID NO: 261830, SEQ ID NO: 261832, SEQ ID NO: 261837, SEQ ID NO: 261839, SEQ ID NO: 262119, SEQ ID NO: 262122, SEQ ID NOs: 262261 to 262285, SEQ ID NO: 262313, SEQ ID NO: 262318, SEQ ID NOs: 263471 to 263474, SEQ ID NO: 263494, SEQ ID NO: 263498, SEQ ID NOs: 266653 to 266654, SEQ ID NO: 269139, SEQ ID NO: 269143, SEQ ID NO: 269149, SEQ ID NO: 269156, SEQ ID NO: 269169, SEQ ID NOs: 270516 to 270517, SEQ ID NOs: 270519 to 270520, SEQ ID NOs: 270523 to 270524, SEQ ID NOs: 270527 to 270528, SEQ ID NO: 272016, SEQ ID NO: 272020, SEQ ID NOs: 272214 to 272222, SEQ ID NO: 272243, SEQ ID NO: 272248, SEQ ID NO: 272896, SEQ ID NOs: 273018 to 273020, SEQ ID NOs: 278350 to 278351, SEQ ID NO: 278355, SEQ ID NOs: 278358 to 278359, SEQ ID NOs: 278361 to 278362, SEQ ID NO: 278364, SEQ ID NO: 278367, SEQ ID NO: 278369, SEQ ID NO: 278371, SEQ ID NO: 278373, SEQ ID NO: 278375, SEQ ID NO: 278377, SEQ ID NO: 278383, SEQ ID NO: 278385, SEQ ID NO: 278388, SEQ ID NO: 278390, SEQ ID NO: 278394, SEQ ID NO: 278396, SEQ ID NOs: 281013 to 281014, SEQ ID NO: 281018, SEQ ID NO: 281022, SEQ ID NO: 281026, SEQ ID NO: 281031, SEQ ID NOs: 281037 to 281038, SEQ ID NOs: 281044 to 281045, SEQ ID NOs: 281052 to 281053, SEQ ID NOs: 281151 to 281152, SEQ ID NO: 281155, SEQ ID NO: 281159, SEQ ID NOs: 281162 to 281163, SEQ ID NOs: 281165 to 281166, SEQ ID NO: 281169, SEQ ID NO: 281171, SEQ ID NO: 281174, SEQ ID NO: 281176, SEQ ID NO: 281179, SEQ ID NO: 281181, SEQ ID NO: 281184, SEQ ID NO: 281186, SEQ ID NO: 281190, SEQ ID NO: 281192, SEQ ID NO: 281197, SEQ ID NO: 281199, or SEQ ID NOs: 281350 to 305565.

In some embodiments, the amino acid sequence for a MHC class II peptide vaccine for the MAGC3 protein comprises two or more of the SEQ ID NOs: 281350 to 281378. In some embodiments, any one of the peptides in the MAGC3 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 281350 to 281378.

In some embodiments, the amino acid sequence for a MHC class II peptide vaccine for the MAGC3 protein comprises two or more of the SEQ ID NO: 217120, SEQ ID NO: 247270, SEQ ID NO: 248009, SEQ ID NOs: 248159 to 248160, SEQ ID NOs: 248735 to 248738, SEQ ID NOs: 249358 to 249362, SEQ ID NOs: 249690 to 249691, SEQ ID NOs: 252562 to 252564, SEQ ID NOs: 252836 to 252837, SEQ ID NO: 256214, SEQ ID NO: 256221, SEQ ID NO: 256226, SEQ ID NO: 256229, SEQ ID NO: 256235, SEQ ID NO: 256705, SEQ ID NO: 257337, SEQ ID NO: 257341, SEQ ID NO: 257345, SEQ ID NO: 257995, SEQ ID NO: 258292, SEQ ID NO: 258295, SEQ ID NOs: 258614 to 258616, SEQ ID NO: 259467, SEQ ID NO: 259471, SEQ ID NO: 259474, SEQ ID NO: 260118, SEQ ID NO: 260122, SEQ ID NO: 260126, SEQ ID NO: 260131, SEQ ID NO: 260138, SEQ ID NO: 260145, SEQ ID NO: 260153, SEQ ID NOs: 260367 to 260384, SEQ ID NO: 260407, SEQ ID NO: 260412, SEQ ID NO: 261788, SEQ ID NO: 261790, SEQ ID NOs: 261792 to 261793, SEQ ID NO: 261795, SEQ ID NO: 261798, SEQ ID NO: 261800, SEQ ID NO: 261803, SEQ ID NO: 261805, SEQ ID NO: 261809, SEQ ID NO: 261811, SEQ ID NO: 261814, SEQ ID NO: 261816, SEQ ID NO: 261821, SEQ ID NO: 261823, SEQ ID NO: 261830, SEQ ID NO: 261832, SEQ ID NO: 261837, SEQ ID NO: 261839, SEQ ID NO: 262119, SEQ ID NO: 262122, SEQ ID NOs: 262261 to 262285, SEQ ID NO: 262313, SEQ ID NO: 262318, SEQ ID NOs: 263471 to 263474, SEQ ID NO: 263494, SEQ ID NO: 263498, SEQ ID NOs: 266653 to 266654, SEQ ID NO: 269139, SEQ ID NO: 269143, SEQ ID NO: 269149, SEQ ID NO: 269156, SEQ ID NO: 269169, SEQ ID NOs: 270516 to 270517, SEQ ID NOs: 270519 to 270520, SEQ ID NOs: 270523 to 270524, SEQ ID NOs: 270527 to 270528, SEQ ID NO: 272016, SEQ ID NO: 272020, SEQ ID NOs: 272214 to 272222, SEQ ID NO: 272243, SEQ ID NO: 272248, SEQ ID NO: 272896, SEQ ID NOs: 273018 to 273020, SEQ ID NOs: 278350 to 278351, SEQ ID NO: 278355, SEQ ID NOs: 278358 to 278359, SEQ ID NOs: 278361 to 278362, SEQ ID NO: 278364, SEQ ID NO: 278367, SEQ ID NO: 278369, SEQ ID NO: 278371, SEQ ID NO: 278373, SEQ ID NO: 278375, SEQ ID NO: 278377, SEQ ID NO: 278383, SEQ ID NO: 278385, SEQ ID NO: 278388, SEQ ID NO: 278390, SEQ ID NO: 278394, SEQ ID NO: 278396, SEQ ID NOs: 281013 to 281014, SEQ ID NO: 281018, SEQ ID NO: 281022, SEQ ID NO: 281026, SEQ ID NO: 281031, SEQ ID NOs: 281037 to 281038, SEQ ID NOs: 281044 to 281045, SEQ ID NOs: 281052 to 281053, SEQ ID NOs: 281151 to 281152, SEQ ID NO: 281155, SEQ ID NO: 281159, SEQ ID NOs: 281162 to 281163, SEQ ID NOs: 281165 to 281166, SEQ ID NO: 281169, SEQ ID NO: 281171, SEQ ID NO: 281174, SEQ ID NO: 281176, SEQ ID NO: 281179, SEQ ID NO: 281181, SEQ ID NO: 281184, SEQ ID NO: 281186, SEQ ID NO: 281190, SEQ ID NO: 281192, SEQ ID NO: 281197, SEQ ID NO: 281199, or SEQ ID NOs: 281350 to 305565.

In some embodiments, the amino acid sequence for a MHC class II peptide vaccine for the SSX2 protein comprises one or more of the SEQ ID NOs: 369027 to 369036. In some embodiments, any one of the peptides in the SSX2 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 369027 to 369036.

In some embodiments, the amino acid sequence for a MHC class II peptide vaccine for the SSX2 protein comprises one or more of the SEQ ID NOs: 369027 to 373347. In some embodiments, any one of the peptides in the SSX2 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 369027 to 373347.

In some embodiments, the amino acid sequence for a MHC class II peptide vaccine for the SSX2 protein comprises two or more of the SEQ ID NOs: 369027 to 369036. In some embodiments, any one of the peptides in the SSX2 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 369027 to 369036.

In some embodiments, the amino acid sequence for a MHC class II peptide vaccine for the SSX2 protein comprises two or more of the SEQ ID NOs: 369027 to 373347. In some embodiments, any one of the peptides in the SSX2 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 369027 to 373347.

In some embodiments, the amino acid sequence for a MHC class II peptide vaccine for the PRAME protein comprises one or more of the SEQ ID NOs: 342521 to 342555. In some embodiments, any one of the peptides in the PRAME vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 342521 to 342555.

In some embodiments, the amino acid sequence for a MHC class II peptide vaccine for the PRAME protein comprises one or more of the SEQ ID NOs: 342521 to 369026. In some embodiments, any one of the peptides in the PRAME vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 342521 to 369026.

In some embodiments, the amino acid sequence for a MHC class II peptide vaccine for the PRAME protein comprises two or more of the SEQ ID NOs: 342521 to 342555. In some embodiments, any one of the peptides in the PRAME vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 342521 to 342555.

In some embodiments, the amino acid sequence for a MHC class II peptide vaccine for the PRAME protein comprises two or more of the SEQ ID NOs: 342521 to 369026. In some embodiments, any one of the peptides in the PRAME vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 342521 to 369026.

In some embodiments, the amino acid sequence for a MHC class II peptide vaccine for the KKLC1 protein comprises one or more of the SEQ ID NOs: 206663 to 206675. In some embodiments, any one of the peptides in the KKLC1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 206663 to 206675.

In some embodiments, the amino acid sequence for a MHC class II peptide vaccine for the KKLC1 protein comprises one or more of the SEQ ID NOs: 206663 to 211900. In some embodiments, any one of the peptides in the KKLC1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 206663 to 211900.

In some embodiments, the amino acid sequence for a MHC class II peptide vaccine for the KKLC1 protein comprises two or more of the SEQ ID NOs: 206663 to 206675. In some embodiments, any one of the peptides in the KKLC1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 206663 to 206675.

In some embodiments, the amino acid sequence for a MHC class II peptide vaccine for the KKLC1 protein comprises two or more of the SEQ ID NOs: 206663 to 211900. In some embodiments, any one of the peptides in the KKLC1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 206663 to 211900.

In some embodiments, the amino acid sequence for a MHC class II peptide vaccine for the PMEL protein comprises one or more of the SEQ ID NOs: 317360 to 317390. In some embodiments, any one of the peptides in the PMEL vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 317360 to 317390.

In some embodiments, the amino acid sequence for a MHC class II peptide vaccine for the PMEL protein comprises one or more of the SEQ ID NOs: 317360 to 342520. In some embodiments, any one of the peptides in the PMEL vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 317360 to 342520.

In some embodiments, the amino acid sequence for a MHC class II peptide vaccine for the PMEL protein comprises two or more of the SEQ ID NOs: 317360 to 317390. In some embodiments, any one of the peptides in the PMEL vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 317360 to 317390.

In some embodiments, the amino acid sequence for a MHC class II peptide vaccine for the PMEL protein comprises two or more of the SEQ ID NOs: 317360 to 342520. In some embodiments, any one of the peptides in the PMEL vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 317360 to 342520.

In some embodiments, the amino acid sequence for a MHC class II peptide vaccine for the TYRP1 protein comprises one or more of the SEQ ID NOs: 373348 to 373373. In some embodiments, any one of the peptides in the TYRP1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 373348 to 373373.

In some embodiments, the amino acid sequence for a MHC class II peptide vaccine for the TYRP1 protein comprises one or more of the SEQ ID NOs: 373348 to 392433. In some embodiments, any one of the peptides in the TYRP1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 373348 to 392433.

In some embodiments, the amino acid sequence for a MHC class II peptide vaccine for the TYRP1 protein comprises two or more of the SEQ ID NOs: 373348 to 373373. In some embodiments, any one of the peptides in the TYRP1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 373348 to 373373.

In some embodiments, the amino acid sequence for a MHC class II peptide vaccine for the TYRP1 protein comprises two or more of the SEQ ID NOs: 373348 to 392433. In some embodiments, any one of the peptides in the TYRP1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 373348 to 392433.

In some embodiments, the amino acid sequence for a MHC class II peptide vaccine for the TYRP2 protein comprises one or more of the SEQ ID NOs: 392434 to 392455. In some embodiments, any one of the peptides in the TYRP2 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 392434 to 392455.

In some embodiments, the amino acid sequence for a MHC class II peptide vaccine for the TYRP2 protein comprises one or more of the SEQ ID NO: 379327, SEQ ID NO: 379329, SEQ ID NO: 379332, SEQ ID NO: 379334, SEQ ID NO: 379770, SEQ ID NO: 381531, SEQ ID NO: 382109, SEQ ID NO: 383301, SEQ ID NO: 383305, SEQ ID NO: 383310, SEQ ID NO: 386111, SEQ ID NO: 387057, SEQ ID NO: 387062, and SEQ ID NOs: 392434 to 410309. In some embodiments, any one of the peptides in the TYRP2 vaccine comprise an amino acid sequence 80, 81, 82, 83, 84, 85, 86, 87, 88, 89, 90, 91, 92, 93, 94, 95, 96, 97, 98 or 99% identical to SEQ ID NO: 379327, SEQ ID NO: 379329, SEQ ID NO: 379332, SEQ ID NO: 379334, SEQ ID NO: 379770, SEQ ID NO: 381531, SEQ ID NO: 382109, SEQ ID NO: 383301, SEQ ID NO: 383305, SEQ ID NO: 383310, SEQ ID NO: 386111, SEQ ID NO: 387057, SEQ ID NO: 387062, or SEQ ID NOs: 392434 to 410309.

In some embodiments, the amino acid sequence for a MHC class II peptide vaccine for the TYRP2 protein comprises two or more of the SEQ ID NOs: 392434 to 392455. In some embodiments, any one of the peptides in the TYRP2 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 392434 to 392455.

In some embodiments, the amino acid sequence for a MHC class II peptide vaccine for the TYRP2 protein comprises two or more of the SEQ ID NO: 379327, SEQ ID NO: 379329, SEQ ID NO: 379332, SEQ ID NO: 379334, SEQ ID NO: 379770, SEQ ID NO: 381531, SEQ ID NO: 382109, SEQ ID NO: 383301, SEQ ID NO: 383305, SEQ ID NO: 383310, SEQ ID NO: 386111, SEQ ID NO: 387057, SEQ ID NO: 387062, and SEQ ID NOs: 392434 to 410309. In some embodiments, any one of the peptides in the TYRP2 vaccine comprise an amino acid sequence 80, 81, 82, 83, 84, 85, 86, 87, 88, 89, 90, 91, 92, 93, 94, 95, 96, 97, 98 or 99% identical to SEQ ID NO: 379327, SEQ ID NO: 379329, SEQ ID NO: 379332, SEQ ID NO: 379334, SEQ ID NO: 379770, SEQ ID NO: 381531, SEQ ID NO: 382109, SEQ ID NO: 383301, SEQ ID NO: 383305, SEQ ID NO: 383310, SEQ ID NO: 386111, SEQ ID NO: 387057, SEQ ID NO: 387062, or SEQ ID NOs: 392434 to 410309.

In some embodiments, the amino acid sequence for a MHC class II peptide vaccine for the MAR1 protein comprises one or more of the SEQ ID NOs: 305566 to 305571. In some embodiments, any one of the peptides in the MAR1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 305566 to 305571.

In some embodiments, the amino acid sequence for a MHC class II peptide vaccine for the MAR1 protein comprises one or more of the SEQ ID NOs: 305566 to 307669. In some embodiments, any one of the peptides in the MAR1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 305566 to 307669.

In some embodiments, the amino acid sequence for a MHC class II peptide vaccine for the MAR1 protein comprises two or more of the SEQ ID NOs: 305566 to 305571. In some embodiments, any one of the peptides in the MAR1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 305566 to 305571.

In some embodiments, the amino acid sequence for a MHC class II peptide vaccine for the MAR1 protein comprises two or more of the SEQ ID NOs: 305566 to 307669. In some embodiments, any one of the peptides in the MAR1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 305566 to 307669.

Additional amino acid sequences of MHC class II vaccine peptides are provided in Sequence Listings (SEQ ID NOs: 22728 to 28795, SEQ ID NOs: 197911 to 203516, SEQ ID NOs: 206676 to 211900, SEQ ID NO: 211911, SEQ ID NOs: 211918 to 223622, SEQ ID NOs: 223641 to 236015, SEQ ID NOs: 236034 to 247058, SEQ ID NOs: 247094 to 281349, SEQ ID NOs: 281379 to 305565, SEQ ID NOs: 305572 to 307669, SEQ ID NOs: 317391 to 342520, SEQ ID NOs: 342556 to 369026, SEQ ID NOs: 369037 to 373347, SEQ ID NOs: 373374 to 392433, and SEQ ID NOs: 392456 to 410309). In some embodiments, any combination of MHC class II peptides disclosed herein (SEQ ID NOs: 475 to 759, SEQ ID NOs: 22728 to 28795, SEQ ID NOs: 197897 to 203516, SEQ ID NOs: 206663 to 307669, and SEQ ID NOs: 317360 to 410309) may be used to create a combined peptide vaccine having between about 2 and about 40 peptides. In some embodiments, any one of the peptides (SEQ ID NOs: 475 to 759, SEQ ID NOs: 22728 to 28795, SEQ ID NOs: 197897 to 203516, SEQ ID NOs: 206663 to 307669, and SEQ ID NOs: 317360 to 410309) in the combined vaccine comprises or contains an amino acid sequence 80, 81, 82, 83, 84, 85, 86, 87, 88, 89, 90, 91, 92, 93, 94, 95, 96, 97, 98 or 99% identical to any of SEQ ID NOs: 475 to 759, SEQ ID NOs: 22728 to 28795, SEQ ID NOs: 197897 to 203516, SEQ ID NOs: 206663 to 307669, or SEQ ID NOs: 317360 to 410309.

In some embodiments, the amino acid sequence for a MHC class I and/or MHC class II peptides may be used to create a single target (individual) or combined peptide vaccine for the CTG1B protein having between about 2 and about 40 peptides. In some embodiments, any one of the peptides in the vaccine for the CTG1B protein comprises one or more of the SEQ ID NOs: 28796 to 34168 and SEQ ID NOs: 197897 to 203516. In some embodiments, any one of the peptides in the CTG1B vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 28796 to 34168 or SEQ ID NOs: 197897 to 203516.

In some embodiments, the amino acid sequence for a MHC class I and/or MHC class II peptides may be used to create a single target (individual) or combined peptide vaccine for the MAGA1 protein having between about 2 and about 40 peptides. In some embodiments, any one of the peptides in the vaccine for the MAGA1 protein comprises one or more of the SEQ ID NOs: 41321 to 51433 and SEQ ID NOs: 211901 to 223622. In some embodiments, any one of the peptides in the MAGA1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 41321 to 51433 or SEQ ID NOs: 211901 to 223622.

In some embodiments, the amino acid sequence for a MHC class I and/or MHC class II peptides may be used to create a single target (individual) or combined peptide vaccine for the MAGA3 protein having between about 2 and about 40 peptides. In some embodiments, any one of the peptides in the vaccine for the MAGA3 protein comprises one or more of the SEQ ID NOs: 41351 to 41352, SEQ ID NO: 41383, SEQ ID NO: 41396, SEQ ID NO: 41410, SEQ ID NO: 41414, SEQ ID NO: 41435, SEQ ID NO: 41450, SEQ ID NO: 41463, SEQ ID NO: 41478, SEQ ID NO: 41489, SEQ ID NO: 41495, SEQ ID NO: 41503, SEQ ID NO: 41513, SEQ ID NO: 41520, SEQ ID NO: 41535, SEQ ID NO: 41541, SEQ ID NO: 41545, SEQ ID NO: 41577, SEQ ID NO: 41588, SEQ ID NO: 41598, SEQ ID NO: 41605, SEQ ID NO: 41617, SEQ ID NO: 41620, SEQ ID NO: 41622, SEQ ID NO: 41627, SEQ ID NO: 41630, SEQ ID NO: 41638, SEQ ID NO: 41647, SEQ ID NO: 41673, SEQ ID NO: 41696, SEQ ID NO: 41703, SEQ ID NO: 41708, SEQ ID NO: 41728, SEQ ID NOs: 41732 to 41733, SEQ ID NO: 41749, SEQ ID NO: 41760, SEQ ID NO: 41766, SEQ ID NO: 41770, SEQ ID NO: 41788, SEQ ID NO: 41791, SEQ ID NO: 41809, SEQ ID NO: 41813, SEQ ID NO: 41817, SEQ ID NO: 41829, SEQ ID NOs: 41847 to 41848, SEQ ID NO: 41853, SEQ ID NO: 41859, SEQ ID NO: 41889, SEQ ID NO: 41894, SEQ ID NO: 41897, SEQ ID NO: 41909, SEQ ID NO: 41923, SEQ ID NO: 41934, SEQ ID NO: 41939, SEQ ID NOs: 41953 to 41954, SEQ ID NO: 41959, SEQ ID NO: 41967, SEQ ID NO: 41970, SEQ ID NO: 41976, SEQ ID NOs: 41984 to 41985, SEQ ID NO: 42007, SEQ ID NO: 42017, SEQ ID NO: 42034, SEQ ID NO: 42044, SEQ ID NO: 42046, SEQ ID NO: 42048, SEQ ID NO: 42056, SEQ ID NO: 42067, SEQ ID NO: 42080, SEQ ID NO: 42088, SEQ ID NO: 42091, SEQ ID NOs: 42119 to 42120, SEQ ID NO: 42129, SEQ ID NO: 42135, SEQ ID NOs: 42140 to 42141, SEQ ID NO: 42155, SEQ ID NO: 42158, SEQ ID NO: 42164, SEQ ID NO: 42170, SEQ ID NO: 42174, SEQ ID NO: 42186, SEQ ID NO: 42209, SEQ ID NO: 42218, SEQ ID NO: 42224, SEQ ID NO: 42229, SEQ ID NO: 42232, SEQ ID NO: 42235, SEQ ID NOs: 42237 to 42238, SEQ ID NO: 42265, SEQ ID NO: 42272, SEQ ID NO: 42278, SEQ ID NO: 42293, SEQ ID NO: 42314, SEQ ID NOs: 42336 to 42337, SEQ ID NO: 42339, SEQ ID NOs: 42372 to 42373, SEQ ID NO: 42376, SEQ ID NO: 42382, SEQ ID NO: 42386, SEQ ID NO: 42408, SEQ ID NO: 42414, SEQ ID NO: 42423, SEQ ID NO: 42429, SEQ ID NOs: 42447 to 42448, SEQ ID NO: 42461, SEQ ID NO: 42466, SEQ ID NO: 42475, SEQ ID NO: 42513, SEQ ID NO: 42540, SEQ ID NO: 42545, SEQ ID NO: 42550, SEQ ID NO: 42553, SEQ ID NOs: 42567 to 42568, SEQ ID NO: 42580, SEQ ID NO: 42585, SEQ ID NO: 42605, SEQ ID NO: 42612, SEQ ID NO: 42627, SEQ ID NO: 42675, SEQ ID NO: 42680, SEQ ID NO: 42685, SEQ ID NO: 42690, SEQ ID NO: 42702, SEQ ID NO: 42711, SEQ ID NO: 42719, SEQ ID NO: 42738, SEQ ID NO: 42743, SEQ ID NO: 42750, SEQ ID NO: 42755, SEQ ID NO: 42777, SEQ ID NO: 42788, SEQ ID NO: 42793, SEQ ID NO: 42851, SEQ ID NO: 42858, SEQ ID NO: 42866, SEQ ID NO: 42903, SEQ ID NO: 42927, SEQ ID NOs: 42936 to 42937, SEQ ID NOs: 42940 to 42941, SEQ ID NO: 42957, SEQ ID NO: 42962, SEQ ID NO: 42966, SEQ ID NO: 42968, SEQ ID NO: 42986, SEQ ID NO: 43002, SEQ ID NO: 43013, SEQ ID NO: 43037, SEQ ID NO: 43052, SEQ ID NOs: 43055 to 43056, SEQ ID NOs: 43063 to 43064, SEQ ID NO: 43096, SEQ ID NO: 43133, SEQ ID NO: 43138, SEQ ID NO: 43156, SEQ ID NO: 43161, SEQ ID NO: 43186, SEQ ID NO: 43199, SEQ ID NO: 43205, SEQ ID NO: 43245, SEQ ID NO: 43251, SEQ ID NO: 43275, SEQ ID NO: 43312, SEQ ID NO: 43327, SEQ ID NO: 43333, SEQ ID NO: 43339, SEQ ID NO: 43342, SEQ ID NO: 43348, SEQ ID NO: 43365, SEQ ID NO: 43371, SEQ ID NO: 43400, SEQ ID NO: 43440, SEQ ID NO: 43451, SEQ ID NO: 43462, SEQ ID NO: 43467, SEQ ID NO: 43487, SEQ ID NOs: 43498 to 43499, SEQ ID NO: 43507, SEQ ID NO: 43522, SEQ ID NO: 43529, SEQ ID NO: 43533, SEQ ID NO: 43545, SEQ ID NO: 43558, SEQ ID NO: 43560, SEQ ID NO: 43583, SEQ ID NO: 43597, SEQ ID NO: 43599, SEQ ID NO: 43610, SEQ ID NO: 43614, SEQ ID NO: 43627, SEQ ID NO: 43697, SEQ ID NO: 43715, SEQ ID NO: 43718, SEQ ID NO: 43768, SEQ ID NO: 43777, SEQ ID NOs: 43825 to 43826, SEQ ID NO: 43836, SEQ ID NO: 43840, SEQ ID NO: 43856, SEQ ID NO: 43860, SEQ ID NO: 43870, SEQ ID NO: 43878, SEQ ID NOs: 43881 to 43882, SEQ ID NO: 43905, SEQ ID NO: 43922, SEQ ID NO: 43930, SEQ ID NO: 43943, SEQ ID NO: 43953, SEQ ID NO: 43958, SEQ ID NO: 43979, SEQ ID NO: 43986, SEQ ID NO: 44002, SEQ ID NO: 44033, SEQ ID NO: 44037, SEQ ID NO: 44048, SEQ ID NO: 44050, SEQ ID NO: 44052, SEQ ID NOs: 44080 to 44081, SEQ ID NOs: 44093 to 44094, SEQ ID NOs: 44114 to 44115, SEQ ID NO: 44120, SEQ ID NO: 44142, SEQ ID NO: 44152, SEQ ID NOs: 44164 to 44166, SEQ ID NO: 44181, SEQ ID NO: 44222, SEQ ID NO: 44244, SEQ ID NO: 44246, SEQ ID NO: 44255, SEQ ID NO: 44261, SEQ ID NO: 44276, SEQ ID NOs: 44286 to 44287, SEQ ID NO: 44296, SEQ ID NO: 44315, SEQ ID NO: 44322, SEQ ID NO: 44324, SEQ ID NO: 44328, SEQ ID NO: 44332, SEQ ID NO: 44339, SEQ ID NO: 44401, SEQ ID NO: 44413, SEQ ID NO: 44435, SEQ ID NO: 44452, SEQ ID NO: 44454, SEQ ID NO: 44463, SEQ ID NO: 44467, SEQ ID NO: 44485, SEQ ID NO: 44504, SEQ ID NO: 44512, SEQ ID NO: 44523, SEQ ID NOs: 44526 to 44527, SEQ ID NO: 44536, SEQ ID NO: 44564, SEQ ID NO: 44605, SEQ ID NO: 44607, SEQ ID NO: 44612, SEQ ID NO: 44629, SEQ ID NOs: 44635 to 44636, SEQ ID NO: 44647, SEQ ID NO: 44650, SEQ ID NO: 44674, SEQ ID NO: 44691, SEQ ID NO: 44696, SEQ ID NO: 44702, SEQ ID NO: 44710, SEQ ID NO: 44713, SEQ ID NO: 44715, SEQ ID NO: 44722, SEQ ID NO: 44730, SEQ ID NO: 44733, SEQ ID NO: 44755, SEQ ID NO: 44770, SEQ ID NO: 44773, SEQ ID NO: 44781, SEQ ID NO: 44783, SEQ ID NO: 44797, SEQ ID NO: 44805, SEQ ID NO: 44822, SEQ ID NO: 44828, SEQ ID NO: 44830, SEQ ID NO: 44832, SEQ ID NO: 44850, SEQ ID NO: 44852, SEQ ID NO: 44854, SEQ ID NO: 44860, SEQ ID NO: 44866, SEQ ID NO: 44898, SEQ ID NO: 44900, SEQ ID NO: 44907, SEQ ID NO: 44933, SEQ ID NO: 44947, SEQ ID NO: 44986, SEQ ID NO: 45003, SEQ ID NO: 45007, SEQ ID NO: 45009, SEQ ID NO: 45012, SEQ ID NO: 45016, SEQ ID NO: 45018, SEQ ID NO: 45027, SEQ ID NO: 45031, SEQ ID NO: 45036, SEQ ID NO: 45044, SEQ ID NO: 45060, SEQ ID NO: 45071, SEQ ID NO: 45077, SEQ ID NO: 45095, SEQ ID NO: 45126, SEQ ID NO: 45132, SEQ ID NO: 45135, SEQ ID NO: 45139, SEQ ID NO: 45143, SEQ ID NO: 45159, SEQ ID NO: 45177, SEQ ID NO: 45197, SEQ ID NO: 45200, SEQ ID NO: 45219, SEQ ID NO: 45228, SEQ ID NO: 45323, SEQ ID NO: 45329, SEQ ID NO: 45351, SEQ ID NO: 45378, SEQ ID NO: 45380, SEQ ID NO: 45389, SEQ ID NO: 45413, SEQ ID NO: 45417, SEQ ID NO: 45438, SEQ ID NO: 45455, SEQ ID NO: 45457, SEQ ID NO: 45467, SEQ ID NO: 45478, SEQ ID NO: 45530, SEQ ID NO: 45562, SEQ ID NO: 45565, SEQ ID NOs: 45583 to 45584, SEQ ID NOs: 45595 to 45596, SEQ ID NO: 45608, SEQ ID NO: 45612, SEQ ID NO: 45616, SEQ ID NO: 45627, SEQ ID NO: 45653, SEQ ID NOs: 45666 to 45667, SEQ ID NO: 45680, SEQ ID NO: 45697, SEQ ID NO: 45705, SEQ ID NO: 45710, SEQ ID NO: 45722, SEQ ID NO: 45736, SEQ ID NO: 45742, SEQ ID NO: 45746, SEQ ID NO: 45765, SEQ ID NO: 45808, SEQ ID NO: 45830, SEQ ID NOs: 45840 to 45841, SEQ ID NO: 45896, SEQ ID NOs: 45904 to 45905, SEQ ID NO: 45913, SEQ ID NO: 45915, SEQ ID NOs: 45940 to 45943, SEQ ID NO: 45945, SEQ ID NOs: 45958 to 45959, SEQ ID NO: 45977, SEQ ID NO: 45983, SEQ ID NO: 45992, SEQ ID NO: 46006, SEQ ID NO: 46012, SEQ ID NO: 46018, SEQ ID NO: 46021, SEQ ID NOs: 46037 to 46038, SEQ ID NO: 46044, SEQ ID NO: 46058, SEQ ID NO: 46071, SEQ ID NO: 46082, SEQ ID NO: 46094, SEQ ID NO: 46096, SEQ ID NO: 46102, SEQ ID NOs: 46108 to 46109, SEQ ID NO: 46122, SEQ ID NO: 46125, SEQ ID NOs: 46133 to 46134, SEQ ID NO: 46146, SEQ ID NO: 46159, SEQ ID NO: 46177, SEQ ID NO: 46182, SEQ ID NO: 46188, SEQ ID NO: 46202, SEQ ID NO: 46219, SEQ ID NO: 46246, SEQ ID NO: 46249, SEQ ID NO: 46270, SEQ ID NO: 46279, SEQ ID NO: 46312, SEQ ID NO: 46339, SEQ ID NO: 46378, SEQ ID NO: 46433, SEQ ID NO: 46442, SEQ ID NO: 46446, SEQ ID NO: 46452, SEQ ID NO: 46454, SEQ ID NO: 46457, SEQ ID NO: 46478, SEQ ID NO: 46484, SEQ ID NO: 46486, SEQ ID NO: 46491, SEQ ID NO: 46506, SEQ ID NO: 46512, SEQ ID NO: 46517, SEQ ID NO: 46530, SEQ ID NO: 46534, SEQ ID NO: 46556, SEQ ID NO: 46560, SEQ ID NO: 46564, SEQ ID NO: 46596, SEQ ID NO: 46602, SEQ ID NO: 46616, SEQ ID NO: 46635, SEQ ID NO: 46656, SEQ ID NO: 46658, SEQ ID NO: 46666, SEQ ID NO: 46676, SEQ ID NO: 46679, SEQ ID NO: 46689, SEQ ID NO: 46705, SEQ ID NO: 46724, SEQ ID NO: 46738, SEQ ID NO: 46767, SEQ ID NO: 46770, SEQ ID NO: 46794, SEQ ID NO: 46810, SEQ ID NO: 46819, SEQ ID NO: 46824, SEQ ID NO: 46831, SEQ ID NO: 46849, SEQ ID NO: 46854, SEQ ID NO: 46870, SEQ ID NO: 46880, SEQ ID NO: 46916, SEQ ID NO: 46935, SEQ ID NO: 46939, SEQ ID NO: 46944, SEQ ID NO: 46958, SEQ ID NO: 46964, SEQ ID NO: 46967, SEQ ID NO: 46978, SEQ ID NO: 46987, SEQ ID NO: 46989, SEQ ID NO: 46991, SEQ ID NO: 46993, SEQ ID NO: 47007, SEQ ID NO: 47034, SEQ ID NO: 47037, SEQ ID NO: 47047, SEQ ID NO: 47057, SEQ ID NO: 47066, SEQ ID NO: 47096, SEQ ID NO: 47098, SEQ ID NO: 47119, SEQ ID NO: 47123, SEQ ID NO: 47137, SEQ ID NO: 47139, SEQ ID NO: 47143, SEQ ID NO: 47150, SEQ ID NO: 47158, SEQ ID NO: 47161, SEQ ID NO: 47170, SEQ ID NO: 47181, SEQ ID NO: 47197, SEQ ID NO: 47209, SEQ ID NO: 47254, SEQ ID NO: 47266, SEQ ID NO: 47272, SEQ ID NO: 47291, SEQ ID NO: 47298, SEQ ID NO: 47300, SEQ ID NO: 47319, SEQ ID NO: 47324, SEQ ID NOs: 47331 to 47332, SEQ ID NO: 47358, SEQ ID NO: 47361, SEQ ID NO: 47393, SEQ ID NO: 47414, SEQ ID NO: 47416, SEQ ID NO: 47422, SEQ ID NO: 47425, SEQ ID NOs: 47432 to 47433, SEQ ID NO: 47445, SEQ ID NO: 47453, SEQ ID NOs: 47460 to 47461, SEQ ID NO: 47477, SEQ ID NO: 47492, SEQ ID NO: 47507, SEQ ID NO: 47509, SEQ ID NO: 47516, SEQ ID NO: 47535, SEQ ID NOs: 47556 to 47557, SEQ ID NOs: 47578 to 47579, SEQ ID NOs: 47591 to 47592, SEQ ID NO: 47597, SEQ ID NO: 47600, SEQ ID NO: 47614, SEQ ID NO: 47626, SEQ ID NO: 47629, SEQ ID NO: 47637, SEQ ID NO: 47639, SEQ ID NO: 47649, SEQ ID NOs: 47689 to 47690, SEQ ID NO: 47713, SEQ ID NO: 47766, SEQ ID NOs: 47814 to 47815, SEQ ID NO: 47827, SEQ ID NO: 47834, SEQ ID NOs: 47852 to 47853, SEQ ID NO: 47855, SEQ ID NO: 47871, SEQ ID NOs: 47875 to 47876, SEQ ID NO: 47891, SEQ ID NO: 47896, SEQ ID NO: 47902, SEQ ID NO: 47923, SEQ ID NO: 47925, SEQ ID NO: 47927, SEQ ID NO: 47929, SEQ ID NO: 47932, SEQ ID NOs: 47962 to 47964, SEQ ID NO: 47972, SEQ ID NO: 47999, SEQ ID NO: 48008, SEQ ID NO: 48028, SEQ ID NOs: 48034 to 48035, SEQ ID NO: 48038, SEQ ID NO: 48056, SEQ ID NO: 48061, SEQ ID NO: 48066, SEQ ID NO: 48118, SEQ ID NO: 48120, SEQ ID NO: 48129, SEQ ID NO: 48140, SEQ ID NO: 48148, SEQ ID NO: 48153, SEQ ID NOs: 48159 to 48160, SEQ ID NO: 48163, SEQ ID NO: 48167, SEQ ID NO: 48178, SEQ ID NO: 48180, SEQ ID NO: 48186, SEQ ID NO: 48218, SEQ ID NO: 48220, SEQ ID NO: 48263, SEQ ID NO: 48286, SEQ ID NO: 48300, SEQ ID NO: 48307, SEQ ID NO: 48315, SEQ ID NO: 48321, SEQ ID NO: 48338, SEQ ID NO: 48341, SEQ ID NO: 48343, SEQ ID NO: 48358, SEQ ID NO: 48362, SEQ ID NO: 48366, SEQ ID NO: 48368, SEQ ID NO: 48418, SEQ ID NO: 48431, SEQ ID NO: 48436, SEQ ID NOs: 48438 to 48439, SEQ ID NOs: 48443 to 48444, SEQ ID NO: 48450, SEQ ID NOs: 48452 to 48453, SEQ ID NO: 48458, SEQ ID NOs: 48461 to 48462, SEQ ID NO: 48507, SEQ ID NO: 48516, SEQ ID NO: 48527, SEQ ID NO: 48537, SEQ ID NO: 48548, SEQ ID NO: 48567, SEQ ID NO: 48574, SEQ ID NO: 48576, SEQ ID NO: 48578, SEQ ID NO: 48594, SEQ ID NO: 48599, SEQ ID NO: 48612, SEQ ID NO: 48614, SEQ ID NO: 48623, SEQ ID NO: 48626, SEQ ID NO: 48630, SEQ ID NO: 48642, SEQ ID NO: 48648, SEQ ID NO: 48656, SEQ ID NOs: 48704 to 48705, SEQ ID NO: 48708, SEQ ID NO: 48739, SEQ ID NO: 48749, SEQ ID NO: 48752, SEQ ID NO: 48754, SEQ ID NO: 48756, SEQ ID NO: 48802, SEQ ID NO: 48832, SEQ ID NO: 48845, SEQ ID NO: 48850, SEQ ID NO: 48852, SEQ ID NO: 48856, SEQ ID NO: 48870, SEQ ID NO: 48888, SEQ ID NO: 48902, SEQ ID NO: 48904, SEQ ID NOs: 48912 to 48913, SEQ ID NO: 48921, SEQ ID NO: 48970, SEQ ID NO: 48974, SEQ ID NO: 48993, SEQ ID NO: 48997, SEQ ID NO: 49004, SEQ ID NO: 49019, SEQ ID NO: 49025, SEQ ID NOs: 49045 to 49046, SEQ ID NO: 49052, SEQ ID NO: 49083, SEQ ID NO: 49086, SEQ ID NOs: 49091 to 49092, SEQ ID NO: 49102, SEQ ID NO: 49106, SEQ ID NO: 49111, SEQ ID NO: 49127, SEQ ID NO: 49152, SEQ ID NO: 49159, SEQ ID NO: 49173, SEQ ID NO: 49197, SEQ ID NO: 49201, SEQ ID NO: 49203, SEQ ID NO: 49207, SEQ ID NO: 49220, SEQ ID NO: 49227, SEQ ID NO: 49230, SEQ ID NO: 49234, SEQ ID NO: 49242, SEQ ID NO: 49256, SEQ ID NO: 49263, SEQ ID NOs: 49273 to 49274, SEQ ID NO: 49278, SEQ ID NO: 49280, SEQ ID NO: 49288, SEQ ID NO: 49290, SEQ ID NOs: 49294 to 49295, SEQ ID NO: 49326, SEQ ID NO: 49362, SEQ ID NOs: 49384 to 49385, SEQ ID NO: 49387, SEQ ID NO: 49393, SEQ ID NO: 49395, SEQ ID NOs: 49427 to 49428, SEQ ID NO: 49444, SEQ ID NO: 49458, SEQ ID NO: 49483, SEQ ID NO: 49487, SEQ ID NO: 49497, SEQ ID NO: 49501, SEQ ID NO: 49517, SEQ ID NO: 49525, SEQ ID NO: 49535, SEQ ID NO: 49537, SEQ ID NO: 49544, SEQ ID NO: 49557, SEQ ID NO: 49569, SEQ ID NO: 49572, SEQ ID NO: 49587, SEQ ID NO: 49594, SEQ ID NO: 49596, SEQ ID NO: 49598, SEQ ID NO: 49606, SEQ ID NO: 49617, SEQ ID NO: 49629, SEQ ID NO: 49646, SEQ ID NO: 49658, SEQ ID NO: 49693, SEQ ID NOs: 49702 to 49703, SEQ ID NO: 49710, SEQ ID NO: 49712, SEQ ID NO: 49719, SEQ ID NO: 49727, SEQ ID NO: 49737, SEQ ID NO: 49740, SEQ ID NO: 49743, SEQ ID NO: 49767, SEQ ID NO: 49778, SEQ ID NO: 49788, SEQ ID NO: 49811, SEQ ID NO: 49848, SEQ ID NO: 49860, SEQ ID NO: 49888, SEQ ID NO: 49908, SEQ ID NO: 49973, SEQ ID NO: 49977, SEQ ID NO: 49980, SEQ ID NOs: 49996 to 49997, SEQ ID NO: 50000, SEQ ID NO: 50012, SEQ ID NOs: 50017 to 50018, SEQ ID NO: 50051, SEQ ID NO: 50056, SEQ ID NO: 50062, SEQ ID NO: 50090, SEQ ID NO: 50093, SEQ ID NO: 50107, SEQ ID NO: 50129, SEQ ID NO: 50132, SEQ ID NO: 50138, SEQ ID NO: 50144, SEQ ID NO: 50167, SEQ ID NO: 50191, SEQ ID NO: 50194, SEQ ID NO: 50196, SEQ ID NO: 50228, SEQ ID NO: 50239, SEQ ID NO: 50263, SEQ ID NO: 50271, SEQ ID NO: 50297, SEQ ID NO: 50305, SEQ ID NO: 50320, SEQ ID NO: 50322, SEQ ID NO: 50326, SEQ ID NO: 50334, SEQ ID NO: 50349, SEQ ID NO: 50375, SEQ ID NO: 50394, SEQ ID NO: 50401, SEQ ID NO: 50414, SEQ ID NO: 50421, SEQ ID NO: 50423, SEQ ID NO: 50435, SEQ ID NOs: 50440 to 50441, SEQ ID NO: 50443, SEQ ID NO: 50510, SEQ ID NO: 50556, SEQ ID NO: 50564, SEQ ID NO: 50591, SEQ ID NO: 50605, SEQ ID NO: 50607, SEQ ID NO: 50611, SEQ ID NO: 50622, SEQ ID NO: 50625, SEQ ID NO: 50627, SEQ ID NO: 50632, SEQ ID NO: 50644, SEQ ID NOs: 50652 to 50653, SEQ ID NOs: 50668 to 50669, SEQ ID NO: 50677, SEQ ID NO: 50696, SEQ ID NO: 50699, SEQ ID NO: 50705, SEQ ID NO: 50709, SEQ ID NO: 50711, SEQ ID NO: 50729, SEQ ID NO: 50731, SEQ ID NO: 50741, SEQ ID NO: 50743, SEQ ID NO: 50748, SEQ ID NO: 50762, SEQ ID NO: 50765, SEQ ID NO: 50767, SEQ ID NO: 50800, SEQ ID NO: 50803, SEQ ID NO: 50807, SEQ ID NO: 50841, SEQ ID NO: 50865, SEQ ID NO: 50872, SEQ ID NO: 50905, SEQ ID NOs: 50955 to 50956, SEQ ID NOs: 50975 to 50977, SEQ ID NO: 50986, SEQ ID NO: 51021, SEQ ID NOs: 51039 to 51040, SEQ ID NOs: 51066 to 51068, SEQ ID NO: 51084, SEQ ID NOs: 51099 to 51100, SEQ ID NOs: 51165 to 51167, SEQ ID NO: 51169, SEQ ID NO: 51190, SEQ ID NOs: 51194 to 51198, SEQ ID NOs: 51267 to 51270, SEQ ID NOs: 51281 to 51282, SEQ ID NO: 51324, SEQ ID NO: 51349, SEQ ID NO: 51379, SEQ ID NOs: 51413 to 51415, SEQ ID NOs: 51420 to 51421, SEQ ID NOs: 51434 to 60455, SEQ ID NOs: 212187 to 212190, SEQ ID NOs: 212668 to 212673, SEQ ID NOs: 212836 to 212837, SEQ ID NOs: 213320 to 213323, SEQ ID NO: 213359, SEQ ID NOs: 213380 to 213382, SEQ ID NOs: 213391 to 213395, SEQ ID NO: 213432, SEQ ID NOs: 214285 to 214290, SEQ ID NOs: 215204 to 215205, SEQ ID NOs: 215677 to 215682, SEQ ID NO: 216240, SEQ ID NO: 216385, SEQ ID NO: 216393, SEQ ID NO: 216397, SEQ ID NOs: 217119 to 217137, SEQ ID NO: 217185, SEQ ID NO: 217187, SEQ ID NO: 217190, SEQ ID NOs: 217659 to 217660, SEQ ID NOs: 219238 to 219245, SEQ ID NOs: 219322 to 219323, SEQ ID NOs: 219380 to 219386, SEQ ID NOs: 219432 to 219446, SEQ ID NOs: 219545 to 219546, SEQ ID NO: 219774, SEQ ID NO: 219777, SEQ ID NO: 220091, SEQ ID NOs: 221996 to 222005, SEQ ID NO: 223185, SEQ ID NO: 223187, SEQ ID NO: 223251, SEQ ID NO: 223253, SEQ ID NO: 223258, SEQ ID NO: 223261, SEQ ID NO: 223264, SEQ ID NO: 223268, SEQ ID NO: 223272, SEQ ID NO: 223274, SEQ ID NO: 223277, and SEQ ID NOs: 223623 to 236015. In some embodiments, any one of the peptides in the MAGA3 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 41351 to 41352, SEQ ID NO: 41383, SEQ ID NO: 41396, SEQ ID NO: 41410, SEQ ID NO: 41414, SEQ ID NO: 41435, SEQ ID NO: 41450, SEQ ID NO: 41463, SEQ ID NO: 41478, SEQ ID NO: 41489, SEQ ID NO: 41495, SEQ ID NO: 41503, SEQ ID NO: 41513, SEQ ID NO: 41520, SEQ ID NO: 41535, SEQ ID NO: 41541, SEQ ID NO: 41545, SEQ ID NO: 41577, SEQ ID NO: 41588, SEQ ID NO: 41598, SEQ ID NO: 41605, SEQ ID NO: 41617, SEQ ID NO: 41620, SEQ ID NO: 41622, SEQ ID NO: 41627, SEQ ID NO: 41630, SEQ ID NO: 41638, SEQ ID NO: 41647, SEQ ID NO: 41673, SEQ ID NO: 41696, SEQ ID NO: 41703, SEQ ID NO: 41708, SEQ ID NO: 41728, SEQ ID NOs: 41732 to 41733, SEQ ID NO: 41749, SEQ ID NO: 41760, SEQ ID NO: 41766, SEQ ID NO: 41770, SEQ ID NO: 41788, SEQ ID NO: 41791, SEQ ID NO: 41809, SEQ ID NO: 41813, SEQ ID NO: 41817, SEQ ID NO: 41829, SEQ ID NOs: 41847 to 41848, SEQ ID NO: 41853, SEQ ID NO: 41859, SEQ ID NO: 41889, SEQ ID NO: 41894, SEQ ID NO: 41897, SEQ ID NO: 41909, SEQ ID NO: 41923, SEQ ID NO: 41934, SEQ ID NO: 41939, SEQ ID NOs: 41953 to 41954, SEQ ID NO: 41959, SEQ ID NO: 41967, SEQ ID NO: 41970, SEQ ID NO: 41976, SEQ ID NOs: 41984 to 41985, SEQ ID NO: 42007, SEQ ID NO: 42017, SEQ ID NO: 42034, SEQ ID NO: 42044, SEQ ID NO: 42046, SEQ ID NO: 42048, SEQ ID NO: 42056, SEQ ID NO: 42067, SEQ ID NO: 42080, SEQ ID NO: 42088, SEQ ID NO: 42091, SEQ ID NOs: 42119 to 42120, SEQ ID NO: 42129, SEQ ID NO: 42135, SEQ ID NOs: 42140 to 42141, SEQ ID NO: 42155, SEQ ID NO: 42158, SEQ ID NO: 42164, SEQ ID NO: 42170, SEQ ID NO: 42174, SEQ ID NO: 42186, SEQ ID NO: 42209, SEQ ID NO: 42218, SEQ ID NO: 42224, SEQ ID NO: 42229, SEQ ID NO: 42232, SEQ ID NO: 42235, SEQ ID NOs: 42237 to 42238, SEQ ID NO: 42265, SEQ ID NO: 42272, SEQ ID NO: 42278, SEQ ID NO: 42293, SEQ ID NO: 42314, SEQ ID NOs: 42336 to 42337, SEQ ID NO: 42339, SEQ ID NOs: 42372 to 42373, SEQ ID NO: 42376, SEQ ID NO: 42382, SEQ ID NO: 42386, SEQ ID NO: 42408, SEQ ID NO: 42414, SEQ ID NO: 42423, SEQ ID NO: 42429, SEQ ID NOs: 42447 to 42448, SEQ ID NO: 42461, SEQ ID NO: 42466, SEQ ID NO: 42475, SEQ ID NO: 42513, SEQ ID NO: 42540, SEQ ID NO: 42545, SEQ ID NO: 42550, SEQ ID NO: 42553, SEQ ID NOs: 42567 to 42568, SEQ ID NO: 42580, SEQ ID NO: 42585, SEQ ID NO: 42605, SEQ ID NO: 42612, SEQ ID NO: 42627, SEQ ID NO: 42675, SEQ ID NO: 42680, SEQ ID NO: 42685, SEQ ID NO: 42690, SEQ ID NO: 42702, SEQ ID NO: 42711, SEQ ID NO: 42719, SEQ ID NO: 42738, SEQ ID NO: 42743, SEQ ID NO: 42750, SEQ ID NO: 42755, SEQ ID NO: 42777, SEQ ID NO: 42788, SEQ ID NO: 42793, SEQ ID NO: 42851, SEQ ID NO: 42858, SEQ ID NO: 42866, SEQ ID NO: 42903, SEQ ID NO: 42927, SEQ ID NOs: 42936 to 42937, SEQ ID NOs: 42940 to 42941, SEQ ID NO: 42957, SEQ ID NO: 42962, SEQ ID NO: 42966, SEQ ID NO: 42968, SEQ ID NO: 42986, SEQ ID NO: 43002, SEQ ID NO: 43013, SEQ ID NO: 43037, SEQ ID NO: 43052, SEQ ID NOs: 43055 to 43056, SEQ ID NOs: 43063 to 43064, SEQ ID NO: 43096, SEQ ID NO: 43133, SEQ ID NO: 43138, SEQ ID NO: 43156, SEQ ID NO: 43161, SEQ ID NO: 43186, SEQ ID NO: 43199, SEQ ID NO: 43205, SEQ ID NO: 43245, SEQ ID NO: 43251, SEQ ID NO: 43275, SEQ ID NO: 43312, SEQ ID NO: 43327, SEQ ID NO: 43333, SEQ ID NO: 43339, SEQ ID NO: 43342, SEQ ID NO: 43348, SEQ ID NO: 43365, SEQ ID NO: 43371, SEQ ID NO: 43400, SEQ ID NO: 43440, SEQ ID NO: 43451, SEQ ID NO: 43462, SEQ ID NO: 43467, SEQ ID NO: 43487, SEQ ID NOs: 43498 to 43499, SEQ ID NO: 43507, SEQ ID NO: 43522, SEQ ID NO: 43529, SEQ ID NO: 43533, SEQ ID NO: 43545, SEQ ID NO: 43558, SEQ ID NO: 43560, SEQ ID NO: 43583, SEQ ID NO: 43597, SEQ ID NO: 43599, SEQ ID NO: 43610, SEQ ID NO: 43614, SEQ ID NO: 43627, SEQ ID NO: 43697, SEQ ID NO: 43715, SEQ ID NO: 43718, SEQ ID NO: 43768, SEQ ID NO: 43777, SEQ ID NOs: 43825 to 43826, SEQ ID NO: 43836, SEQ ID NO: 43840, SEQ ID NO: 43856, SEQ ID NO: 43860, SEQ ID NO: 43870, SEQ ID NO: 43878, SEQ ID NOs: 43881 to 43882, SEQ ID NO: 43905, SEQ ID NO: 43922, SEQ ID NO: 43930, SEQ ID NO: 43943, SEQ ID NO: 43953, SEQ ID NO: 43958, SEQ ID NO: 43979, SEQ ID NO: 43986, SEQ ID NO: 44002, SEQ ID NO: 44033, SEQ ID NO: 44037, SEQ ID NO: 44048, SEQ ID NO: 44050, SEQ ID NO: 44052, SEQ ID NOs: 44080 to 44081, SEQ ID NOs: 44093 to 44094, SEQ ID NOs: 44114 to 44115, SEQ ID NO: 44120, SEQ ID NO: 44142, SEQ ID NO: 44152, SEQ ID NOs: 44164 to 44166, SEQ ID NO: 44181, SEQ ID NO: 44222, SEQ ID NO: 44244, SEQ ID NO: 44246, SEQ ID NO: 44255, SEQ ID NO: 44261, SEQ ID NO: 44276, SEQ ID NOs: 44286 to 44287, SEQ ID NO: 44296, SEQ ID NO: 44315, SEQ ID NO: 44322, SEQ ID NO: 44324, SEQ ID NO: 44328, SEQ ID NO: 44332, SEQ ID NO: 44339, SEQ ID NO: 44401, SEQ ID NO: 44413, SEQ ID NO: 44435, SEQ ID NO: 44452, SEQ ID NO: 44454, SEQ ID NO: 44463, SEQ ID NO: 44467, SEQ ID NO: 44485, SEQ ID NO: 44504, SEQ ID NO: 44512, SEQ ID NO: 44523, SEQ ID NOs: 44526 to 44527, SEQ ID NO: 44536, SEQ ID NO: 44564, SEQ ID NO: 44605, SEQ ID NO: 44607, SEQ ID NO: 44612, SEQ ID NO: 44629, SEQ ID NOs: 44635 to 44636, SEQ ID NO: 44647, SEQ ID NO: 44650, SEQ ID NO: 44674, SEQ ID NO: 44691, SEQ ID NO: 44696, SEQ ID NO: 44702, SEQ ID NO: 44710, SEQ ID NO: 44713, SEQ ID NO: 44715, SEQ ID NO: 44722, SEQ ID NO: 44730, SEQ ID NO: 44733, SEQ ID NO: 44755, SEQ ID NO: 44770, SEQ ID NO: 44773, SEQ ID NO: 44781, SEQ ID NO: 44783, SEQ ID NO: 44797, SEQ ID NO: 44805, SEQ ID NO: 44822, SEQ ID NO: 44828, SEQ ID NO: 44830, SEQ ID NO: 44832, SEQ ID NO: 44850, SEQ ID NO: 44852, SEQ ID NO: 44854, SEQ ID NO: 44860, SEQ ID NO: 44866, SEQ ID NO: 44898, SEQ ID NO: 44900, SEQ ID NO: 44907, SEQ ID NO: 44933, SEQ ID NO: 44947, SEQ ID NO: 44986, SEQ ID NO: 45003, SEQ ID NO: 45007, SEQ ID NO: 45009, SEQ ID NO: 45012, SEQ ID NO: 45016, SEQ ID NO: 45018, SEQ ID NO: 45027, SEQ ID NO: 45031, SEQ ID NO: 45036, SEQ ID NO: 45044, SEQ ID NO: 45060, SEQ ID NO: 45071, SEQ ID NO: 45077, SEQ ID NO: 45095, SEQ ID NO: 45126, SEQ ID NO: 45132, SEQ ID NO: 45135, SEQ ID NO: 45139, SEQ ID NO: 45143, SEQ ID NO: 45159, SEQ ID NO: 45177, SEQ ID NO: 45197, SEQ ID NO: 45200, SEQ ID NO: 45219, SEQ ID NO: 45228, SEQ ID NO: 45323, SEQ ID NO: 45329, SEQ ID NO: 45351, SEQ ID NO: 45378, SEQ ID NO: 45380, SEQ ID NO: 45389, SEQ ID NO: 45413, SEQ ID NO: 45417, SEQ ID NO: 45438, SEQ ID NO: 45455, SEQ ID NO: 45457, SEQ ID NO: 45467, SEQ ID NO: 45478, SEQ ID NO: 45530, SEQ ID NO: 45562, SEQ ID NO: 45565, SEQ ID NOs: 45583 to 45584, SEQ ID NOs: 45595 to 45596, SEQ ID NO: 45608, SEQ ID NO: 45612, SEQ ID NO: 45616, SEQ ID NO: 45627, SEQ ID NO: 45653, SEQ ID NOs: 45666 to 45667, SEQ ID NO: 45680, SEQ ID NO: 45697, SEQ ID NO: 45705, SEQ ID NO: 45710, SEQ ID NO: 45722, SEQ ID NO: 45736, SEQ ID NO: 45742, SEQ ID NO: 45746, SEQ ID NO: 45765, SEQ ID NO: 45808, SEQ ID NO: 45830, SEQ ID NOs: 45840 to 45841, SEQ ID NO: 45896, SEQ ID NOs: 45904 to 45905, SEQ ID NO: 45913, SEQ ID NO: 45915, SEQ ID NOs: 45940 to 45943, SEQ ID NO: 45945, SEQ ID NOs: 45958 to 45959, SEQ ID NO: 45977, SEQ ID NO: 45983, SEQ ID NO: 45992, SEQ ID NO: 46006, SEQ ID NO: 46012, SEQ ID NO: 46018, SEQ ID NO: 46021, SEQ ID NOs: 46037 to 46038, SEQ ID NO: 46044, SEQ ID NO: 46058, SEQ ID NO: 46071, SEQ ID NO: 46082, SEQ ID NO: 46094, SEQ ID NO: 46096, SEQ ID NO: 46102, SEQ ID NOs: 46108 to 46109, SEQ ID NO: 46122, SEQ ID NO: 46125, SEQ ID NOs: 46133 to 46134, SEQ ID NO: 46146, SEQ ID NO: 46159, SEQ ID NO: 46177, SEQ ID NO: 46182, SEQ ID NO: 46188, SEQ ID NO: 46202, SEQ ID NO: 46219, SEQ ID NO: 46246, SEQ ID NO: 46249, SEQ ID NO: 46270, SEQ ID NO: 46279, SEQ ID NO: 46312, SEQ ID NO: 46339, SEQ ID NO: 46378, SEQ ID NO: 46433, SEQ ID NO: 46442, SEQ ID NO: 46446, SEQ ID NO: 46452, SEQ ID NO: 46454, SEQ ID NO: 46457, SEQ ID NO: 46478, SEQ ID NO: 46484, SEQ ID NO: 46486, SEQ ID NO: 46491, SEQ ID NO: 46506, SEQ ID NO: 46512, SEQ ID NO: 46517, SEQ ID NO: 46530, SEQ ID NO: 46534, SEQ ID NO: 46556, SEQ ID NO: 46560, SEQ ID NO: 46564, SEQ ID NO: 46596, SEQ ID NO: 46602, SEQ ID NO: 46616, SEQ ID NO: 46635, SEQ ID NO: 46656, SEQ ID NO: 46658, SEQ ID NO: 46666, SEQ ID NO: 46676, SEQ ID NO: 46679, SEQ ID NO: 46689, SEQ ID NO: 46705, SEQ ID NO: 46724, SEQ ID NO: 46738, SEQ ID NO: 46767, SEQ ID NO: 46770, SEQ ID NO: 46794, SEQ ID NO: 46810, SEQ ID NO: 46819, SEQ ID NO: 46824, SEQ ID NO: 46831, SEQ ID NO: 46849, SEQ ID NO: 46854, SEQ ID NO: 46870, SEQ ID NO: 46880, SEQ ID NO: 46916, SEQ ID NO: 46935, SEQ ID NO: 46939, SEQ ID NO: 46944, SEQ ID NO: 46958, SEQ ID NO: 46964, SEQ ID NO: 46967, SEQ ID NO: 46978, SEQ ID NO: 46987, SEQ ID NO: 46989, SEQ ID NO: 46991, SEQ ID NO: 46993, SEQ ID NO: 47007, SEQ ID NO: 47034, SEQ ID NO: 47037, SEQ ID NO: 47047, SEQ ID NO: 47057, SEQ ID NO: 47066, SEQ ID NO: 47096, SEQ ID NO: 47098, SEQ ID NO: 47119, SEQ ID NO: 47123, SEQ ID NO: 47137, SEQ ID NO: 47139, SEQ ID NO: 47143, SEQ ID NO: 47150, SEQ ID NO: 47158, SEQ ID NO: 47161, SEQ ID NO: 47170, SEQ ID NO: 47181, SEQ ID NO: 47197, SEQ ID NO: 47209, SEQ ID NO: 47254, SEQ ID NO: 47266, SEQ ID NO: 47272, SEQ ID NO: 47291, SEQ ID NO: 47298, SEQ ID NO: 47300, SEQ ID NO: 47319, SEQ ID NO: 47324, SEQ ID NOs: 47331 to 47332, SEQ ID NO: 47358, SEQ ID NO: 47361, SEQ ID NO: 47393, SEQ ID NO: 47414, SEQ ID NO: 47416, SEQ ID NO: 47422, SEQ ID NO: 47425, SEQ ID NOs: 47432 to 47433, SEQ ID NO: 47445, SEQ ID NO: 47453, SEQ ID NOs: 47460 to 47461, SEQ ID NO: 47477, SEQ ID NO: 47492, SEQ ID NO: 47507, SEQ ID NO: 47509, SEQ ID NO: 47516, SEQ ID NO: 47535, SEQ ID NOs: 47556 to 47557, SEQ ID NOs: 47578 to 47579, SEQ ID NOs: 47591 to 47592, SEQ ID NO: 47597, SEQ ID NO: 47600, SEQ ID NO: 47614, SEQ ID NO: 47626, SEQ ID NO: 47629, SEQ ID NO: 47637, SEQ ID NO: 47639, SEQ ID NO: 47649, SEQ ID NOs: 47689 to 47690, SEQ ID NO: 47713, SEQ ID NO: 47766, SEQ ID NOs: 47814 to 47815, SEQ ID NO: 47827, SEQ ID NO: 47834, SEQ ID NOs: 47852 to 47853, SEQ ID NO: 47855, SEQ ID NO: 47871, SEQ ID NOs: 47875 to 47876, SEQ ID NO: 47891, SEQ ID NO: 47896, SEQ ID NO: 47902, SEQ ID NO: 47923, SEQ ID NO: 47925, SEQ ID NO: 47927, SEQ ID NO: 47929, SEQ ID NO: 47932, SEQ ID NOs: 47962 to 47964, SEQ ID NO: 47972, SEQ ID NO: 47999, SEQ ID NO: 48008, SEQ ID NO: 48028, SEQ ID NOs: 48034 to 48035, SEQ ID NO: 48038, SEQ ID NO: 48056, SEQ ID NO: 48061, SEQ ID NO: 48066, SEQ ID NO: 48118, SEQ ID NO: 48120, SEQ ID NO: 48129, SEQ ID NO: 48140, SEQ ID NO: 48148, SEQ ID NO: 48153, SEQ ID NOs: 48159 to 48160, SEQ ID NO: 48163, SEQ ID NO: 48167, SEQ ID NO: 48178, SEQ ID NO: 48180, SEQ ID NO: 48186, SEQ ID NO: 48218, SEQ ID NO: 48220, SEQ ID NO: 48263, SEQ ID NO: 48286, SEQ ID NO: 48300, SEQ ID NO: 48307, SEQ ID NO: 48315, SEQ ID NO: 48321, SEQ ID NO: 48338, SEQ ID NO: 48341, SEQ ID NO: 48343, SEQ ID NO: 48358, SEQ ID NO: 48362, SEQ ID NO: 48366, SEQ ID NO: 48368, SEQ ID NO: 48418, SEQ ID NO: 48431, SEQ ID NO: 48436, SEQ ID NOs: 48438 to 48439, SEQ ID NOs: 48443 to 48444, SEQ ID NO: 48450, SEQ ID NOs: 48452 to 48453, SEQ ID NO: 48458, SEQ ID NOs: 48461 to 48462, SEQ ID NO: 48507, SEQ ID NO: 48516, SEQ ID NO: 48527, SEQ ID NO: 48537, SEQ ID NO: 48548, SEQ ID NO: 48567, SEQ ID NO: 48574, SEQ ID NO: 48576, SEQ ID NO: 48578, SEQ ID NO: 48594, SEQ ID NO: 48599, SEQ ID NO: 48612, SEQ ID NO: 48614, SEQ ID NO: 48623, SEQ ID NO: 48626, SEQ ID NO: 48630, SEQ ID NO: 48642, SEQ ID NO: 48648, SEQ ID NO: 48656, SEQ ID NOs: 48704 to 48705, SEQ ID NO: 48708, SEQ ID NO: 48739, SEQ ID NO: 48749, SEQ ID NO: 48752, SEQ ID NO: 48754, SEQ ID NO: 48756, SEQ ID NO: 48802, SEQ ID NO: 48832, SEQ ID NO: 48845, SEQ ID NO: 48850, SEQ ID NO: 48852, SEQ ID NO: 48856, SEQ ID NO: 48870, SEQ ID NO: 48888, SEQ ID NO: 48902, SEQ ID NO: 48904, SEQ ID NOs: 48912 to 48913, SEQ ID NO: 48921, SEQ ID NO: 48970, SEQ ID NO: 48974, SEQ ID NO: 48993, SEQ ID NO: 48997, SEQ ID NO: 49004, SEQ ID NO: 49019, SEQ ID NO: 49025, SEQ ID NOs: 49045 to 49046, SEQ ID NO: 49052, SEQ ID NO: 49083, SEQ ID NO: 49086, SEQ ID NOs: 49091 to 49092, SEQ ID NO: 49102, SEQ ID NO: 49106, SEQ ID NO: 49111, SEQ ID NO: 49127, SEQ ID NO: 49152, SEQ ID NO: 49159, SEQ ID NO: 49173, SEQ ID NO: 49197, SEQ ID NO: 49201, SEQ ID NO: 49203, SEQ ID NO: 49207, SEQ ID NO: 49220, SEQ ID NO: 49227, SEQ ID NO: 49230, SEQ ID NO: 49234, SEQ ID NO: 49242, SEQ ID NO: 49256, SEQ ID NO: 49263, SEQ ID NOs: 49273 to 49274, SEQ ID NO: 49278, SEQ ID NO: 49280, SEQ ID NO: 49288, SEQ ID NO: 49290, SEQ ID NOs: 49294 to 49295, SEQ ID NO: 49326, SEQ ID NO: 49362, SEQ ID NOs: 49384 to 49385, SEQ ID NO: 49387, SEQ ID NO: 49393, SEQ ID NO: 49395, SEQ ID NOs: 49427 to 49428, SEQ ID NO: 49444, SEQ ID NO: 49458, SEQ ID NO: 49483, SEQ ID NO: 49487, SEQ ID NO: 49497, SEQ ID NO: 49501, SEQ ID NO: 49517, SEQ ID NO: 49525, SEQ ID NO: 49535, SEQ ID NO: 49537, SEQ ID NO: 49544, SEQ ID NO: 49557, SEQ ID NO: 49569, SEQ ID NO: 49572, SEQ ID NO: 49587, SEQ ID NO: 49594, SEQ ID NO: 49596, SEQ ID NO: 49598, SEQ ID NO: 49606, SEQ ID NO: 49617, SEQ ID NO: 49629, SEQ ID NO: 49646, SEQ ID NO: 49658, SEQ ID NO: 49693, SEQ ID NOs: 49702 to 49703, SEQ ID NO: 49710, SEQ ID NO: 49712, SEQ ID NO: 49719, SEQ ID NO: 49727, SEQ ID NO: 49737, SEQ ID NO: 49740, SEQ ID NO: 49743, SEQ ID NO: 49767, SEQ ID NO: 49778, SEQ ID NO: 49788, SEQ ID NO: 49811, SEQ ID NO: 49848, SEQ ID NO: 49860, SEQ ID NO: 49888, SEQ ID NO: 49908, SEQ ID NO: 49973, SEQ ID NO: 49977, SEQ ID NO: 49980, SEQ ID NOs: 49996 to 49997, SEQ ID NO: 50000, SEQ ID NO: 50012, SEQ ID NOs: 50017 to 50018, SEQ ID NO: 50051, SEQ ID NO: 50056, SEQ ID NO: 50062, SEQ ID NO: 50090, SEQ ID NO: 50093, SEQ ID NO: 50107, SEQ ID NO: 50129, SEQ ID NO: 50132, SEQ ID NO: 50138, SEQ ID NO: 50144, SEQ ID NO: 50167, SEQ ID NO: 50191, SEQ ID NO: 50194, SEQ ID NO: 50196, SEQ ID NO: 50228, SEQ ID NO: 50239, SEQ ID NO: 50263, SEQ ID NO: 50271, SEQ ID NO: 50297, SEQ ID NO: 50305, SEQ ID NO: 50320, SEQ ID NO: 50322, SEQ ID NO: 50326, SEQ ID NO: 50334, SEQ ID NO: 50349, SEQ ID NO: 50375, SEQ ID NO: 50394, SEQ ID NO: 50401, SEQ ID NO: 50414, SEQ ID NO: 50421, SEQ ID NO: 50423, SEQ ID NO: 50435, SEQ ID NOs: 50440 to 50441, SEQ ID NO: 50443, SEQ ID NO: 50510, SEQ ID NO: 50556, SEQ ID NO: 50564, SEQ ID NO: 50591, SEQ ID NO: 50605, SEQ ID NO: 50607, SEQ ID NO: 50611, SEQ ID NO: 50622, SEQ ID NO: 50625, SEQ ID NO: 50627, SEQ ID NO: 50632, SEQ ID NO: 50644, SEQ ID NOs: 50652 to 50653, SEQ ID NOs: 50668 to 50669, SEQ ID NO: 50677, SEQ ID NO: 50696, SEQ ID NO: 50699, SEQ ID NO: 50705, SEQ ID NO: 50709, SEQ ID NO: 50711, SEQ ID NO: 50729, SEQ ID NO: 50731, SEQ ID NO: 50741, SEQ ID NO: 50743, SEQ ID NO: 50748, SEQ ID NO: 50762, SEQ ID NO: 50765, SEQ ID NO: 50767, SEQ ID NO: 50800, SEQ ID NO: 50803, SEQ ID NO: 50807, SEQ ID NO: 50841, SEQ ID NO: 50865, SEQ ID NO: 50872, SEQ ID NO: 50905, SEQ ID NOs: 50955 to 50956, SEQ ID NOs: 50975 to 50977, SEQ ID NO: 50986, SEQ ID NO: 51021, SEQ ID NOs: 51039 to 51040, SEQ ID NOs: 51066 to 51068, SEQ ID NO: 51084, SEQ ID NOs: 51099 to 51100, SEQ ID NOs: 51165 to 51167, SEQ ID NO: 51169, SEQ ID NO: 51190, SEQ ID NOs: 51194 to 51198, SEQ ID NOs: 51267 to 51270, SEQ ID NOs: 51281 to 51282, SEQ ID NO: 51324, SEQ ID NO: 51349, SEQ ID NO: 51379, SEQ ID NOs: 51413 to 51415, SEQ ID NOs: 51420 to 51421, SEQ ID NOs: 51434 to 60455, SEQ ID NOs: 212187 to 212190, SEQ ID NOs: 212668 to 212673, SEQ ID NOs: 212836 to 212837, SEQ ID NOs: 213320 to 213323, SEQ ID NO: 213359, SEQ ID NOs: 213380 to 213382, SEQ ID NOs: 213391 to 213395, SEQ ID NO: 213432, SEQ ID NOs: 214285 to 214290, SEQ ID NOs: 215204 to 215205, SEQ ID NOs: 215677 to 215682, SEQ ID NO: 216240, SEQ ID NO: 216385, SEQ ID NO: 216393, SEQ ID NO: 216397, SEQ ID NOs: 217119 to 217137, SEQ ID NO: 217185, SEQ ID NO: 217187, SEQ ID NO: 217190, SEQ ID NOs: 217659 to 217660, SEQ ID NOs: 219238 to 219245, SEQ ID NOs: 219322 to 219323, SEQ ID NOs: 219380 to 219386, SEQ ID NOs: 219432 to 219446, SEQ ID NOs: 219545 to 219546, SEQ ID NO: 219774, SEQ ID NO: 219777, SEQ ID NO: 220091, SEQ ID NOs: 221996 to 222005, SEQ ID NO: 223185, SEQ ID NO: 223187, SEQ ID NO: 223251, SEQ ID NO: 223253, SEQ ID NO: 223258, SEQ ID NO: 223261, SEQ ID NO: 223264, SEQ ID NO: 223268, SEQ ID NO: 223272, SEQ ID NO: 223274, SEQ ID NO: 223277, or SEQ ID NOs: 223623 to 236015.

In some embodiments, the amino acid sequence for a MHC class I and/or MHC class II peptides may be used to create a single target (individual) or combined peptide vaccine for the MAGA4 protein having between about 2 and about 40 peptides. In some embodiments, any one of the peptides in the vaccine for the MAGA4 protein comprises one or more of the SEQ ID NO: 41345, SEQ ID NO: 41347, SEQ ID NO: 41352, SEQ ID NOs: 41357 to 41358, SEQ ID NO: 41366, SEQ ID NO: 41377, SEQ ID NO: 41382, SEQ ID NO: 41392, SEQ ID NO: 41396, SEQ ID NO: 41398, SEQ ID NO: 41406, SEQ ID NO: 41411, SEQ ID NO: 41414, SEQ ID NO: 41433, SEQ ID NO: 41436, SEQ ID NO: 41445, SEQ ID NO: 41449, SEQ ID NO: 41455, SEQ ID NO: 41478, SEQ ID NO: 41487, SEQ ID NOs: 41495 to 41496, SEQ ID NO: 41503, SEQ ID NO: 41515, SEQ ID NO: 41520, SEQ ID NO: 41529, SEQ ID NO: 41549, SEQ ID NO: 41553, SEQ ID NO: 41562, SEQ ID NO: 41569, SEQ ID NO: 41574, SEQ ID NO: 41576, SEQ ID NO: 41579, SEQ ID NOs: 41587 to 41588, SEQ ID NO: 41605, SEQ ID NO: 41617, SEQ ID NO: 41620, SEQ ID NO: 41634, SEQ ID NO: 41650, SEQ ID NO: 41665, SEQ ID NO: 41670, SEQ ID NO: 41672, SEQ ID NO: 41696, SEQ ID NO: 41703, SEQ ID NO: 41709, SEQ ID NO: 41725, SEQ ID NOs: 41732 to 41733, SEQ ID NO: 41748, SEQ ID NO: 41760, SEQ ID NO: 41766, SEQ ID NO: 41768, SEQ ID NO: 41770, SEQ ID NO: 41779, SEQ ID NO: 41791, SEQ ID NO: 41797, SEQ ID NO: 41813, SEQ ID NO: 41819, SEQ ID NO: 41825, SEQ ID NO: 41829, SEQ ID NOs: 41846 to 41847, SEQ ID NO: 41853, SEQ ID NO: 41876, SEQ ID NO: 41889, SEQ ID NO: 41892, SEQ ID NO: 41897, SEQ ID NOs: 41906 to 41907, SEQ ID NO: 41912, SEQ ID NO: 41924, SEQ ID NO: 41940, SEQ ID NO: 41953, SEQ ID NO: 41956, SEQ ID NO: 41967, SEQ ID NO: 41970, SEQ ID NO: 41976, SEQ ID NO: 41985, SEQ ID NO: 41990, SEQ ID NO: 42014, SEQ ID NO: 42017, SEQ ID NO: 42026, SEQ ID NO: 42034, SEQ ID NO: 42037, SEQ ID NO: 42046, SEQ ID NO: 42048, SEQ ID NOs: 42056 to 42057, SEQ ID NO: 42080, SEQ ID NO: 42088, SEQ ID NO: 42091, SEQ ID NO: 42102, SEQ ID NO: 42106, SEQ ID NO: 42115, SEQ ID NO: 42120, SEQ ID NO: 42129, SEQ ID NO: 42135, SEQ ID NO: 42138, SEQ ID NO: 42151, SEQ ID NO: 42158, SEQ ID NOs: 42163 to 42164, SEQ ID NOs: 42167 to 42168, SEQ ID NO: 42170, SEQ ID NO: 42186, SEQ ID NO: 42192, SEQ ID NO: 42195, SEQ ID NO: 42198, SEQ ID NO: 42204, SEQ ID NO: 42209, SEQ ID NO: 42218, SEQ ID NO: 42221, SEQ ID NO: 42224, SEQ ID NO: 42229, SEQ ID NO: 42240, SEQ ID NO: 42263, SEQ ID NO: 42265, SEQ ID NO: 42270, SEQ ID NO: 42316, SEQ ID NOs: 42336 to 42337, SEQ ID NO: 42339, SEQ ID NO: 42351, SEQ ID NO: 42354, SEQ ID NO: 42372, SEQ ID NO: 42378, SEQ ID NOs: 42385 to 42386, SEQ ID NO: 42394, SEQ ID NO: 42405, SEQ ID NO: 42409, SEQ ID NO: 42417, SEQ ID NO: 42423, SEQ ID NO: 42439, SEQ ID NO: 42447, SEQ ID NO: 42453, SEQ ID NO: 42458, SEQ ID NOs: 42460 to 42461, SEQ ID NO: 42466, SEQ ID NOs: 42472 to 42473, SEQ ID NOs: 42519 to 42520, SEQ ID NO: 42525, SEQ ID NO: 42528, SEQ ID NO: 42540, SEQ ID NO: 42545, SEQ ID NO: 42550, SEQ ID NOs: 42563 to 42564, SEQ ID NO: 42580, SEQ ID NO: 42605, SEQ ID NO: 42609, SEQ ID NOs: 42612 to 42613, SEQ ID NO: 42615, SEQ ID NO: 42628, SEQ ID NO: 42637, SEQ ID NO: 42648, SEQ ID NO: 42653, SEQ ID NO: 42675, SEQ ID NO: 42680, SEQ ID NO: 42685, SEQ ID NO: 42696, SEQ ID NO: 42703, SEQ ID NO: 42719, SEQ ID NO: 42735, SEQ ID NO: 42743, SEQ ID NO: 42748, SEQ ID NO: 42750, SEQ ID NO: 42768, SEQ ID NO: 42812, SEQ ID NO: 42814, SEQ ID NO: 42822, SEQ ID NO: 42827, SEQ ID NO: 42831, SEQ ID NO: 42846, SEQ ID NO: 42850, SEQ ID NO: 42872, SEQ ID NO: 42886, SEQ ID NO: 42911, SEQ ID NO: 42914, SEQ ID NO: 42923, SEQ ID NO: 42927, SEQ ID NOs: 42957 to 42958, SEQ ID NO: 42962, SEQ ID NO: 42971, SEQ ID NOs: 42997 to 42998, SEQ ID NO: 43002, SEQ ID NO: 43008, SEQ ID NO: 43035, SEQ ID NO: 43046, SEQ ID NO: 43048, SEQ ID NO: 43064, SEQ ID NO: 43083, SEQ ID NO: 43091, SEQ ID NO: 43093, SEQ ID NO: 43148, SEQ ID NO: 43160, SEQ ID NO: 43170, SEQ ID NO: 43175, SEQ ID NO: 43180, SEQ ID NO: 43186, SEQ ID NO: 43193, SEQ ID NO: 43196, SEQ ID NOs: 43231 to 43232, SEQ ID NO: 43238, SEQ ID NO: 43242, SEQ ID NO: 43248, SEQ ID NO: 43253, SEQ ID NO: 43258, SEQ ID NO: 43267, SEQ ID NO: 43274, SEQ ID NO: 43280, SEQ ID NO: 43285, SEQ ID NO: 43295, SEQ ID NO: 43308, SEQ ID NO: 43311, SEQ ID NO: 43329, SEQ ID NO: 43333, SEQ ID NOs: 43339 to 43340, SEQ ID NO: 43362, SEQ ID NO: 43365, SEQ ID NO: 43384, SEQ ID NO: 43389, SEQ ID NO: 43395, SEQ ID NO: 43401, SEQ ID NO: 43429, SEQ ID NO: 43432, SEQ ID NO: 43440, SEQ ID NOs: 43451 to 43453, SEQ ID NO: 43462, SEQ ID NO: 43464, SEQ ID NO: 43467, SEQ ID NO: 43479, SEQ ID NO: 43482, SEQ ID NO: 43496, SEQ ID NO: 43511, SEQ ID NO: 43513, SEQ ID NO: 43517, SEQ ID NO: 43545, SEQ ID NO: 43564, SEQ ID NO: 43573, SEQ ID NO: 43585, SEQ ID NO: 43587, SEQ ID NO: 43591, SEQ ID NO: 43611, SEQ ID NO: 43632, SEQ ID NO: 43636, SEQ ID NO: 43641, SEQ ID NO: 43643, SEQ ID NO: 43651, SEQ ID NO: 43669, SEQ ID NO: 43688, SEQ ID NO: 43696, SEQ ID NO: 43700, SEQ ID NO: 43703, SEQ ID NO: 43707, SEQ ID NO: 43718, SEQ ID NO: 43760, SEQ ID NO: 43763, SEQ ID NO: 43768, SEQ ID NO: 43777, SEQ ID NO: 43780, SEQ ID NO: 43787, SEQ ID NO: 43801, SEQ ID NO: 43808, SEQ ID NO: 43810, SEQ ID NO: 43825, SEQ ID NO: 43827, SEQ ID NO: 43836, SEQ ID NO: 43860, SEQ ID NO: 43867, SEQ ID NOs: 43881 to 43882, SEQ ID NO: 43884, SEQ ID NO: 43887, SEQ ID NOs: 43898 to 43899, SEQ ID NO: 43905, SEQ ID NO: 43915, SEQ ID NO: 43924, SEQ ID NO: 43932, SEQ ID NO: 43958, SEQ ID NO: 43971, SEQ ID NO: 43974, SEQ ID NO: 43978, SEQ ID NOs: 43982 to 43984, SEQ ID NOs: 43986 to 43987, SEQ ID NO: 43993, SEQ ID NO: 43995, SEQ ID NO: 44012, SEQ ID NO: 44035, SEQ ID NO: 44037, SEQ ID NO: 44048, SEQ ID NO: 44050, SEQ ID NO: 44052, SEQ ID NO: 44055, SEQ ID NO: 44063, SEQ ID NO: 44073, SEQ ID NO: 44080, SEQ ID NO: 44085, SEQ ID NO: 44087, SEQ ID NO: 44089, SEQ ID NO: 44112, SEQ ID NO: 44117, SEQ ID NO: 44123, SEQ ID NOs: 44151 to 44152, SEQ ID NO: 44160, SEQ ID NO: 44181, SEQ ID NO: 44207, SEQ ID NO: 44210, SEQ ID NO: 44244, SEQ ID NO: 44246, SEQ ID NO: 44254, SEQ ID NO: 44263, SEQ ID NOs: 44298 to 44299, SEQ ID NO: 44309, SEQ ID NO: 44324, SEQ ID NO: 44328, SEQ ID NO: 44342, SEQ ID NO: 44345, SEQ ID NO: 44359, SEQ ID NO: 44361, SEQ ID NO: 44383, SEQ ID NO: 44401, SEQ ID NO: 44422, SEQ ID NO: 44440, SEQ ID NO: 44452, SEQ ID NO: 44454, SEQ ID NO: 44456, SEQ ID NO: 44463, SEQ ID NO: 44467, SEQ ID NO: 44485, SEQ ID NO: 44512, SEQ ID NO: 44523, SEQ ID NO: 44545, SEQ ID NO: 44552, SEQ ID NO: 44564, SEQ ID NOs: 44566 to 44567, SEQ ID NOs: 44589 to 44591, SEQ ID NO: 44615, SEQ ID NO: 44623, SEQ ID NO: 44631, SEQ ID NO: 44636, SEQ ID NO: 44649, SEQ ID NO: 44654, SEQ ID NO: 44691, SEQ ID NO: 44713, SEQ ID NO: 44722, SEQ ID NO: 44730, SEQ ID NO: 44754, SEQ ID NO: 44756, SEQ ID NOs: 44762 to 44763, SEQ ID NO: 44773, SEQ ID NO: 44781, SEQ ID NO: 44794, SEQ ID NO: 44850, SEQ ID NOs: 44873 to 44875, SEQ ID NO: 44877, SEQ ID NO: 44884, SEQ ID NO: 44908, SEQ ID NO: 44913, SEQ ID NO: 44940, SEQ ID NO: 44955, SEQ ID NO: 44964, SEQ ID NO: 44971, SEQ ID NO: 44976, SEQ ID NO: 45000, SEQ ID NO: 45027, SEQ ID NO: 45035, SEQ ID NO: 45060, SEQ ID NO: 45062, SEQ ID NO: 45095, SEQ ID NO: 45123, SEQ ID NOs: 45126 to 45127, SEQ ID NO: 45132, SEQ ID NO: 45135, SEQ ID NOs: 45138 to 45139, SEQ ID NO: 45193, SEQ ID NO: 45197, SEQ ID NO: 45200, SEQ ID NO: 45223, SEQ ID NO: 45225, SEQ ID NO: 45244, SEQ ID NO: 45262, SEQ ID NO: 45273, SEQ ID NO: 45292, SEQ ID NO: 45302, SEQ ID NO: 45306, SEQ ID NO: 45314, SEQ ID NO: 45380, SEQ ID NO: 45385, SEQ ID NO: 45389, SEQ ID NO: 45398, SEQ ID NO: 45409, SEQ ID NO: 45438, SEQ ID NO: 45444, SEQ ID NOs: 45450 to 45451, SEQ ID NO: 45478, SEQ ID NO: 45480, SEQ ID NO: 45485, SEQ ID NO: 45490, SEQ ID NO: 45510, SEQ ID NO: 45514, SEQ ID NOs: 45519 to 45520, SEQ ID NO: 45530, SEQ ID NO: 45541, SEQ ID NO: 45552, SEQ ID NO: 45556, SEQ ID NOs: 45562 to 45563, SEQ ID NO: 45568, SEQ ID NO: 45577, SEQ ID NOs: 45580 to 45581, SEQ ID NO: 45584, SEQ ID NO: 45588, SEQ ID NO: 45595, SEQ ID NO: 45599, SEQ ID NO: 45632, SEQ ID NO: 45653, SEQ ID NOs: 45666 to 45667, SEQ ID NO: 45675, SEQ ID NO: 45680, SEQ ID NO: 45687, SEQ ID NO: 45697, SEQ ID NOs: 45699 to 45700, SEQ ID NO: 45712, SEQ ID NO: 45714, SEQ ID NO: 45723, SEQ ID NO: 45746, SEQ ID NO: 45765, SEQ ID NO: 45787, SEQ ID NO: 45793, SEQ ID NO: 45818, SEQ ID NO: 45826, SEQ ID NOs: 45829 to 45830, SEQ ID NO: 45835, SEQ ID NO: 45837, SEQ ID NO: 45846, SEQ ID NO: 45859, SEQ ID NO: 45885, SEQ ID NO: 45894, SEQ ID NO: 45904, SEQ ID NO: 45915, SEQ ID NO: 45930, SEQ ID NO: 45938, SEQ ID NO: 45959, SEQ ID NO: 45983, SEQ ID NO: 46006, SEQ ID NO: 46011, SEQ ID NO: 46014, SEQ ID NO: 46044, SEQ ID NO: 46049, SEQ ID NO: 46054, SEQ ID NO: 46058, SEQ ID NO: 46063, SEQ ID NO: 46071, SEQ ID NO: 46077, SEQ ID NO: 46096, SEQ ID NO: 46103, SEQ ID NO: 46108, SEQ ID NO: 46110, SEQ ID NO: 46125, SEQ ID NO: 46133, SEQ ID NOs: 46170 to 46171, SEQ ID NO: 46195, SEQ ID NO: 46208, SEQ ID NO: 46212, SEQ ID NO: 46219, SEQ ID NO: 46226, SEQ ID NO: 46234, SEQ ID NO: 46236, SEQ ID NO: 46261, SEQ ID NO: 46270, SEQ ID NO: 46273, SEQ ID NO: 46275, SEQ ID NO: 46339, SEQ ID NO: 46364, SEQ ID NO: 46376, SEQ ID NOs: 46400 to 46401, SEQ ID NOs: 46421 to 46422, SEQ ID NO: 46433, SEQ ID NOs: 46442 to 46443, SEQ ID NO: 46446, SEQ ID NOs: 46452 to 46454, SEQ ID NO: 46457, SEQ ID NO: 46459, SEQ ID NO: 46462, SEQ ID NO: 46465, SEQ ID NO: 46478, SEQ ID NO: 46484, SEQ ID NO: 46489, SEQ ID NO: 46499, SEQ ID NO: 46512, SEQ ID NO: 46521, SEQ ID NO: 46530, SEQ ID NO: 46536, SEQ ID NO: 46560, SEQ ID NO: 46564, SEQ ID NO: 46570, SEQ ID NO: 46572, SEQ ID NO: 46575, SEQ ID NO: 46579, SEQ ID NO: 46586, SEQ ID NO: 46602, SEQ ID NO: 46616, SEQ ID NO: 46621, SEQ ID NO: 46628, SEQ ID NO: 46637, SEQ ID NO: 46642, SEQ ID NO: 46648, SEQ ID NO: 46652, SEQ ID NO: 46655, SEQ ID NO: 46660, SEQ ID NO: 46663, SEQ ID NOs: 46665 to 46666, SEQ ID NO: 46676, SEQ ID NOs: 46678 to 46679, SEQ ID NO: 46682, SEQ ID NO: 46685, SEQ ID NO: 46689, SEQ ID NO: 46713, SEQ ID NO: 46715, SEQ ID NO: 46736, SEQ ID NO: 46739, SEQ ID NO: 46770, SEQ ID NO: 46777, SEQ ID NO: 46800, SEQ ID NOs: 46823 to 46825, SEQ ID NO: 46831, SEQ ID NO: 46872, SEQ ID NO: 46880, SEQ ID NO: 46897, SEQ ID NO: 46916, SEQ ID NO: 46928, SEQ ID NO: 46937, SEQ ID NO: 46950, SEQ ID NO: 46978, SEQ ID NO: 46981, SEQ ID NO: 46983, SEQ ID NO: 46989, SEQ ID NO: 46991, SEQ ID NO: 46993, SEQ ID NO: 47003, SEQ ID NO: 47006, SEQ ID NO: 47017, SEQ ID NO: 47028, SEQ ID NO: 47045, SEQ ID NO: 47047, SEQ ID NO: 47057, SEQ ID NOs: 47079 to 47080, SEQ ID NO: 47082, SEQ ID NO: 47114, SEQ ID NO: 47119, SEQ ID NO: 47123, SEQ ID NOs: 47137 to 47139, SEQ ID NO: 47151, SEQ ID NO: 47158, SEQ ID NO: 47167, SEQ ID NO: 47172, SEQ ID NO: 47186, SEQ ID NO: 47191, SEQ ID NO: 47206, SEQ ID NO: 47224, SEQ ID NO: 47298, SEQ ID NO: 47316, SEQ ID NO: 47324, SEQ ID NOs: 47331 to 47332, SEQ ID NO: 47335, SEQ ID NO: 47356, SEQ ID NO: 47358, SEQ ID NOs: 47360 to 47361, SEQ ID NOs: 47377 to 47378, SEQ ID NO: 47381, SEQ ID NO: 47405, SEQ ID NO: 47412, SEQ ID NO: 47416, SEQ ID NO: 47422, SEQ ID NO: 47425, SEQ ID NO: 47427, SEQ ID NOs: 47432 to 47433, SEQ ID NO: 47445, SEQ ID NO: 47451, SEQ ID NO: 47460, SEQ ID NO: 47482, SEQ ID NO: 47491, SEQ ID NO: 47509, SEQ ID NO: 47516, SEQ ID NOs: 47533 to 47535, SEQ ID NOs: 47538 to 47539, SEQ ID NO: 47555, SEQ ID NO: 47561, SEQ ID NOs: 47575 to 47576, SEQ ID NO: 47582, SEQ ID NO: 47592, SEQ ID NO: 47614, SEQ ID NO: 47625, SEQ ID NO: 47630, SEQ ID NO: 47637, SEQ ID NO: 47643, SEQ ID NO: 47654, SEQ ID NO: 47673, SEQ ID NO: 47689, SEQ ID NO: 47698, SEQ ID NO: 47701, SEQ ID NO: 47727, SEQ ID NO: 47749, SEQ ID NOs: 47759 to 47760, SEQ ID NO: 47767, SEQ ID NO: 47773, SEQ ID NO: 47782, SEQ ID NO: 47790, SEQ ID NO: 47793, SEQ ID NO: 47799, SEQ ID NO: 47806, SEQ ID NO: 47809, SEQ ID NO: 47834, SEQ ID NO: 47840, SEQ ID NO: 47844, SEQ ID NO: 47848, SEQ ID NO: 47855, SEQ ID NO: 47867, SEQ ID NO: 47890, SEQ ID NO: 47895, SEQ ID NO: 47899, SEQ ID NO: 47902, SEQ ID NO: 47923, SEQ ID NO: 47927, SEQ ID NOs: 47959 to 47960, SEQ ID NO: 47964, SEQ ID NO: 47979, SEQ ID NO: 47984, SEQ ID NO: 47986, SEQ ID NOs: 48030 to 48031, SEQ ID NO: 48034, SEQ ID NO: 48059, SEQ ID NO: 48093, SEQ ID NO: 48107, SEQ ID NO: 48113, SEQ ID NO: 48118, SEQ ID NO: 48121, SEQ ID NO: 48129, SEQ ID NOs: 48138 to 48139, SEQ ID NO: 48144, SEQ ID NO: 48158, SEQ ID NO: 48160, SEQ ID NO: 48162, SEQ ID NO: 48175, SEQ ID NO: 48186, SEQ ID NO: 48203, SEQ ID NO: 48210, SEQ ID NO: 48213, SEQ ID NO: 48220, SEQ ID NO: 48224, SEQ ID NO: 48229, SEQ ID NO: 48258, SEQ ID NO: 48266, SEQ ID NO: 48273, SEQ ID NO: 48280, SEQ ID NO: 48286, SEQ ID NO: 48295, SEQ ID NOs: 48300 to 48301, SEQ ID NOs: 48306 to 48307, SEQ ID NO: 48315, SEQ ID NO: 48347, SEQ ID NO: 48353, SEQ ID NO: 48358, SEQ ID NO: 48366, SEQ ID NO: 48371, SEQ ID NO: 48379, SEQ ID NO: 48387, SEQ ID NO: 48400, SEQ ID NO: 48415, SEQ ID NOs: 48418 to 48419, SEQ ID NO: 48436, SEQ ID NOs: 48438 to 48440, SEQ ID NO: 48443, SEQ ID NO: 48452, SEQ ID NOs: 48461 to 48462, SEQ ID NO: 48466, SEQ ID NO: 48469, SEQ ID NO: 48520, SEQ ID NO: 48537, SEQ ID NO: 48545, SEQ ID NO: 48574, SEQ ID NOs: 48576 to 48578, SEQ ID NO: 48594, SEQ ID NO: 48599, SEQ ID NO: 48614, SEQ ID NO: 48627, SEQ ID NO: 48642, SEQ ID NO: 48648, SEQ ID NO: 48654, SEQ ID NO: 48656, SEQ ID NO: 48666, SEQ ID NOs: 48669 to 48670, SEQ ID NO: 48674, SEQ ID NOs: 48680 to 48681, SEQ ID NO: 48684, SEQ ID NO: 48686, SEQ ID NO: 48692, SEQ ID NO: 48701, SEQ ID NO: 48705, SEQ ID NO: 48714, SEQ ID NO: 48717, SEQ ID NO: 48735, SEQ ID NO: 48738, SEQ ID NO: 48749, SEQ ID NO: 48751, SEQ ID NO: 48764, SEQ ID NO: 48769, SEQ ID NO: 48793, SEQ ID NO: 48796, SEQ ID NOs: 48799 to 48800, SEQ ID NOs: 48802 to 48803, SEQ ID NO: 48818, SEQ ID NO: 48832, SEQ ID NO: 48834, SEQ ID NO: 48838, SEQ ID NO: 48845, SEQ ID NO: 48856, SEQ ID NO: 48877, SEQ ID NO: 48884, SEQ ID NO: 48903, SEQ ID NO: 48936, SEQ ID NO: 48947, SEQ ID NOs: 48968 to 48970, SEQ ID NO: 48974, SEQ ID NOs: 48981 to 48982, SEQ ID NO: 48997, SEQ ID NOs: 49013 to 49014, SEQ ID NOs: 49019 to 49020, SEQ ID NO: 49031, SEQ ID NO: 49033, SEQ ID NO: 49043, SEQ ID NO: 49052, SEQ ID NOs: 49061 to 49062, SEQ ID NO: 49068, SEQ ID NO: 49071, SEQ ID NO: 49086, SEQ ID NO: 49102, SEQ ID NO: 49111, SEQ ID NO: 49156, SEQ ID NO: 49164, SEQ ID NO: 49173, SEQ ID NO: 49176, SEQ ID NO: 49183, SEQ ID NO: 49185, SEQ ID NOs: 49200 to 49201, SEQ ID NO: 49209, SEQ ID NO: 49220, SEQ ID NO: 49247, SEQ ID NO: 49251, SEQ ID NO: 49256, SEQ ID NO: 49263, SEQ ID NOs: 49273 to 49274, SEQ ID NOs: 49280 to 49281, SEQ ID NO: 49291, SEQ ID NOs: 49294 to 49295, SEQ ID NO: 49298, SEQ ID NO: 49309, SEQ ID NO: 49319, SEQ ID NO: 49326, SEQ ID NO: 49330, SEQ ID NO: 49340, SEQ ID NOs: 49351 to 49352, SEQ ID NO: 49360, SEQ ID NOs: 49376 to 49377, SEQ ID NO: 49384, SEQ ID NO: 49393, SEQ ID NO: 49395, SEQ ID NO: 49399, SEQ ID NO: 49406, SEQ ID NO: 49411, SEQ ID NOs: 49443 to 49444, SEQ ID NO: 49452, SEQ ID NO: 49462, SEQ ID NO: 49474, SEQ ID NO: 49487, SEQ ID NO: 49499, SEQ ID NO: 49525, SEQ ID NO: 49537, SEQ ID NO: 49540, SEQ ID NO: 49557, SEQ ID NO: 49572, SEQ ID NO: 49584, SEQ ID NO: 49597, SEQ ID NO: 49626, SEQ ID NO: 49630, SEQ ID NO: 49646, SEQ ID NO: 49658, SEQ ID NO: 49671, SEQ ID NO: 49681, SEQ ID NO: 49703, SEQ ID NO: 49728, SEQ ID NO: 49730, SEQ ID NO: 49737, SEQ ID NOs: 49742 to 49743, SEQ ID NOs: 49766 to 49767, SEQ ID NO: 49772, SEQ ID NO: 49782, SEQ ID NOs: 49787 to 49788, SEQ ID NO: 49793, SEQ ID NO: 49796, SEQ ID NO: 49805, SEQ ID NO: 49811, SEQ ID NO: 49823, SEQ ID NO: 49838, SEQ ID NO: 49850, SEQ ID NOs: 49859 to 49860, SEQ ID NO: 49873, SEQ ID NO: 49883, SEQ ID NO: 49892, SEQ ID NO: 49912, SEQ ID NO: 49928, SEQ ID NO: 49948, SEQ ID NO: 49961, SEQ ID NO: 49965, SEQ ID NO: 49987, SEQ ID NO: 49997, SEQ ID NOs: 50017 to 50018, SEQ ID NO: 50020, SEQ ID NO: 50022, SEQ ID NO: 50045, SEQ ID NO: 50062, SEQ ID NO: 50073, SEQ ID NO: 50079, SEQ ID NO: 50090, SEQ ID NO: 50107, SEQ ID NOs: 50111 to 50112, SEQ ID NO: 50123, SEQ ID NO: 50138, SEQ ID NOs: 50165 to 50167, SEQ ID NOs: 50227 to 50228, SEQ ID NO: 50243, SEQ ID NO: 50250, SEQ ID NO: 50254, SEQ ID NO: 50282, SEQ ID NO: 50284, SEQ ID NO: 50290, SEQ ID NO: 50297, SEQ ID NO: 50305, SEQ ID NO: 50309, SEQ ID NO: 50319, SEQ ID NO: 50331, SEQ ID NO: 50334, SEQ ID NO: 50339, SEQ ID NO: 50366, SEQ ID NO: 50388, SEQ ID NO: 50392, SEQ ID NO: 50394, SEQ ID NOs: 50400 to 50401, SEQ ID NO: 50418, SEQ ID NO: 50423, SEQ ID NO: 50428, SEQ ID NO: 50437, SEQ ID NO: 50443, SEQ ID NO: 50450, SEQ ID NO: 50464, SEQ ID NO: 50485, SEQ ID NO: 50494, SEQ ID NO: 50496, SEQ ID NO: 50499, SEQ ID NO: 50526, SEQ ID NO: 50528, SEQ ID NO: 50532, SEQ ID NO: 50538, SEQ ID NO: 50554, SEQ ID NO: 50557, SEQ ID NO: 50560, SEQ ID NO: 50564, SEQ ID NO: 50574, SEQ ID NO: 50585, SEQ ID NO: 50617, SEQ ID NO: 50632, SEQ ID NO: 50634, SEQ ID NO: 50644, SEQ ID NO: 50654, SEQ ID NO: 50678, SEQ ID NO: 50699, SEQ ID NO: 50714, SEQ ID NOs: 50728 to 50729, SEQ ID NO: 50735, SEQ ID NO: 50741, SEQ ID NO: 50744, SEQ ID NO: 50765, SEQ ID NO: 50769, SEQ ID NO: 50793, SEQ ID NO: 50818, SEQ ID NO: 50822, SEQ ID NO: 50826, SEQ ID NO: 50835, SEQ ID NO: 50842, SEQ ID NO: 50847, SEQ ID NO: 50849, SEQ ID NO: 50851, SEQ ID NO: 50893, SEQ ID NO: 50918, SEQ ID NOs: 50935 to 50936, SEQ ID NOs: 50941 to 50944, SEQ ID NOs: 50960 to 50962, SEQ ID NOs: 50975 to 50976, SEQ ID NOs: 51008 to 51009, SEQ ID NO: 51012, SEQ ID NOs: 51021 to 51022, SEQ ID NO: 51046, SEQ ID NO: 51062, SEQ ID NOs: 51068 to 51071, SEQ ID NOs: 51102 to 51104, SEQ ID NO: 51118, SEQ ID NOs: 51168 to 51169, SEQ ID NO: 51214, SEQ ID NO: 51235, SEQ ID NO: 51239, SEQ ID NO: 51241, SEQ ID NO: 51243, SEQ ID NO: 51257, SEQ ID NOs: 51263 to 51266, SEQ ID NOs: 51295 to 51297, SEQ ID NO: 51313, SEQ ID NO: 51405, SEQ ID NOs: 51413 to 51417, SEQ ID NO: 51524, SEQ ID NO: 51526, SEQ ID NO: 51693, SEQ ID NO: 51717, SEQ ID NO: 51762, SEQ ID NO: 51765, SEQ ID NO: 51853, SEQ ID NO: 51878, SEQ ID NO: 52035, SEQ ID NO: 52179, SEQ ID NO: 52275, SEQ ID NO: 52290, SEQ ID NO: 52379, SEQ ID NO: 52463, SEQ ID NO: 52497, SEQ ID NO: 52515, SEQ ID NO: 52652, SEQ ID NO: 52660, SEQ ID NO: 52679, SEQ ID NO: 52686, SEQ ID NO: 52746, SEQ ID NO: 52758, SEQ ID NO: 52816, SEQ ID NO: 52944, SEQ ID NO: 52984, SEQ ID NO: 52988, SEQ ID NO: 52991, SEQ ID NO: 53045, SEQ ID NO: 53118, SEQ ID NO: 53166, SEQ ID NO: 53338, SEQ ID NO: 53382, SEQ ID NO: 53464, SEQ ID NO: 53478, SEQ ID NO: 53511, SEQ ID NO: 53519, SEQ ID NO: 53548, SEQ ID NO: 53581, SEQ ID NO: 53653, SEQ ID NO: 53968, SEQ ID NO: 54024, SEQ ID NO: 54038, SEQ ID NO: 54045, SEQ ID NO: 54080, SEQ ID NO: 54097, SEQ ID NO: 54111, SEQ ID NO: 54238, SEQ ID NO: 54251, SEQ ID NO: 54269, SEQ ID NO: 54409, SEQ ID NO: 54418, SEQ ID NO: 54442, SEQ ID NO: 54473, SEQ ID NO: 54543, SEQ ID NO: 54713, SEQ ID NO: 54719, SEQ ID NO: 54727, SEQ ID NO: 54772, SEQ ID NO: 54788, SEQ ID NO: 54863, SEQ ID NO: 54877, SEQ ID NO: 54945, SEQ ID NO: 54960, SEQ ID NO: 55004, SEQ ID NO: 55109, SEQ ID NO: 55207, SEQ ID NO: 55230, SEQ ID NO: 55300, SEQ ID NO: 55355, SEQ ID NO: 55437, SEQ ID NO: 55516, SEQ ID NO: 55695, SEQ ID NO: 55758, SEQ ID NO: 55801, SEQ ID NO: 55814, SEQ ID NO: 55875, SEQ ID NO: 55879, SEQ ID NO: 55886, SEQ ID NO: 55911, SEQ ID NO: 55986, SEQ ID NO: 56043, SEQ ID NO: 56052, SEQ ID NO: 56175, SEQ ID NO: 56240, SEQ ID NO: 56277, SEQ ID NO: 56352, SEQ ID NO: 56418, SEQ ID NO: 56435, SEQ ID NO: 56521, SEQ ID NO: 56593, SEQ ID NO: 56609, SEQ ID NO: 56629, SEQ ID NOs: 56649 to 56650, SEQ ID NO: 56793, SEQ ID NO: 56836, SEQ ID NO: 56852, SEQ ID NO: 56902, SEQ ID NO: 57155, SEQ ID NO: 57157, SEQ ID NO: 57265, SEQ ID NO: 57278, SEQ ID NO: 57323, SEQ ID NO: 57472, SEQ ID NO: 57535, SEQ ID NO: 57550, SEQ ID NO: 57561, SEQ ID NO: 57568, SEQ ID NO: 57639, SEQ ID NO: 57655, SEQ ID NO: 57790, SEQ ID NO: 57811, SEQ ID NO: 57904, SEQ ID NO: 57944, SEQ ID NO: 58040, SEQ ID NO: 58064, SEQ ID NO: 58075, SEQ ID NO: 58145, SEQ ID NO: 58199, SEQ ID NO: 58223, SEQ ID NO: 58226, SEQ ID NO: 58309, SEQ ID NO: 58349, SEQ ID NO: 58395, SEQ ID NO: 58411, SEQ ID NO: 58433, SEQ ID NO: 58547, SEQ ID NO: 58589, SEQ ID NO: 58679, SEQ ID NOs: 58683 to 58684, SEQ ID NO: 58815, SEQ ID NO: 58823, SEQ ID NO: 58855, SEQ ID NO: 58932, SEQ ID NO: 59223, SEQ ID NO: 59246, SEQ ID NO: 59248, SEQ ID NO: 59530, SEQ ID NO: 59622, SEQ ID NO: 59755, SEQ ID NO: 59757, SEQ ID NO: 59775, SEQ ID NO: 59816, SEQ ID NO: 59821, SEQ ID NO: 59828, SEQ ID NO: 59856, SEQ ID NO: 59871, SEQ ID NO: 59873, SEQ ID NO: 59875, SEQ ID NO: 59960, SEQ ID NO: 59967, SEQ ID NO: 60005, SEQ ID NOs: 60046 to 60047, SEQ ID NO: 60081, SEQ ID NO: 60224, SEQ ID NO: 60228, SEQ ID NO: 60276, SEQ ID NO: 60289, SEQ ID NO: 60292, SEQ ID NOs: 60422 to 60423, SEQ ID NO: 60444, SEQ ID NOs: 60456 to 68237, SEQ ID NO: 211911, SEQ ID NOs: 212086 to 212095, SEQ ID NOs: 212435 to 212440, SEQ ID NOs: 212681 to 212684, SEQ ID NOs: 212858 to 212860, SEQ ID NOs: 213516 to 213517, SEQ ID NOs: 213529 to 213531, SEQ ID NOs: 213602 to 213611, SEQ ID NOs: 213719 to 213720, SEQ ID NO: 213899, SEQ ID NOs: 214004 to 214012, SEQ ID NO: 214607, SEQ ID NOs: 214647 to 214649, SEQ ID NOs: 214672 to 214679, SEQ ID NOs: 214774 to 214775, SEQ ID NO: 214777, SEQ ID NO: 214779, SEQ ID NO: 214782, SEQ ID NOs: 215373 to 215415, SEQ ID NO: 215494, SEQ ID NO: 215497, SEQ ID NO: 215679, SEQ ID NO: 216244, SEQ ID NO: 216246, SEQ ID NOs: 216383 to 216401, SEQ ID NOs: 217184 to 217192, SEQ ID NO: 217200, SEQ ID NO: 217362, SEQ ID NOs: 217708 to 217712, SEQ ID NO: 217719, SEQ ID NO: 219238, SEQ ID NOs: 219742 to 219744, SEQ ID NO: 219747, SEQ ID NO: 219749, SEQ ID NO: 219751, SEQ ID NOs: 219773 to 219781, SEQ ID NOs: 219994 to 220030, SEQ ID NOs: 220318 to 220319, SEQ ID NO: 220327, SEQ ID NO: 220670, SEQ ID NO: 220815, SEQ ID NO: 220820, SEQ ID NOs: 221197 to 221234, SEQ ID NO: 221998, SEQ ID NO: 222000, SEQ ID NO: 223092, SEQ ID NO: 223095, SEQ ID NO: 223097, SEQ ID NO: 223099, SEQ ID NO: 223119, SEQ ID NO: 223121, SEQ ID NOs: 223184 to 223190, SEQ ID NOs:

223250 to 223283, SEQ ID NO: 223319, SEQ ID NO: 230922, SEQ ID NOs: 232805 to 232806, SEQ ID NO: 232846, and SEQ ID NOs: 236016 to 247058. In some embodiments, any one of the peptides in the MAGA4 vaccine comprise an amino acid sequence 80, 81, 82, 83, 84, 85, 86, 87, 88, 89, 90, 91, 92, 93, 94, 95, 96, 97, 98 or 99% identical to SEQ ID NO: 41345, SEQ ID NO: 41347, SEQ ID NO: 41352, SEQ ID NOs: 41357 to 41358, SEQ ID NO: 41366, SEQ ID NO: 41377, SEQ ID NO: 41382, SEQ ID NO: 41392, SEQ ID NO: 41396, SEQ ID NO: 41398, SEQ ID NO: 41406, SEQ ID NO: 41411, SEQ ID NO: 41414, SEQ ID NO: 41433, SEQ ID NO: 41436, SEQ ID NO: 41445, SEQ ID NO: 41449, SEQ ID NO: 41455, SEQ ID NO: 41478, SEQ ID NO: 41487, SEQ ID NOs: 41495 to 41496, SEQ ID NO: 41503, SEQ ID NO: 41515, SEQ ID NO: 41520, SEQ ID NO: 41529, SEQ ID NO: 41549, SEQ ID NO: 41553, SEQ ID NO: 41562, SEQ ID NO: 41569, SEQ ID NO: 41574, SEQ ID NO: 41576, SEQ ID NO: 41579, SEQ ID NOs: 41587 to 41588, SEQ ID NO: 41605, SEQ ID NO: 41617, SEQ ID NO: 41620, SEQ ID NO: 41634, SEQ ID NO: 41650, SEQ ID NO: 41665, SEQ ID NO: 41670, SEQ ID NO: 41672, SEQ ID NO: 41696, SEQ ID NO: 41703, SEQ ID NO: 41709, SEQ ID NO: 41725, SEQ ID NOs: 41732 to 41733, SEQ ID NO: 41748, SEQ ID NO: 41760, SEQ ID NO: 41766, SEQ ID NO: 41768, SEQ ID NO: 41770, SEQ ID NO: 41779, SEQ ID NO: 41791, SEQ ID NO: 41797, SEQ ID NO: 41813, SEQ ID NO: 41819, SEQ ID NO: 41825, SEQ ID NO: 41829, SEQ ID NOs: 41846 to 41847, SEQ ID NO: 41853, SEQ ID NO: 41876, SEQ ID NO: 41889, SEQ ID NO: 41892, SEQ ID NO: 41897, SEQ ID NOs: 41906 to 41907, SEQ ID NO: 41912, SEQ ID NO: 41924, SEQ ID NO: 41940, SEQ ID NO: 41953, SEQ ID NO: 41956, SEQ ID NO: 41967, SEQ ID NO: 41970, SEQ ID NO: 41976, SEQ ID NO: 41985, SEQ ID NO: 41990, SEQ ID NO: 42014, SEQ ID NO: 42017, SEQ ID NO: 42026, SEQ ID NO: 42034, SEQ ID NO: 42037, SEQ ID NO: 42046, SEQ ID NO: 42048, SEQ ID NOs: 42056 to 42057, SEQ ID NO: 42080, SEQ ID NO: 42088, SEQ ID NO: 42091, SEQ ID NO: 42102, SEQ ID NO: 42106, SEQ ID NO: 42115, SEQ ID NO: 42120, SEQ ID NO: 42129, SEQ ID NO: 42135, SEQ ID NO: 42138, SEQ ID NO: 42151, SEQ ID NO: 42158, SEQ ID NOs: 42163 to 42164, SEQ ID NOs: 42167 to 42168, SEQ ID NO: 42170, SEQ ID NO: 42186, SEQ ID NO: 42192, SEQ ID NO: 42195, SEQ ID NO: 42198, SEQ ID NO: 42204, SEQ ID NO: 42209, SEQ ID NO: 42218, SEQ ID NO: 42221, SEQ ID NO: 42224, SEQ ID NO: 42229, SEQ ID NO: 42240, SEQ ID NO: 42263, SEQ ID NO: 42265, SEQ ID NO: 42270, SEQ ID NO: 42316, SEQ ID NOs: 42336 to 42337, SEQ ID NO: 42339, SEQ ID NO: 42351, SEQ ID NO: 42354, SEQ ID NO: 42372, SEQ ID NO: 42378, SEQ ID NOs: 42385 to 42386, SEQ ID NO: 42394, SEQ ID NO: 42405, SEQ ID NO: 42409, SEQ ID NO: 42417, SEQ ID NO: 42423, SEQ ID NO: 42439, SEQ ID NO: 42447, SEQ ID NO: 42453, SEQ ID NO: 42458, SEQ ID NOs: 42460 to 42461, SEQ ID NO: 42466, SEQ ID NOs: 42472 to 42473, SEQ ID NOs: 42519 to 42520, SEQ ID NO: 42525, SEQ ID NO: 42528, SEQ ID NO: 42540, SEQ ID NO: 42545, SEQ ID NO: 42550, SEQ ID NOs: 42563 to 42564, SEQ ID NO: 42580, SEQ ID NO: 42605, SEQ ID NO: 42609, SEQ ID NOs: 42612 to 42613, SEQ ID NO: 42615, SEQ ID NO: 42628, SEQ ID NO: 42637, SEQ ID NO: 42648, SEQ ID NO: 42653, SEQ ID NO: 42675, SEQ ID NO: 42680, SEQ ID NO: 42685, SEQ ID NO: 42696, SEQ ID NO: 42703, SEQ ID NO: 42719, SEQ ID NO: 42735, SEQ ID NO: 42743, SEQ ID NO: 42748, SEQ ID NO: 42750, SEQ ID NO: 42768, SEQ ID NO: 42812, SEQ ID NO: 42814, SEQ ID NO: 42822, SEQ ID NO: 42827, SEQ ID NO: 42831, SEQ ID NO: 42846, SEQ ID NO: 42850, SEQ ID NO: 42872, SEQ ID NO: 42886, SEQ ID NO: 42911, SEQ ID NO: 42914, SEQ ID NO: 42923, SEQ ID NO: 42927, SEQ ID NOs: 42957 to 42958, SEQ ID NO: 42962, SEQ ID NO: 42971, SEQ ID NOs: 42997 to 42998, SEQ ID NO: 43002, SEQ ID NO: 43008, SEQ ID NO: 43035, SEQ ID NO: 43046, SEQ ID NO: 43048, SEQ ID NO: 43064, SEQ ID NO: 43083, SEQ ID NO: 43091, SEQ ID NO: 43093, SEQ ID NO: 43148, SEQ ID NO: 43160, SEQ ID NO: 43170, SEQ ID NO: 43175, SEQ ID NO: 43180, SEQ ID NO: 43186, SEQ ID NO: 43193, SEQ ID NO: 43196, SEQ ID NOs: 43231 to 43232, SEQ ID NO: 43238, SEQ ID NO: 43242, SEQ ID NO: 43248, SEQ ID NO: 43253, SEQ ID NO: 43258, SEQ ID NO: 43267, SEQ ID NO: 43274, SEQ ID NO: 43280, SEQ ID NO: 43285, SEQ ID NO: 43295, SEQ ID NO: 43308, SEQ ID NO: 43311, SEQ ID NO: 43329, SEQ ID NO: 43333, SEQ ID NOs: 43339 to 43340, SEQ ID NO: 43362, SEQ ID NO: 43365, SEQ ID NO: 43384, SEQ ID NO: 43389, SEQ ID NO: 43395, SEQ ID NO: 43401, SEQ ID NO: 43429, SEQ ID NO: 43432, SEQ ID NO: 43440, SEQ ID NOs: 43451 to 43453, SEQ ID NO: 43462, SEQ ID NO: 43464, SEQ ID NO: 43467, SEQ ID NO: 43479, SEQ ID NO: 43482, SEQ ID NO: 43496, SEQ ID NO: 43511, SEQ ID NO: 43513, SEQ ID NO: 43517, SEQ ID NO: 43545, SEQ ID NO: 43564, SEQ ID NO: 43573, SEQ ID NO: 43585, SEQ ID NO: 43587, SEQ ID NO: 43591, SEQ ID NO: 43611, SEQ ID NO: 43632, SEQ ID NO: 43636, SEQ ID NO: 43641, SEQ ID NO: 43643, SEQ ID NO: 43651, SEQ ID NO: 43669, SEQ ID NO: 43688, SEQ ID NO: 43696, SEQ ID NO: 43700, SEQ ID NO: 43703, SEQ ID NO: 43707, SEQ ID NO: 43718, SEQ ID NO: 43760, SEQ ID NO: 43763, SEQ ID NO: 43768, SEQ ID NO: 43777, SEQ ID NO: 43780, SEQ ID NO: 43787, SEQ ID NO: 43801, SEQ ID NO: 43808, SEQ ID NO: 43810, SEQ ID NO: 43825, SEQ ID NO: 43827, SEQ ID NO: 43836, SEQ ID NO: 43860, SEQ ID NO: 43867, SEQ ID NOs: 43881 to 43882, SEQ ID NO: 43884, SEQ ID NO: 43887, SEQ ID NOs: 43898 to 43899, SEQ ID NO: 43905, SEQ ID NO: 43915, SEQ ID NO: 43924, SEQ ID NO: 43932, SEQ ID NO: 43958, SEQ ID NO: 43971, SEQ ID NO: 43974, SEQ ID NO: 43978, SEQ ID NOs: 43982 to 43984, SEQ ID NOs: 43986 to 43987, SEQ ID NO: 43993, SEQ ID NO: 43995, SEQ ID NO: 44012, SEQ ID NO: 44035, SEQ ID NO: 44037, SEQ ID NO: 44048, SEQ ID NO: 44050, SEQ ID NO: 44052, SEQ ID NO: 44055, SEQ ID NO: 44063, SEQ ID NO: 44073, SEQ ID NO: 44080, SEQ ID NO: 44085, SEQ ID NO: 44087, SEQ ID NO: 44089, SEQ ID NO: 44112, SEQ ID NO: 44117, SEQ ID NO: 44123, SEQ ID NOs: 44151 to 44152, SEQ ID NO: 44160, SEQ ID NO: 44181, SEQ ID NO: 44207, SEQ ID NO: 44210, SEQ ID NO: 44244, SEQ ID NO: 44246, SEQ ID NO: 44254, SEQ ID NO: 44263, SEQ ID NOs: 44298 to 44299, SEQ ID NO: 44309, SEQ ID NO: 44324, SEQ ID NO: 44328, SEQ ID NO: 44342, SEQ ID NO: 44345, SEQ ID NO: 44359, SEQ ID NO: 44361, SEQ ID NO: 44383, SEQ ID NO: 44401, SEQ ID NO: 44422, SEQ ID NO: 44440, SEQ ID NO: 44452, SEQ ID NO: 44454, SEQ ID NO: 44456, SEQ ID NO: 44463, SEQ ID NO: 44467, SEQ ID NO: 44485, SEQ ID NO: 44512, SEQ ID NO: 44523, SEQ ID NO: 44545, SEQ ID NO: 44552, SEQ ID NO: 44564, SEQ ID NOs: 44566 to 44567, SEQ ID NOs: 44589 to 44591, SEQ ID NO: 44615, SEQ ID NO: 44623, SEQ ID NO: 44631, SEQ ID NO: 44636, SEQ ID NO: 44649, SEQ ID NO: 44654, SEQ ID NO: 44691, SEQ ID NO: 44713, SEQ ID NO: 44722, SEQ ID NO: 44730, SEQ ID NO: 44754, SEQ ID NO: 44756, SEQ ID NOs: 44762 to 44763, SEQ ID NO: 44773, SEQ ID NO: 44781, SEQ ID NO: 44794, SEQ ID NO: 44850, SEQ ID NOs: 44873 to 44875, SEQ ID NO: 44877, SEQ ID NO: 44884, SEQ ID NO: 44908, SEQ ID NO: 44913, SEQ ID NO: 44940, SEQ ID NO: 44955, SEQ ID NO: 44964, SEQ ID NO: 44971, SEQ ID NO: 44976, SEQ ID NO: 45000, SEQ ID NO: 45027, SEQ ID NO: 45035, SEQ ID NO: 45060, SEQ ID NO: 45062, SEQ ID NO: 45095, SEQ ID NO: 45123, SEQ ID NOs: 45126 to 45127, SEQ ID NO: 45132, SEQ ID NO: 45135, SEQ ID NOs: 45138 to 45139, SEQ ID NO: 45193, SEQ ID NO: 45197, SEQ ID NO: 45200, SEQ ID NO: 45223, SEQ ID NO: 45225, SEQ ID NO: 45244, SEQ ID NO: 45262, SEQ ID NO: 45273, SEQ ID NO: 45292, SEQ ID NO: 45302, SEQ ID NO: 45306, SEQ ID NO: 45314, SEQ ID NO: 45380, SEQ ID NO: 45385, SEQ ID NO: 45389, SEQ ID NO: 45398, SEQ ID NO: 45409, SEQ ID NO: 45438, SEQ ID NO: 45444, SEQ ID NOs: 45450 to 45451, SEQ ID NO: 45478, SEQ ID NO: 45480, SEQ ID NO: 45485, SEQ ID NO: 45490, SEQ ID NO: 45510, SEQ ID NO: 45514, SEQ ID NOs: 45519 to 45520, SEQ ID NO: 45530, SEQ ID NO: 45541, SEQ ID NO: 45552, SEQ ID NO: 45556, SEQ ID NOs: 45562 to 45563, SEQ ID NO: 45568, SEQ ID NO: 45577, SEQ ID NOs: 45580 to 45581, SEQ ID NO: 45584, SEQ ID NO: 45588, SEQ ID NO: 45595, SEQ ID NO: 45599, SEQ ID NO: 45632, SEQ ID NO: 45653, SEQ ID NOs: 45666 to 45667, SEQ ID NO: 45675, SEQ ID NO: 45680, SEQ ID NO: 45687, SEQ ID NO: 45697, SEQ ID NOs: 45699 to 45700, SEQ ID NO: 45712, SEQ ID NO: 45714, SEQ ID NO: 45723, SEQ ID NO: 45746, SEQ ID NO: 45765, SEQ ID NO: 45787, SEQ ID NO: 45793, SEQ ID NO: 45818, SEQ ID NO: 45826, SEQ ID NOs: 45829 to 45830, SEQ ID NO: 45835, SEQ ID NO: 45837, SEQ ID NO: 45846, SEQ ID NO: 45859, SEQ ID NO: 45885, SEQ ID NO: 45894, SEQ ID NO: 45904, SEQ ID NO: 45915, SEQ ID NO: 45930, SEQ ID NO: 45938, SEQ ID NO: 45959, SEQ ID NO: 45983, SEQ ID NO: 46006, SEQ ID NO: 46011, SEQ ID NO: 46014, SEQ ID NO: 46044, SEQ ID NO: 46049, SEQ ID NO: 46054, SEQ ID NO: 46058, SEQ ID NO: 46063, SEQ ID NO: 46071, SEQ ID NO: 46077, SEQ ID NO: 46096, SEQ ID NO: 46103, SEQ ID NO: 46108, SEQ ID NO: 46110, SEQ ID NO: 46125, SEQ ID NO: 46133, SEQ ID NOs: 46170 to 46171, SEQ ID NO: 46195, SEQ ID NO: 46208, SEQ ID NO: 46212, SEQ ID NO: 46219, SEQ ID NO: 46226, SEQ ID NO: 46234, SEQ ID NO: 46236, SEQ ID NO: 46261, SEQ ID NO: 46270, SEQ ID NO: 46273, SEQ ID NO: 46275, SEQ ID NO: 46339, SEQ ID NO: 46364, SEQ ID NO: 46376, SEQ ID NOs: 46400 to 46401, SEQ ID NOs: 46421 to 46422, SEQ ID NO: 46433, SEQ ID NOs: 46442 to 46443, SEQ ID NO: 46446, SEQ ID NOs: 46452 to 46454, SEQ ID NO: 46457, SEQ ID NO: 46459, SEQ ID NO: 46462, SEQ ID NO: 46465, SEQ ID NO: 46478, SEQ ID NO: 46484, SEQ ID NO: 46489, SEQ ID NO: 46499, SEQ ID NO: 46512, SEQ ID NO: 46521, SEQ ID NO: 46530, SEQ ID NO: 46536, SEQ ID NO: 46560, SEQ ID NO: 46564, SEQ ID NO: 46570, SEQ ID NO: 46572, SEQ ID NO: 46575, SEQ ID NO: 46579, SEQ ID NO: 46586, SEQ ID NO: 46602, SEQ ID NO: 46616, SEQ ID NO: 46621, SEQ ID NO: 46628, SEQ ID NO: 46637, SEQ ID NO: 46642, SEQ ID NO: 46648, SEQ ID NO: 46652, SEQ ID NO: 46655, SEQ ID NO: 46660, SEQ ID NO: 46663, SEQ ID NOs: 46665 to 46666, SEQ ID NO: 46676, SEQ ID NOs: 46678 to 46679, SEQ ID NO: 46682, SEQ ID NO: 46685, SEQ ID NO: 46689, SEQ ID NO: 46713, SEQ ID NO: 46715, SEQ ID NO: 46736, SEQ ID NO: 46739, SEQ ID NO: 46770, SEQ ID NO: 46777, SEQ ID NO: 46800, SEQ ID NOs: 46823 to 46825, SEQ ID NO: 46831, SEQ ID NO: 46872, SEQ ID NO: 46880, SEQ ID NO: 46897, SEQ ID NO: 46916, SEQ ID NO: 46928, SEQ ID NO: 46937, SEQ ID NO: 46950, SEQ ID NO: 46978, SEQ ID NO: 46981, SEQ ID NO: 46983, SEQ ID NO: 46989, SEQ ID NO: 46991, SEQ ID NO: 46993, SEQ ID NO: 47003, SEQ ID NO: 47006, SEQ ID NO: 47017, SEQ ID NO: 47028, SEQ ID NO: 47045, SEQ ID NO: 47047, SEQ ID NO: 47057, SEQ ID NOs: 47079 to 47080, SEQ ID NO: 47082, SEQ ID NO: 47114, SEQ ID NO: 47119, SEQ ID NO: 47123, SEQ ID NOs: 47137 to 47139, SEQ ID NO: 47151, SEQ ID NO: 47158, SEQ ID NO: 47167, SEQ ID NO: 47172, SEQ ID NO: 47186, SEQ ID NO: 47191, SEQ ID NO: 47206, SEQ ID NO: 47224, SEQ ID NO: 47298, SEQ ID NO: 47316, SEQ ID NO: 47324, SEQ ID NOs: 47331 to 47332, SEQ ID NO: 47335, SEQ ID NO: 47356, SEQ ID NO: 47358, SEQ ID NOs: 47360 to 47361, SEQ ID NOs: 47377 to 47378, SEQ ID NO: 47381, SEQ ID NO: 47405, SEQ ID NO: 47412, SEQ ID NO: 47416, SEQ ID NO: 47422, SEQ ID NO: 47425, SEQ ID NO: 47427, SEQ ID NOs: 47432 to 47433, SEQ ID NO: 47445, SEQ ID NO: 47451, SEQ ID NO: 47460, SEQ ID NO: 47482, SEQ ID NO: 47491, SEQ ID NO: 47509, SEQ ID NO: 47516, SEQ ID NOs: 47533 to 47535, SEQ ID NOs: 47538 to 47539, SEQ ID NO: 47555, SEQ ID NO: 47561, SEQ ID NOs: 47575 to 47576, SEQ ID NO: 47582, SEQ ID NO: 47592, SEQ ID NO: 47614, SEQ ID NO: 47625, SEQ ID NO: 47630, SEQ ID NO: 47637, SEQ ID NO: 47643, SEQ ID NO: 47654, SEQ ID NO: 47673, SEQ ID NO: 47689, SEQ ID NO: 47698, SEQ ID NO: 47701, SEQ ID NO: 47727, SEQ ID NO: 47749, SEQ ID NOs: 47759 to 47760, SEQ ID NO: 47767, SEQ ID NO: 47773, SEQ ID NO: 47782, SEQ ID NO: 47790, SEQ ID NO: 47793, SEQ ID NO: 47799, SEQ ID NO: 47806, SEQ ID NO: 47809, SEQ ID NO: 47834, SEQ ID NO: 47840, SEQ ID NO: 47844, SEQ ID NO: 47848, SEQ ID NO: 47855, SEQ ID NO: 47867, SEQ ID NO: 47890, SEQ ID NO: 47895, SEQ ID NO: 47899, SEQ ID NO: 47902, SEQ ID NO: 47923, SEQ ID NO: 47927, SEQ ID NOs: 47959 to 47960, SEQ ID NO: 47964, SEQ ID NO: 47979, SEQ ID NO: 47984, SEQ ID NO: 47986, SEQ ID NOs: 48030 to 48031, SEQ ID NO: 48034, SEQ ID NO: 48059, SEQ ID NO: 48093, SEQ ID NO: 48107, SEQ ID NO: 48113, SEQ ID NO: 48118, SEQ ID NO: 48121, SEQ ID NO: 48129, SEQ ID NOs: 48138 to 48139, SEQ ID NO: 48144, SEQ ID NO: 48158, SEQ ID NO: 48160, SEQ ID NO: 48162, SEQ ID NO: 48175, SEQ ID NO: 48186, SEQ ID NO: 48203, SEQ ID NO: 48210, SEQ ID NO: 48213, SEQ ID NO: 48220, SEQ ID NO: 48224, SEQ ID NO: 48229, SEQ ID NO: 48258, SEQ ID NO: 48266, SEQ ID NO: 48273, SEQ ID NO: 48280, SEQ ID NO: 48286, SEQ ID NO: 48295, SEQ ID NOs: 48300 to 48301, SEQ ID NOs: 48306 to 48307, SEQ ID NO: 48315, SEQ ID NO: 48347, SEQ ID NO: 48353, SEQ ID NO: 48358, SEQ ID NO: 48366, SEQ ID NO: 48371, SEQ ID NO: 48379, SEQ ID NO: 48387, SEQ ID NO: 48400, SEQ ID NO: 48415, SEQ ID NOs: 48418 to 48419, SEQ ID NO: 48436, SEQ ID NOs: 48438 to 48440, SEQ ID NO: 48443, SEQ ID NO: 48452, SEQ ID NOs: 48461 to 48462, SEQ ID NO: 48466, SEQ ID NO: 48469, SEQ ID NO: 48520, SEQ ID NO: 48537, SEQ ID NO: 48545, SEQ ID NO: 48574, SEQ ID NOs: 48576 to 48578, SEQ ID NO: 48594, SEQ ID NO: 48599, SEQ ID NO: 48614, SEQ ID NO: 48627, SEQ ID NO: 48642, SEQ ID NO: 48648, SEQ ID NO: 48654, SEQ ID NO: 48656, SEQ ID NO: 48666, SEQ ID NOs: 48669 to 48670, SEQ ID NO: 48674, SEQ ID NOs: 48680 to 48681, SEQ ID NO: 48684, SEQ ID NO: 48686, SEQ ID NO: 48692, SEQ ID NO: 48701, SEQ ID NO: 48705, SEQ ID NO: 48714, SEQ ID NO: 48717, SEQ ID NO: 48735, SEQ ID NO: 48738, SEQ ID NO: 48749, SEQ ID NO: 48751, SEQ ID NO: 48764, SEQ ID NO: 48769, SEQ ID NO: 48793, SEQ ID NO: 48796, SEQ ID NOs: 48799 to 48800, SEQ ID NOs: 48802 to 48803, SEQ ID NO: 48818, SEQ ID NO: 48832, SEQ ID NO: 48834, SEQ ID NOs: 48838, SEQ ID NO: 48845, SEQ ID NO: 48856, SEQ ID NO: 48877, SEQ ID NO: 48884, SEQ ID NO: 48903, SEQ ID NO: 48936, SEQ ID NO: 48947, SEQ ID NOs: 48968 to 48970, SEQ ID NO: 48974, SEQ ID NOs: 48981 to 48982, SEQ ID NO: 48997, SEQ ID NOs: 49013 to 49014, SEQ ID NOs: 49019 to 49020, SEQ ID NO: 49031, SEQ ID NO: 49033, SEQ ID NO: 49043, SEQ ID NO: 49052, SEQ ID NOs: 49061 to 49062, SEQ ID NO: 49068, SEQ ID NO: 49071, SEQ ID NO: 49086, SEQ ID NO: 49102, SEQ ID NO: 49111, SEQ ID NO: 49156, SEQ ID NO: 49164, SEQ ID NO: 49173, SEQ ID NO: 49176, SEQ ID NO: 49183, SEQ ID NO: 49185, SEQ ID NOs: 49200 to 49201, SEQ ID NO: 49209, SEQ ID NO: 49220, SEQ ID NO: 49247, SEQ ID NO: 49251, SEQ ID NO: 49256, SEQ ID NO: 49263, SEQ ID NOs: 49273 to 49274, SEQ ID NOs: 49280 to 49281, SEQ ID NO: 49291, SEQ ID NOs: 49294 to 49295, SEQ ID NO: 49298, SEQ ID NO: 49309, SEQ ID NO: 49319, SEQ ID NO: 49326, SEQ ID NO: 49330, SEQ ID NO: 49340, SEQ ID NOs: 49351 to 49352, SEQ ID NO: 49360, SEQ ID NOs: 49376 to 49377, SEQ ID NO: 49384, SEQ ID NO: 49393, SEQ ID NO: 49395, SEQ ID NO: 49399, SEQ ID NO: 49406, SEQ ID NO: 49411, SEQ ID NOs: 49443 to 49444, SEQ ID NO: 49452, SEQ ID NO: 49462, SEQ ID NO: 49474, SEQ ID NO: 49487, SEQ ID NO: 49499, SEQ ID NO: 49525, SEQ ID NO: 49537, SEQ ID NO: 49540, SEQ ID NO: 49557, SEQ ID NO: 49572, SEQ ID NO: 49584, SEQ ID NO: 49597, SEQ ID NO: 49626, SEQ ID NO: 49630, SEQ ID NO: 49646, SEQ ID NO: 49658, SEQ ID NO: 49671, SEQ ID NO: 49681, SEQ ID NO: 49703, SEQ ID NO: 49728, SEQ ID NO: 49730, SEQ ID NO: 49737, SEQ ID NOs: 49742 to 49743, SEQ ID NOs: 49766 to 49767, SEQ ID NO: 49772, SEQ ID NO: 49782, SEQ ID NOs: 49787 to 49788, SEQ ID NO: 49793, SEQ ID NO: 49796, SEQ ID NO: 49805, SEQ ID NO: 49811, SEQ ID NO: 49823, SEQ ID NO: 49838, SEQ ID NO: 49850, SEQ ID NOs: 49859 to 49860, SEQ ID NO: 49873, SEQ ID NO: 49883, SEQ ID NO: 49892, SEQ ID NO: 49912, SEQ ID NO: 49928, SEQ ID NO: 49948, SEQ ID NO: 49961, SEQ ID NO: 49965, SEQ ID NO: 49987, SEQ ID NO: 49997, SEQ ID NOs: 50017 to 50018, SEQ ID NO: 50020, SEQ ID NO: 50022, SEQ ID NO: 50045, SEQ ID NO: 50062, SEQ ID NO: 50073, SEQ ID NO: 50079, SEQ ID NO: 50090, SEQ ID NO: 50107, SEQ ID NOs: 50111 to 50112, SEQ ID NO: 50123, SEQ ID NO: 50138, SEQ ID NOs: 50165 to 50167, SEQ ID NOs: 50227 to 50228, SEQ ID NO: 50243, SEQ ID NO: 50250, SEQ ID NO: 50254, SEQ ID NO: 50282, SEQ ID NO: 50284, SEQ ID NO: 50290, SEQ ID NO: 50297, SEQ ID NO: 50305, SEQ ID NO: 50309, SEQ ID NO: 50319, SEQ ID NO: 50331, SEQ ID NO: 50334, SEQ ID NO: 50339, SEQ ID NO: 50366, SEQ ID NO: 50388, SEQ ID NO: 50392, SEQ ID NO: 50394, SEQ ID NOs: 50400 to 50401, SEQ ID NO: 50418, SEQ ID NO: 50423, SEQ ID NO: 50428, SEQ ID NO: 50437, SEQ ID NO: 50443, SEQ ID NO: 50450, SEQ ID NO: 50464, SEQ ID NO: 50485, SEQ ID NO: 50494, SEQ ID NO: 50496, SEQ ID NO: 50499, SEQ ID NO: 50526, SEQ ID NO: 50528, SEQ ID NO: 50532, SEQ ID NO: 50538, SEQ ID NO: 50554, SEQ ID NO: 50557, SEQ ID NO: 50560, SEQ ID NO: 50564, SEQ ID NO: 50574, SEQ ID NO: 50585, SEQ ID NO: 50617, SEQ ID NO: 50632, SEQ ID NO: 50634, SEQ ID NO: 50644, SEQ ID NO: 50654, SEQ ID NO: 50678, SEQ ID NO: 50699, SEQ ID NO: 50714, SEQ ID NOs: 50728 to 50729, SEQ ID NO: 50735, SEQ ID NO: 50741, SEQ ID NO: 50744, SEQ ID NO: 50765, SEQ ID NO: 50769, SEQ ID NO: 50793, SEQ ID NO: 50818, SEQ ID NO: 50822, SEQ ID NO: 50826, SEQ ID NO: 50835, SEQ ID NO: 50842, SEQ ID NO: 50847, SEQ ID NO: 50849, SEQ ID NO: 50851, SEQ ID NO: 50893, SEQ ID NO: 50918, SEQ ID NOs: 50935 to 50936, SEQ ID NOs: 50941 to 50944, SEQ ID NOs: 50960 to 50962, SEQ ID NOs: 50975 to 50976, SEQ ID NOs: 51008 to 51009, SEQ ID NO: 51012, SEQ ID NOs: 51021 to 51022, SEQ ID NO: 51046, SEQ ID NO: 51062, SEQ ID NOs: 51068 to 51071, SEQ ID NOs: 51102 to 51104, SEQ ID NO: 51118, SEQ ID NOs: 51168 to 51169, SEQ ID NO: 51214, SEQ ID NO: 51235, SEQ ID NO: 51239, SEQ ID NO: 51241, SEQ ID NO: 51243, SEQ ID NO: 51257, SEQ ID NOs: 51263 to 51266, SEQ ID NOs: 51295 to 51297, SEQ ID NO: 51313, SEQ ID NO: 51405, SEQ ID NOs: 51413 to 51417, SEQ ID NO: 51524, SEQ ID NO: 51526, SEQ ID NO: 51693, SEQ ID NO: 51717, SEQ ID NO: 51762, SEQ ID NO: 51765, SEQ ID NO: 51853, SEQ ID NO: 51878, SEQ ID NO: 52035, SEQ ID NO: 52179, SEQ ID NO: 52275, SEQ ID NO: 52290, SEQ ID NO: 52379, SEQ ID NO: 52463, SEQ ID NO: 52497, SEQ ID NO: 52515, SEQ ID NO: 52610, SEQ ID NO: 52652, SEQ ID NO: 52660, SEQ ID NO: 52679, SEQ ID NO: 52686, SEQ ID NO: 52746, SEQ ID NO: 52758, SEQ ID NO: 52816, SEQ ID NO: 52944, SEQ ID NO: 52984, SEQ ID NO: 52988, SEQ ID NO: 52991, SEQ ID NO: 53045, SEQ ID NO: 53118, SEQ ID NO: 53166, SEQ ID NO: 53338, SEQ ID NO: 53382, SEQ ID NO: 53464, SEQ ID NO: 53478, SEQ ID NO: 53511, SEQ ID NO: 53519, SEQ ID NO: 53548, SEQ ID NO: 53581, SEQ ID NO: 53653, SEQ ID NO: 53968, SEQ ID NO: 54024, SEQ ID NO: 54038, SEQ ID NO: 54045, SEQ ID NO: 54080, SEQ ID NO: 54097, SEQ ID NO: 54111, SEQ ID NO: 54238, SEQ ID NO: 54251, SEQ ID NO: 54269, SEQ ID NO: 54409, SEQ ID NO: 54418, SEQ ID NO: 54442, SEQ ID NO: 54473, SEQ ID NO: 54543, SEQ ID NO: 54713, SEQ ID NO: 54719, SEQ ID NO: 54727, SEQ ID NO: 54772, SEQ ID NO: 54788, SEQ ID NO: 54863, SEQ ID NO: 54877, SEQ ID NO: 54945, SEQ ID NO: 54960, SEQ ID NO: 55004, SEQ ID NO: 55109, SEQ ID NO: 55207, SEQ ID NO: 55230, SEQ ID NO: 55300, SEQ ID NO: 55355, SEQ ID NO: 55437, SEQ ID NO: 55516, SEQ ID NO: 55695, SEQ ID NO: 55758, SEQ ID NO: 55801, SEQ ID NO: 55814, SEQ ID NO: 55875, SEQ ID NO: 55879, SEQ ID NO: 55886, SEQ ID NO: 55911, SEQ ID NO: 55986, SEQ ID NO: 56043, SEQ ID NO: 56052, SEQ ID NO: 56175, SEQ ID NO: 56240, SEQ ID NO: 56277, SEQ ID NO: 56352, SEQ ID NO: 56418, SEQ ID NO: 56435, SEQ ID NO: 56521, SEQ ID NO: 56593, SEQ ID NO: 56609, SEQ ID NO: 56629, SEQ ID NOs: 56649 to 56650, SEQ ID NO: 56793, SEQ ID NO: 56836, SEQ ID NO: 56852, SEQ ID NO: 56902, SEQ ID NO: 57155, SEQ ID NO: 57157, SEQ ID NO: 57265, SEQ ID NO: 57278, SEQ ID NO: 57323, SEQ ID NO: 57472, SEQ ID NO: 57535, SEQ ID NO: 57550, SEQ ID NO: 57561, SEQ ID NO: 57568, SEQ ID NO: 57639, SEQ ID NO: 57655, SEQ ID NO: 57790, SEQ ID NO: 57811, SEQ ID NO: 57904, SEQ ID NO: 57944, SEQ ID NO: 58040, SEQ ID NO: 58064, SEQ ID NO: 58075, SEQ ID NO: 58145, SEQ ID NO: 58199, SEQ ID NO: 58223, SEQ ID NO: 58226, SEQ ID NO: 58309, SEQ ID NO: 58349, SEQ ID NO: 58395, SEQ ID NO: 58411, SEQ ID NO: 58433, SEQ ID NO: 58547, SEQ ID NO: 58589, SEQ ID NO: 58679, SEQ ID NOs: 58683 to 58684, SEQ ID NO: 58815, SEQ ID NO: 58823, SEQ ID NO: 58855, SEQ ID NO: 58932, SEQ ID NO: 59223, SEQ ID NO: 59246, SEQ ID NO: 59248, SEQ ID NO: 59530, SEQ ID NO: 59622, SEQ ID NO: 59755, SEQ ID NO: 59757, SEQ ID NO: 59775, SEQ ID NO: 59816, SEQ ID NO: 59821, SEQ ID NO: 59828, SEQ ID NO: 59856, SEQ ID NO: 59871, SEQ ID NO: 59873, SEQ ID NO: 59875, SEQ ID NO: 59960, SEQ ID NO: 59967, SEQ ID NO: 60005, SEQ ID NOs: 60046 to 60047, SEQ ID NO: 60081, SEQ ID NO: 60224, SEQ ID NO: 60228, SEQ ID NO: 60276, SEQ ID NO: 60289, SEQ ID NO: 60292, SEQ ID NOs: 60422 to 60423, SEQ ID NO: 60444, SEQ ID NOs: 60456 to 68237, SEQ ID NO: 211911, SEQ ID NOs: 212086 to 212095, SEQ ID NOs: 212435 to 212440, SEQ ID NOs: 212681 to 212684, SEQ ID NOs: 212858 to 212860, SEQ ID NOs: 213516 to 213517, SEQ ID NOs: 213529 to 213531, SEQ ID NOs: 213602 to 213611, SEQ ID NOs: 213719 to 213720, SEQ ID NO: 213899, SEQ ID NOs: 214004 to 214012, SEQ ID NO: 214607, SEQ ID NOs: 214647 to 214649, SEQ ID NOs: 214672 to 214679, SEQ ID NOs: 214774 to 214775, SEQ ID NO: 214777, SEQ ID NO: 214779, SEQ ID NO: 214782, SEQ ID NOs: 215373 to 215415, SEQ ID NO: 215494, SEQ ID NO: 215497, SEQ ID NO: 215679, SEQ ID NO: 216244, SEQ ID NO: 216246, SEQ ID NOs: 216383 to 216401, SEQ ID NOs: 217184 to 217192, SEQ ID NO: 217200, SEQ ID NO: 217362, SEQ ID NOs: 217708 to 217712, SEQ ID NO: 217719, SEQ ID NO: 219238, SEQ ID NOs: 219742 to 219744, SEQ ID NO: 219747, SEQ ID NO: 219749, SEQ ID NO: 219751, SEQ ID NOs: 219773 to 219781, SEQ ID NOs: 219994 to 220030, SEQ ID NOs: 220318 to 220319, SEQ ID NO: 220327, SEQ ID NO: 220670, SEQ ID NO: 220815, SEQ ID NO: 220820, SEQ ID NOs: 221197 to 221234, SEQ ID NO: 221998, SEQ ID NO: 222000, SEQ ID NO: 223092, SEQ ID NO: 223095, SEQ ID NO: 223097, SEQ ID NO: 223099, SEQ ID NO: 223119, SEQ ID NO: 223121, SEQ ID NOs: 223184 to 223190, SEQ ID NOs: 223250 to 223283, SEQ ID NO: 223319, SEQ ID NO: 230922, SEQ ID NOs: 232805 to 232806, SEQ ID NO: 232846, or SEQ ID NOs: 236016 to 247058.

In some embodiments, the amino acid sequence for a MHC class I and/or MHC class II peptides may be used to create a single target (individual) or combined peptide vaccine for the MAGC1 protein having between about 2 and about 40 peptides. In some embodiments, any one of the peptides in the vaccine for the MAGC1 protein comprises one or more of the SEQ ID NO: 41352, SEQ ID NO: 41478, SEQ ID NO: 41495, SEQ ID NO: 41725, SEQ ID NO: 41847, SEQ ID NO: 42129, SEQ ID NO: 42135, SEQ ID NO: 42168, SEQ ID NO: 42170, SEQ ID NO: 42195, SEQ ID NO: 42218, SEQ ID NO: 42229, SEQ ID NO: 42458, SEQ ID NO: 42545, SEQ ID NO: 42628, SEQ ID NO: 42653, SEQ ID NO: 42685, SEQ ID NO: 42703, SEQ ID NO: 42872, SEQ ID NO: 43008, SEQ ID NO: 43046, SEQ ID NO: 43083, SEQ ID NO: 43333, SEQ ID NO: 43429, SEQ ID NO: 43564, SEQ ID NO: 43780, SEQ ID NO: 43836, SEQ ID NO: 43881, SEQ ID NO: 43898, SEQ ID NO: 43932, SEQ ID NO: 44048, SEQ ID NO: 44181, SEQ ID NO: 44328, SEQ ID NO: 44456, SEQ ID NO: 44523, SEQ ID NO: 44566, SEQ ID NO: 44773, SEQ ID NO: 44877, SEQ ID NO: 45197, SEQ ID NO: 45385, SEQ ID NO: 45450, SEQ ID NO: 45556, SEQ ID NO: 45580, SEQ ID NO: 45584, SEQ ID NO: 45599, SEQ ID NO: 45765, SEQ ID NO: 45829, SEQ ID NO: 45894, SEQ ID NO: 45915, SEQ ID NO: 46273, SEQ ID NO: 46400, SEQ ID NO: 46421, SEQ ID NO: 46457, SEQ ID NO: 46459, SEQ ID NO: 46484, SEQ ID NO: 46666, SEQ ID NO: 46678, SEQ ID NO: 46689, SEQ ID NO: 46981, SEQ ID NO: 46991, SEQ ID NO: 46993, SEQ ID NO: 47047, SEQ ID NO: 47151, SEQ ID NO: 47324, SEQ ID NO: 47432, SEQ ID NO: 47592, SEQ ID NO: 47673, SEQ ID NO: 47895, SEQ ID NO: 47960, SEQ ID NO: 47964, SEQ ID NO: 47979, SEQ ID NO: 47984, SEQ ID NO: 48034, SEQ ID NO: 48113, SEQ ID NO: 48118, SEQ ID NO: 48300, SEQ ID NO: 48436, SEQ ID NOs: 48461 to 48462, SEQ ID NO: 48469, SEQ ID NO: 48574, SEQ ID NO: 48680, SEQ ID NO: 48796, SEQ ID NO: 48832, SEQ ID NO: 48838, SEQ ID NO: 48845, SEQ ID NO: 48877, SEQ ID NO: 48947, SEQ ID NO: 49019, SEQ ID NO: 49111, SEQ ID NO: 49176, SEQ ID NO: 49263, SEQ ID NO: 49395, SEQ ID NO: 49462, SEQ ID NO: 49557, SEQ ID NO: 49823, SEQ ID NO: 49883, SEQ ID NO: 50062, SEQ ID NO: 50167, SEQ ID NO: 50305, SEQ ID NO: 50394, SEQ ID NO: 50401, SEQ ID NO: 50423, SEQ ID NO: 50428, SEQ ID NO: 50443, SEQ ID NO: 50450, SEQ ID NO: 50564, SEQ ID NO: 50574, SEQ ID NO: 50632, SEQ ID NO: 50678, SEQ ID NOs: 68238 to 95592, and SEQ ID NOs: 247059 to 281349. In some embodiments, any one of the peptides in the MAGC1 vaccine comprise an amino acid sequence 80, 81, 82, 83, 84, 85, 86, 87, 88, 89, 90, 91, 92, 93, 94, 95, 96, 97, 98 or 99% identical to SEQ ID NO: 41352, SEQ ID NO: 41478, SEQ ID NO: 41495, SEQ ID NO: 41725, SEQ ID NO: 41847, SEQ ID NO: 42129, SEQ ID NO: 42135, SEQ ID NO: 42168, SEQ ID NO: 42170, SEQ ID NO: 42195, SEQ ID NO: 42218, SEQ ID NO: 42229, SEQ ID NO: 42458, SEQ ID NO: 42545, SEQ ID NO: 42628, SEQ ID NO: 42653, SEQ ID NO: 42685, SEQ ID NO: 42703, SEQ ID NO: 42872, SEQ ID NO: 43008, SEQ ID NO: 43046, SEQ ID NO: 43083, SEQ ID NO: 43333, SEQ ID NO: 43429, SEQ ID NO: 43564, SEQ ID NO: 43780, SEQ ID NO: 43836, SEQ ID NO: 43881, SEQ ID NO: 43898, SEQ ID NO: 43932, SEQ ID NO: 44048, SEQ ID NO: 44181, SEQ ID NO: 44328, SEQ ID NO: 44456, SEQ ID NO: 44523, SEQ ID NO: 44566, SEQ ID NO: 44773, SEQ ID NO: 44877, SEQ ID NO: 45197, SEQ ID NO: 45385, SEQ ID NO: 45450, SEQ ID NO: 45556, SEQ ID NO: 45580, SEQ ID NO: 45584, SEQ ID NO: 45599, SEQ ID NO: 45765, SEQ ID NO: 45829, SEQ ID NO: 45894, SEQ ID NO: 45915, SEQ ID NO: 46273, SEQ ID NO: 46400, SEQ ID NO: 46421, SEQ ID NO: 46457, SEQ ID NO: 46459, SEQ ID NO: 46484, SEQ ID NO: 46666, SEQ ID NO: 46678, SEQ ID NO: 46689, SEQ ID NO: 46981, SEQ ID NO: 46991, SEQ ID NO: 46993, SEQ ID NO: 47047, SEQ ID NO: 47151, SEQ ID NO: 47324, SEQ ID NO: 47432, SEQ ID NO: 47592, SEQ ID NO: 47673, SEQ ID NO: 47895, SEQ ID NO: 47960, SEQ ID NO: 47964, SEQ ID NO: 47979, SEQ ID NO: 47984, SEQ ID NO: 48034, SEQ ID NO: 48113, SEQ ID NO: 48118, SEQ ID NO: 48300, SEQ ID NO: 48436, SEQ ID NOs: 48461 to 48462, SEQ ID NO: 48469, SEQ ID NO: 48574, SEQ ID NO: 48680, SEQ ID NO: 48796, SEQ ID NO: 48832, SEQ ID NO: 48838, SEQ ID NO: 48845, SEQ ID NO: 48877, SEQ ID NO: 48947, SEQ ID NO: 49019, SEQ ID NO: 49111, SEQ ID NO: 49176, SEQ ID NO: 49263, SEQ ID NO: 49395, SEQ ID NO: 49462, SEQ ID NO: 49557, SEQ ID NO: 49823, SEQ ID NO: 49883, SEQ ID NO: 50062, SEQ ID NO: 50167, SEQ ID NO: 50305, SEQ ID NO: 50394, SEQ ID NO: 50401, SEQ ID NO: 50423, SEQ ID NO: 50428, SEQ ID NO: 50443, SEQ ID NO: 50450, SEQ ID NO: 50564, SEQ ID NO: 50574, SEQ ID NO: 50632, SEQ ID NO: 50678, SEQ ID NOs: 68238 to 95592, or SEQ ID NOs: 247059 to 281349.

In some embodiments, the amino acid sequence for a MHC class I and/or MHC class II peptides may be used to create a single target (individual) or combined peptide vaccine for the MAGC3 protein having between about 2 and about 40 peptides. In some embodiments, any one of the peptides in the vaccine for the MAGC3 protein comprises one or more of the SEQ ID NO: 41647, SEQ ID NO: 50668, SEQ ID NO: 50905, SEQ ID NOs: 51039 to 51040, SEQ ID NO: 68257, SEQ ID NO: 68285, SEQ ID NO: 68288, SEQ ID NO: 68290, SEQ ID NO: 68305, SEQ ID NO: 68389, SEQ ID NO: 68419, SEQ ID NO: 68470, SEQ ID NO: 68510, SEQ ID NO: 68519, SEQ ID NO: 68592, SEQ ID NO: 68603, SEQ ID NO: 68684, SEQ ID NO: 68688, SEQ ID NO: 68747, SEQ ID NO: 68760, SEQ ID NO: 68778, SEQ ID NO: 68786, SEQ ID NO: 68855, SEQ ID NO: 68898, SEQ ID NO: 68900, SEQ ID NO: 68927, SEQ ID NO: 68961, SEQ ID NO: 69026, SEQ ID NO: 69041, SEQ ID NO: 69047, SEQ ID NO: 69148, SEQ ID NO: 69173, SEQ ID NO: 69180, SEQ ID NO: 69192, SEQ ID NO: 69227, SEQ ID NO: 69311, SEQ ID NO: 69330, SEQ ID NO: 69333, SEQ ID NO: 69346, SEQ ID NO: 69356, SEQ ID NO: 69393, SEQ ID NO: 69421, SEQ ID NO: 69437, SEQ ID NO: 69451, SEQ ID NO: 69500, SEQ ID NO: 69505, SEQ ID NO: 69517, SEQ ID NO: 69540, SEQ ID NO: 69559, SEQ ID NO: 69571, SEQ ID NO: 69586, SEQ ID NO: 69589, SEQ ID NO: 69591, SEQ ID NO: 69619, SEQ ID NO: 69631, SEQ ID NO: 69633, SEQ ID NO: 69644, SEQ ID NO: 69649, SEQ ID NO: 69747, SEQ ID NO: 69764, SEQ ID NO: 69767, SEQ ID NO: 69790, SEQ ID NO: 69832, SEQ ID NO: 69836, SEQ ID NO: 69882, SEQ ID NO: 69999, SEQ ID NO: 70012, SEQ ID NO: 70036, SEQ ID NO: 70050, SEQ ID NO: 70066, SEQ ID NO: 70069, SEQ ID NO: 70109, SEQ ID NO: 70159, SEQ ID NO: 70165, SEQ ID NO: 70175, SEQ ID NO: 70177, SEQ ID NO: 70188, SEQ ID NO: 70284, SEQ ID NO: 70323, SEQ ID NO: 70326, SEQ ID NO: 70428, SEQ ID NO: 70455, SEQ ID NO: 70570, SEQ ID NO: 70606, SEQ ID NO: 70635, SEQ ID NO: 70676, SEQ ID NO: 70692, SEQ ID NO: 70716, SEQ ID NO: 70728, SEQ ID NO: 70735, SEQ ID NO: 70750, SEQ ID NO: 70764, SEQ ID NO: 70770, SEQ ID NO: 70806, SEQ ID NO: 70968, SEQ ID NO: 70997, SEQ ID NO: 71049, SEQ ID NO: 71075, SEQ ID NO: 71090, SEQ ID NO: 71117, SEQ ID NO: 71151, SEQ ID NO: 71176, SEQ ID NO: 71193, SEQ ID NO: 71203, SEQ ID NO: 71239, SEQ ID NO: 71247, SEQ ID NO: 71249, SEQ ID NO: 71275, SEQ ID NO: 71287, SEQ ID NO: 71328, SEQ ID NOs: 71359 to 71360, SEQ ID NOs: 71367 to 71368, SEQ ID NO: 71392, SEQ ID NO: 71414, SEQ ID NO: 71449, SEQ ID NO: 71476, SEQ ID NO: 71482, SEQ ID NO: 71543, SEQ ID NO: 71547, SEQ ID NO: 71560, SEQ ID NO: 71585, SEQ ID NO: 71612, SEQ ID NO: 71620, SEQ ID NO: 71628, SEQ ID NO: 71636, SEQ ID NO: 71673, SEQ ID NOs: 71688 to 71689, SEQ ID NO: 71696, SEQ ID NO: 71700, SEQ ID NO: 71718, SEQ ID NO: 71725, SEQ ID NO: 71807, SEQ ID NO: 71919, SEQ ID NO: 71935, SEQ ID NO: 71943, SEQ ID NO: 71948, SEQ ID NOs: 71987 to 71988, SEQ ID NO: 72045, SEQ ID NO: 72055, SEQ ID NO: 72076, SEQ ID NO: 72085, SEQ ID NO: 72102, SEQ ID NO: 72159, SEQ ID NO: 72183, SEQ ID NO: 72216, SEQ ID NO: 72241, SEQ ID NO: 72331, SEQ ID NO: 72364, SEQ ID NO: 72372, SEQ ID NO: 72390, SEQ ID NO: 72448, SEQ ID NO: 72528, SEQ ID NO: 72595, SEQ ID NO: 72604, SEQ ID NO: 72648, SEQ ID NO: 72667, SEQ ID NO: 72685, SEQ ID NO: 72721, SEQ ID NO: 72751, SEQ ID NO: 72755, SEQ ID NO: 72805, SEQ ID NO: 72810, SEQ ID NO: 72831, SEQ ID NO: 72837, SEQ ID NO: 72862, SEQ ID NO: 72885, SEQ ID NO: 72989, SEQ ID NO: 73014, SEQ ID NOs: 73045 to 73046, SEQ ID NO: 73086, SEQ ID NO: 73094, SEQ ID NO: 73113, SEQ ID NO: 73122, SEQ ID NO: 73161, SEQ ID NO: 73191, SEQ ID NO: 73224, SEQ ID NOs: 73232 to 73233, SEQ ID NO: 73238, SEQ ID NO: 73290, SEQ ID NO: 73327, SEQ ID NO: 73377, SEQ ID NO: 73382, SEQ ID NO: 73404, SEQ ID NO: 73406, SEQ ID NO: 73422, SEQ ID NOs: 73428 to 73429, SEQ ID NO: 73466, SEQ ID NO: 73475, SEQ ID NO: 73521, SEQ ID NO: 73523, SEQ ID NO: 73532, SEQ ID NO: 73550, SEQ ID NO: 73560, SEQ ID NO: 73591, SEQ ID NO: 73597, SEQ ID NO: 73644, SEQ ID NO: 73657, SEQ ID NO: 73660, SEQ ID NO: 73689, SEQ ID NO: 73729, SEQ ID NO: 73733, SEQ ID NO: 73873, SEQ ID NO: 73886, SEQ ID NO: 73930, SEQ ID NO: 73957, SEQ ID NOs: 73991 to 73992, SEQ ID NO: 74045, SEQ ID NO: 74047, SEQ ID NO: 74072, SEQ ID NO: 74080, SEQ ID NOs: 74096 to 74097, SEQ ID NO: 74107, SEQ ID NO: 74203, SEQ ID NO: 74208, SEQ ID NO: 74210, SEQ ID NO: 74238, SEQ ID NO: 74302, SEQ ID NO: 74350, SEQ ID NO: 74352, SEQ ID NO: 74411, SEQ ID NO: 74448, SEQ ID NO: 74473, SEQ ID NO: 74482, SEQ ID NO: 74515, SEQ ID NO: 74527, SEQ ID NO: 74560, SEQ ID NO: 74616, SEQ ID NO: 74649, SEQ ID NO: 74672, SEQ ID NO: 74674, SEQ ID NO: 74737, SEQ ID NO: 74782, SEQ ID NO: 74808, SEQ ID NO: 74810, SEQ ID NO: 74835, SEQ ID NO: 74886, SEQ ID NO: 74901, SEQ ID NO: 74946, SEQ ID NOs: 74975 to 74976, SEQ ID NO: 75017, SEQ ID NO: 75021, SEQ ID NO: 75040, SEQ ID NO: 75049, SEQ ID NO: 75063, SEQ ID NO: 75066, SEQ ID NO: 75072, SEQ ID NO: 75092, SEQ ID NO: 75094, SEQ ID NO: 75099, SEQ ID NO: 75111, SEQ ID NO: 75148, SEQ ID NO: 75245, SEQ ID NO: 75269, SEQ ID NO: 75388, SEQ ID NO: 75403, SEQ ID NO: 75429, SEQ ID NO: 75455, SEQ ID NO: 75470, SEQ ID NO: 75489, SEQ ID NO: 75506, SEQ ID NO: 75529, SEQ ID NO: 75547, SEQ ID NO: 75551, SEQ ID NOs: 75576 to 75577, SEQ ID NO: 75595, SEQ ID NO: 75701, SEQ ID NO: 75716, SEQ ID NO: 75747, SEQ ID NO: 75757, SEQ ID NO: 75762, SEQ ID NO: 75766, SEQ ID NO: 75874, SEQ ID NO: 75915, SEQ ID NO: 75933, SEQ ID NO: 75975, SEQ ID NO: 75979, SEQ ID NO: 76016, SEQ ID NO: 76023, SEQ ID NO: 76034, SEQ ID NO: 76040, SEQ ID NO: 76064, SEQ ID NO: 76076, SEQ ID NO: 76102, SEQ ID NOs: 76147 to 76148, SEQ ID NO: 76189, SEQ ID NO: 76199, SEQ ID NO: 76369, SEQ ID NO: 76375, SEQ ID NO: 76397, SEQ ID NO: 76410, SEQ ID NO: 76435, SEQ ID NO: 76446, SEQ ID NO: 76451, SEQ ID NOs: 76456 to 76458, SEQ ID NO: 76492, SEQ ID NO: 76544, SEQ ID NO: 76569, SEQ ID NO: 76574, SEQ ID NO: 76611, SEQ ID NO: 76654, SEQ ID NO: 76710, SEQ ID NO: 76753, SEQ ID NO: 76769, SEQ ID NO: 76781, SEQ ID NO: 76797, SEQ ID NO: 76803, SEQ ID NO: 76858, SEQ ID NO: 76860, SEQ ID NO: 76879, SEQ ID NO: 76943, SEQ ID NO: 76971, SEQ ID NO: 76981, SEQ ID NO: 77091, SEQ ID NO: 77133, SEQ ID NOs: 77193 to 77194, SEQ ID NO: 77210, SEQ ID NO: 77219, SEQ ID NO: 77237, SEQ ID NO: 77246, SEQ ID NO: 77251, SEQ ID NO: 77281, SEQ ID NO: 77293, SEQ ID NO: 77323, SEQ ID NO: 77334, SEQ ID NO: 77339, SEQ ID NO: 77396, SEQ ID NO: 77423, SEQ ID NO: 77433, SEQ ID NO: 77437, SEQ ID NO: 77442, SEQ ID NO: 77453, SEQ ID NO: 77485, SEQ ID NO: 77579, SEQ ID NO: 77627, SEQ ID NO: 77639, SEQ ID NO: 77644, SEQ ID NO: 77703, SEQ ID NO: 77773, SEQ ID NO: 77814, SEQ ID NO: 77868, SEQ ID NO: 77874, SEQ ID NO: 77900, SEQ ID NO: 77925, SEQ ID NO: 77995, SEQ ID NO: 78017, SEQ ID NO: 78083, SEQ ID NO: 78086, SEQ ID NO: 78090, SEQ ID NO: 78131, SEQ ID NO: 78139, SEQ ID NO: 78228, SEQ ID NO: 78248, SEQ ID NO: 78260, SEQ ID NO: 78346, SEQ ID NO: 78352, SEQ ID NO: 78377, SEQ ID NO: 78416, SEQ ID NO: 78421, SEQ ID NO: 78440, SEQ ID NO: 78521, SEQ ID NO: 78530, SEQ ID NO: 78532, SEQ ID NO: 78546, SEQ ID NO: 78600, SEQ ID NO: 78631, SEQ ID NO: 78671, SEQ ID NO: 78709, SEQ ID NO: 78714, SEQ ID NO: 78730, SEQ ID NO: 78738, SEQ ID NO: 78810, SEQ ID NO: 78855, SEQ ID NO: 78883, SEQ ID NO: 78917, SEQ ID NOs: 78919 to 78920, SEQ ID NO: 78928, SEQ ID NO: 79035, SEQ ID NO: 79048, SEQ ID NO: 79056, SEQ ID NO: 79086, SEQ ID NO: 79091, SEQ ID NO: 79095, SEQ ID NO: 79107, SEQ ID NO: 79109, SEQ ID NO: 79136, SEQ ID NO: 79142, SEQ ID NO: 79147, SEQ ID NO: 79151, SEQ ID NO: 79194, SEQ ID NO: 79196, SEQ ID NO: 79227, SEQ ID NO: 79247, SEQ ID NO: 79253, SEQ ID NO: 79255, SEQ ID NO: 79269, SEQ ID NO: 79310, SEQ ID NO: 79331, SEQ ID NO: 79357, SEQ ID NO: 79406, SEQ ID NO: 79437, SEQ ID NO: 79448, SEQ ID NO: 79453, SEQ ID NO: 79480, SEQ ID NO: 79483, SEQ ID NO: 79486, SEQ ID NO: 79504, SEQ ID NO: 79508, SEQ ID NO: 79516, SEQ ID NO: 79548, SEQ ID NO: 79575, SEQ ID NO: 79588, SEQ ID NO: 79592, SEQ ID NO: 79609, SEQ ID NO: 79626, SEQ ID NO: 79640, SEQ ID NO: 79697, SEQ ID NO: 79746, SEQ ID NO: 79751, SEQ ID NO: 79766, SEQ ID NO: 79784, SEQ ID NO: 79787, SEQ ID NO: 79816, SEQ ID NO: 79834, SEQ ID NO: 79853, SEQ ID NO: 79858, SEQ ID NO: 79861, SEQ ID NO: 79874, SEQ ID NO: 79877, SEQ ID NO: 79906, SEQ ID NO: 79909, SEQ ID NO: 79939, SEQ ID NO: 79958, SEQ ID NO: 79987, SEQ ID NO: 80000, SEQ ID NO: 80027, SEQ ID NO: 80040, SEQ ID NO: 80139, SEQ ID NO: 80141, SEQ ID NO: 80212, SEQ ID NO: 80232, SEQ ID NO: 80237, SEQ ID NO: 80241, SEQ ID NO: 80318, SEQ ID NO: 80320, SEQ ID NOs: 80367 to 80368, SEQ ID NO: 80398, SEQ ID NO: 80421, SEQ ID NO: 80461, SEQ ID NO: 80486, SEQ ID NO: 80513, SEQ ID NO: 80527, SEQ ID NO: 80555, SEQ ID NO: 80574, SEQ ID NO: 80583, SEQ ID NO: 80627, SEQ ID NO: 80673, SEQ ID NOs: 80703 to 80704, SEQ ID NOs: 80718 to 80719, SEQ ID NO: 80725, SEQ ID NO: 80796, SEQ ID NO: 80804, SEQ ID NO: 80833, SEQ ID NO: 80869, SEQ ID NO: 80903, SEQ ID NO: 80931, SEQ ID NO: 80936, SEQ ID NO: 80946, SEQ ID NO: 80990, SEQ ID NO: 81021, SEQ ID NO: 81042, SEQ ID NO: 81046, SEQ ID NO: 81054, SEQ ID NO: 81066, SEQ ID NO: 81145, SEQ ID NO: 81166, SEQ ID NO: 81168, SEQ ID NO: 81175, SEQ ID NO: 81185, SEQ ID NO: 81207, SEQ ID NO: 81251, SEQ ID NO: 81259, SEQ ID NO: 81302, SEQ ID NO: 81337, SEQ ID NO: 81342, SEQ ID NO: 81386, SEQ ID NO: 81428, SEQ ID NO: 81446, SEQ ID NO: 81458, SEQ ID NO: 81488, SEQ ID NO: 81505, SEQ ID NO: 81517, SEQ ID NO: 81566, SEQ ID NO: 81687, SEQ ID NO: 81690, SEQ ID NO: 81694, SEQ ID NO: 81713, SEQ ID NO: 81755, SEQ ID NO: 81825, SEQ ID NO: 81856, SEQ ID NO: 81873, SEQ ID NO: 81904, SEQ ID NO: 81916, SEQ ID NO: 81938, SEQ ID NO: 81951, SEQ ID NO: 81963, SEQ ID NO: 82045, SEQ ID NO: 82085, SEQ ID NO: 82117, SEQ ID NO: 82136, SEQ ID NO: 82193, SEQ ID NO: 82239, SEQ ID NO: 82241, SEQ ID NO: 82259, SEQ ID NO: 82320, SEQ ID NO: 82382, SEQ ID NO: 82417, SEQ ID NO: 82459, SEQ ID NO: 82474, SEQ ID NO: 82514, SEQ ID NO: 82556, SEQ ID NO: 82581, SEQ ID NO: 82596, SEQ ID NO: 82633, SEQ ID NO: 82644, SEQ ID NO: 82649, SEQ ID NO: 82676, SEQ ID NO: 82681, SEQ ID NO: 82718, SEQ ID NO: 82731, SEQ ID NO: 82769, SEQ ID NO: 82817, SEQ ID NO: 82870, SEQ ID NO: 82872, SEQ ID NO: 82885, SEQ ID NOs: 82920 to 82921, SEQ ID NO: 82955, SEQ ID NO: 82960, SEQ ID NO: 82985, SEQ ID NO: 82988, SEQ ID NO: 83013, SEQ ID NO: 83018, SEQ ID NO: 83051, SEQ ID NO: 83062, SEQ ID NO: 83099, SEQ ID NO: 83149, SEQ ID NO: 83185, SEQ ID NO: 83193, SEQ ID NO: 83208, SEQ ID NO: 83225, SEQ ID NO: 83235, SEQ ID NO: 83243, SEQ ID NO: 83260, SEQ ID NO: 83269, SEQ ID NO: 83286, SEQ ID NO: 83293, SEQ ID NO: 83349, SEQ ID NO: 83383, SEQ ID NO: 83409, SEQ ID NO: 83426, SEQ ID NO: 83438, SEQ ID NO: 83549, SEQ ID NO: 83605, SEQ ID NO: 83686, SEQ ID NO: 83704, SEQ ID NO: 83714, SEQ ID NO: 83806, SEQ ID NO: 83811, SEQ ID NO: 83821, SEQ ID NOs: 83863 to 83864, SEQ ID NO: 83872, SEQ ID NO: 83891, SEQ ID NO: 83899, SEQ ID NO: 83901, SEQ ID NO: 83921, SEQ ID NO: 83970, SEQ ID NO: 83974, SEQ ID NO: 83988, SEQ ID NO: 84002, SEQ ID NO: 84025, SEQ ID NO: 84070, SEQ ID NO: 84090, SEQ ID NO: 84154, SEQ ID NO: 84182, SEQ ID NOs: 84187 to 84188, SEQ ID NO: 84201, SEQ ID NO: 84212, SEQ ID NO: 84232, SEQ ID NO: 84238, SEQ ID NO: 84248, SEQ ID NO: 84306, SEQ ID NO: 84324, SEQ ID NO: 84348, SEQ ID NO: 84376, SEQ ID NO: 84387, SEQ ID NO: 84390, SEQ ID NO: 84422, SEQ ID NO: 84428, SEQ ID NO: 84437, SEQ ID NO: 84445, SEQ ID NO: 84489, SEQ ID NO: 84501, SEQ ID NO: 84534, SEQ ID NO: 84558, SEQ ID NO: 84593, SEQ ID NO: 84676, SEQ ID NO: 84782, SEQ ID NO: 84795, SEQ ID NO: 84822, SEQ ID NO: 84885, SEQ ID NO: 84991, SEQ ID NO: 85010, SEQ ID NO: 85024, SEQ ID NO: 85054, SEQ ID NO: 85056, SEQ ID NO: 85060, SEQ ID NO: 85101, SEQ ID NO: 85117, SEQ ID NO: 85146, SEQ ID NO: 85219, SEQ ID NOs: 85242 to 85243, SEQ ID NO: 85266, SEQ ID NO: 85310, SEQ ID NO: 85349, SEQ ID NO: 85361, SEQ ID NO: 85370, SEQ ID NO: 85379, SEQ ID NO: 85399, SEQ ID NO: 85417, SEQ ID NO: 85435, SEQ ID NO: 85447, SEQ ID NO: 85463, SEQ ID NO: 85519, SEQ ID NO: 85528, SEQ ID NO: 85530, SEQ ID NO: 85602, SEQ ID NO: 85624, SEQ ID NO: 85629, SEQ ID NO: 85725, SEQ ID NO: 85737, SEQ ID NO: 85848, SEQ ID NO: 85878, SEQ ID NO: 85910, SEQ ID NO: 85959, SEQ ID NO: 85963, SEQ ID NO: 85967, SEQ ID NOs: 85985 to 85986, SEQ ID NO: 86003, SEQ ID NO: 86076, SEQ ID NO: 86159, SEQ ID NO: 86208, SEQ ID NO: 86248, SEQ ID NO: 86279, SEQ ID NO: 86343, SEQ ID NO: 86366, SEQ ID NO: 86417, SEQ ID NO: 86431, SEQ ID NO: 86433, SEQ ID NO: 86473, SEQ ID NO: 86523, SEQ ID NOs: 86526 to 86527, SEQ ID NO: 86541, SEQ ID NO: 86567, SEQ ID NO: 86586, SEQ ID NO: 86589, SEQ ID NO: 86599, SEQ ID NO: 86633, SEQ ID NO: 86665, SEQ ID NO: 86688, SEQ ID NO: 86698, SEQ ID NO: 86725, SEQ ID NO: 86761, SEQ ID NO: 86775, SEQ ID NO: 86825, SEQ ID NO: 86914, SEQ ID NO: 86929, SEQ ID NO: 86940, SEQ ID NO: 86969, SEQ ID NO: 86994, SEQ ID NO: 87027, SEQ ID NO: 87041, SEQ ID NO: 87157, SEQ ID NO: 87160, SEQ ID NO: 87185, SEQ ID NO: 87251, SEQ ID NO: 87255, SEQ ID NO: 87300, SEQ ID NO: 87321, SEQ ID NO: 87358, SEQ ID NO: 87425, SEQ ID NO: 87427, SEQ ID NO: 87431, SEQ ID NO: 87474, SEQ ID NO: 87536, SEQ ID NO: 87550, SEQ ID NO: 87576, SEQ ID NO: 87603, SEQ ID NO: 87623, SEQ ID NO: 87626, SEQ ID NO: 87638, SEQ ID NO: 87708, SEQ ID NO: 87733, SEQ ID NO: 87785, SEQ ID NO: 87799, SEQ ID NO: 87818, SEQ ID NOs: 87865 to 87866, SEQ ID NO: 87875, SEQ ID NO: 87917, SEQ ID NO: 87946, SEQ ID NO: 87951, SEQ ID NO: 88016, SEQ ID NO: 88061, SEQ ID NO: 88120, SEQ ID NO: 88122, SEQ ID NO: 88125, SEQ ID NO: 88144, SEQ ID NO: 88178, SEQ ID NO: 88180, SEQ ID NO: 88186, SEQ ID NO: 88203, SEQ ID NO: 88241, SEQ ID NO: 88272, SEQ ID NO: 88285, SEQ ID NO: 88288, SEQ ID NO: 88359, SEQ ID NO: 88384, SEQ ID NO: 88390, SEQ ID NO: 88474, SEQ ID NO: 88522, SEQ ID NO: 88563, SEQ ID NO: 88643, SEQ ID NO: 88659, SEQ ID NO: 88708, SEQ ID NO: 88710, SEQ ID NO: 88731, SEQ ID NO: 88751, SEQ ID NO: 88806, SEQ ID NO: 88975, SEQ ID NO: 88999, SEQ ID NO: 89010, SEQ ID NO: 89012, SEQ ID NO: 89028, SEQ ID NO: 89035, SEQ ID NO: 89037, SEQ ID NO: 89039, SEQ ID NO: 89045, SEQ ID NO: 89073, SEQ ID NO: 89118, SEQ ID NO: 89126, SEQ ID NO: 89135, SEQ ID NO: 89138, SEQ ID NO: 89147, SEQ ID NO: 89168, SEQ ID NO: 89193, SEQ ID NO: 89228, SEQ ID NO: 89235, SEQ ID NO: 89269, SEQ ID NO: 89286, SEQ ID NO: 89291, SEQ ID NO: 89339, SEQ ID NO: 89342, SEQ ID NO: 89394, SEQ ID NO: 89453, SEQ ID NO: 89492, SEQ ID NO: 89510, SEQ ID NO: 89555, SEQ ID NO: 89595, SEQ ID NO: 89670, SEQ ID NO: 89695, SEQ ID NO: 89785, SEQ ID NO: 89836, SEQ ID NO: 89842, SEQ ID NO: 89921, SEQ ID NO: 89929, SEQ ID NO: 89935, SEQ ID NO: 89938, SEQ ID NO: 89950, SEQ ID NO: 89953, SEQ ID NO: 89960, SEQ ID NO: 89987, SEQ ID NO: 89992, SEQ ID NO: 90030, SEQ ID NO: 90056, SEQ ID NO: 90066, SEQ ID NO: 90085, SEQ ID NO: 90089, SEQ ID NO: 90115, SEQ ID NO: 90120, SEQ ID NO: 90133, SEQ ID NO: 90157, SEQ ID NO: 90159, SEQ ID NO: 90191, SEQ ID NO: 90268, SEQ ID NO: 90274, SEQ ID NO: 90280, SEQ ID NO: 90287, SEQ ID NO: 90315, SEQ ID NO: 90408, SEQ ID NO: 90417, SEQ ID NO: 90443, SEQ ID NO: 90466, SEQ ID NO: 90507, SEQ ID NO: 90555, SEQ ID NO: 90593, SEQ ID NO: 90599, SEQ ID NO: 90621, SEQ ID NO: 90634, SEQ ID NO: 90653, SEQ ID NO: 90696, SEQ ID NO: 90758, SEQ ID NO: 90777, SEQ ID NO: 90835, SEQ ID NO: 90882, SEQ ID NO: 90898, SEQ ID NO: 90938, SEQ ID NO: 90954, SEQ ID NO: 90999, SEQ ID NO: 91045, SEQ ID NO: 91060, SEQ ID NO: 91072, SEQ ID NO: 91076, SEQ ID NO: 91105, SEQ ID NO: 91132, SEQ ID NO: 91222, SEQ ID NO: 91226, SEQ ID NO: 91229, SEQ ID NO: 91306, SEQ ID NO: 91309, SEQ ID NO: 91315, SEQ ID NO: 91346, SEQ ID NO: 91419, SEQ ID NO: 91449, SEQ ID NO: 91498, SEQ ID NO: 91563, SEQ ID NO: 91588, SEQ ID NO: 91681, SEQ ID NO: 91766, SEQ ID NOs: 91775 to 91776, SEQ ID NO: 91780, SEQ ID NO: 91799, SEQ ID NO: 91845, SEQ ID NO: 91852, SEQ ID NOs: 91885 to 91886, SEQ ID NO: 91930, SEQ ID NO: 91935, SEQ ID NO: 91953, SEQ ID NO: 91966, SEQ ID NO: 91984, SEQ ID NO: 92026, SEQ ID NO: 92030, SEQ ID NO: 92069, SEQ ID NO: 92100, SEQ ID NO: 92111, SEQ ID NO: 92189, SEQ ID NO: 92249, SEQ ID NO: 92296, SEQ ID NO: 92400, SEQ ID NO: 92404, SEQ ID NO: 92409, SEQ ID NO: 92429, SEQ ID NO: 92474, SEQ ID NO: 92500, SEQ ID NO: 92515, SEQ ID NO: 92538, SEQ ID NO: 92646, SEQ ID NO: 92659, SEQ ID NO: 92671, SEQ ID NO: 92673, SEQ ID NO: 92675, SEQ ID NO: 92684, SEQ ID NO: 92704, SEQ ID NO: 92832, SEQ ID NO: 92835, SEQ ID NO: 92854, SEQ ID NO: 92858, SEQ ID NO: 92877, SEQ ID NO: 92918, SEQ ID NO: 92920, SEQ ID NO: 93004, SEQ ID NO: 93036, SEQ ID NO: 93042, SEQ ID NO: 93071, SEQ ID NO: 93089, SEQ ID NO: 93136, SEQ ID NO: 93180, SEQ ID NO: 93251, SEQ ID NO: 93325, SEQ ID NO: 93335, SEQ ID NO: 93344, SEQ ID NO: 93356, SEQ ID NO: 93382, SEQ ID NO: 93408, SEQ ID NO: 93420, SEQ ID NO: 93503, SEQ ID NO: 93537, SEQ ID NO: 93617, SEQ ID NO: 93658, SEQ ID NO: 93697, SEQ ID NO: 93710, SEQ ID NO: 93877, SEQ ID NO: 93885, SEQ ID NO: 93888, SEQ ID NO: 93893, SEQ ID NO: 93903, SEQ ID NO: 93912, SEQ ID NO: 93926, SEQ ID NO: 93933, SEQ ID NO: 93982, SEQ ID NO: 93987, SEQ ID NO: 94000, SEQ ID NO: 94054, SEQ ID NO: 94058, SEQ ID NO: 94087, SEQ ID NO: 94090, SEQ ID NO: 94102, SEQ ID NO: 94143, SEQ ID NO: 94269, SEQ ID NO: 94367, SEQ ID NO: 94465, SEQ ID NO: 94477, SEQ ID NO: 94525, SEQ ID NO: 94587, SEQ ID NOs: 95593 to 113807, SEQ ID NO: 217120, SEQ ID NO: 247270, SEQ ID NO: 248009, SEQ ID NOs: 248159 to 248160, SEQ ID NOs: 248735 to 248738, SEQ ID NOs: 249358 to 249362, SEQ ID NOs: 249690 to 249691, SEQ ID NOs: 252562 to 252564, SEQ ID NOs: 252836 to 252837, SEQ ID NO: 256214, SEQ ID NO: 256221, SEQ ID NO: 256226, SEQ ID NO: 256229, SEQ ID NO: 256235, SEQ ID NO: 256705, SEQ ID NO: 257337, SEQ ID NO: 257341, SEQ ID NO: 257345, SEQ ID NO: 257995, SEQ ID NO: 258292, SEQ ID NO: 258295, SEQ ID NOs: 258614 to 258616, SEQ ID NO: 259467, SEQ ID NO: 259471, SEQ ID NO: 259474, SEQ ID NO: 260118, SEQ ID NO: 260122, SEQ ID NO: 260126, SEQ ID NO: 260131, SEQ ID NO: 260138, SEQ ID NO: 260145, SEQ ID NO: 260153, SEQ ID NOs: 260367 to 260384, SEQ ID NO: 260407, SEQ ID NO: 260412, SEQ ID NO: 261788, SEQ ID NO: 261790, SEQ ID NOs: 261792 to 261793, SEQ ID NO: 261795, SEQ ID NO: 261798, SEQ ID NO: 261800, SEQ ID NO: 261803, SEQ ID NO: 261805, SEQ ID NO: 261809, SEQ ID NO: 261811, SEQ ID NO: 261814, SEQ ID NO: 261816, SEQ ID NO: 261821, SEQ ID NO: 261823, SEQ ID NO: 261830, SEQ ID NO: 261832, SEQ ID NO: 261837, SEQ ID NO: 261839, SEQ ID NO: 262119, SEQ ID NO: 262122, SEQ ID NOs: 262261 to 262285, SEQ ID NO: 262313, SEQ ID NO: 262318, SEQ ID NOs: 263471 to 263474, SEQ ID NO: 263494, SEQ ID NO: 263498, SEQ ID NOs: 266653 to 266654, SEQ ID NO: 269139, SEQ ID NO: 269143, SEQ ID NO: 269149, SEQ ID NO: 269156, SEQ ID NO: 269169, SEQ ID NOs: 270516 to 270517, SEQ ID NOs: 270519 to 270520, SEQ ID NOs: 270523 to 270524, SEQ ID NOs: 270527 to 270528, SEQ ID NO: 272016, SEQ ID NO: 272020, SEQ ID NOs: 272214 to 272222, SEQ ID NO: 272243, SEQ ID NO: 272248, SEQ ID NO: 272896, SEQ ID NOs: 273018 to 273020, SEQ ID NOs: 278350 to 278351, SEQ ID NO: 278355, SEQ ID NOs: 278358 to 278359, SEQ ID NOs: 278361 to 278362, SEQ ID NO: 278364, SEQ ID NO: 278367, SEQ ID NO: 278369, SEQ ID NO: 278371, SEQ ID NO: 278373, SEQ ID NO: 278375, SEQ ID NO: 278377, SEQ ID NO: 278383, SEQ ID NO: 278385, SEQ ID NO: 278388, SEQ ID NO: 278390, SEQ ID NO: 278394, SEQ ID NO: 278396, SEQ ID NOs: 281013 to 281014, SEQ ID NO: 281018, SEQ ID NO: 281022, SEQ ID NO: 281026, SEQ ID NO: 281031, SEQ ID NOs: 281037 to 281038, SEQ ID NOs: 281044 to 281045, SEQ ID NOs: 281052 to 281053, SEQ ID NOs: 281151 to 281152, SEQ ID NO: 281155, SEQ ID NO: 281159, SEQ ID NOs: 281162 to 281163, SEQ ID NOs: 281165 to 281166, SEQ ID NO: 281169, SEQ ID NO: 281171, SEQ ID NO: 281174, SEQ ID NO: 281176, SEQ ID NO: 281179, SEQ ID NO: 281181, SEQ ID NO: 281184, SEQ ID NO: 281186, SEQ ID NO: 281190, SEQ ID NO: 281192, SEQ ID NO: 281197, SEQ ID NO: 281199, and SEQ ID NOs: 281350 to 305565. In some embodiments, any one of the peptides in the MAGC3 vaccine comprise an amino acid sequence 80, 81, 82, 83, 84, 85, 86, 87, 88, 89, 90, 91, 92, 93, 94, 95, 96, 97, 98 or 99% identical to SEQ ID NO: 41647, SEQ ID NO: 50668, SEQ ID NO: 50905, SEQ ID NOs: 51039 to 51040, SEQ ID NO: 68257, SEQ ID NO: 68285, SEQ ID NO: 68288, SEQ ID NO: 68290, SEQ ID NO: 68305, SEQ ID NO: 68389, SEQ ID NO: 68419, SEQ ID NO: 68470, SEQ ID NO: 68510, SEQ ID NO: 68519, SEQ ID NO: 68592, SEQ ID NO: 68603, SEQ ID NO: 68684, SEQ ID NO: 68688, SEQ ID NO: 68747, SEQ ID NO: 68760, SEQ ID NO: 68778, SEQ ID NO: 68786, SEQ ID NO: 68855, SEQ ID NO: 68898, SEQ ID NO: 68900, SEQ ID NO: 68927, SEQ ID NO: 68961, SEQ ID NO: 69026, SEQ ID NO: 69041, SEQ ID NO: 69047, SEQ ID NO: 69148, SEQ ID NO: 69173, SEQ ID NO: 69180, SEQ ID NO: 69192, SEQ ID NO: 69227, SEQ ID NO: 69311, SEQ ID NO: 69330, SEQ ID NO: 69333, SEQ ID NO: 69346, SEQ ID NO: 69356, SEQ ID NO: 69393, SEQ ID NO: 69421, SEQ ID NO: 69437, SEQ ID NO: 69451, SEQ ID NO: 69500, SEQ ID NO: 69505, SEQ ID NO: 69517, SEQ ID NO: 69540, SEQ ID NO: 69559, SEQ ID NO: 69571, SEQ ID NO: 69586, SEQ ID NO: 69589, SEQ ID NO: 69591, SEQ ID NO: 69619, SEQ ID NO: 69631, SEQ ID NO: 69633, SEQ ID NO: 69644, SEQ ID NO: 69649, SEQ ID NO: 69747, SEQ ID NO: 69764, SEQ ID NO: 69767, SEQ ID NO: 69790, SEQ ID NO: 69832, SEQ ID NO: 69836, SEQ ID NO: 69882, SEQ ID NO: 69999, SEQ ID NO: 70012, SEQ ID NO: 70036, SEQ ID NO: 70050, SEQ ID NO: 70066, SEQ ID NO: 70069, SEQ ID NO: 70109, SEQ ID NO: 70159, SEQ ID NO: 70165, SEQ ID NO: 70175, SEQ ID NO: 70177, SEQ ID NO: 70188, SEQ ID NO: 70284, SEQ ID NO: 70323, SEQ ID NO: 70326, SEQ ID NO: 70428, SEQ ID NO: 70455, SEQ ID NO: 70570, SEQ ID NO: 70606, SEQ ID NO: 70635, SEQ ID NO: 70676, SEQ ID NO: 70692, SEQ ID NO: 70716, SEQ ID NO: 70728, SEQ ID NO: 70735, SEQ ID NO: 70750, SEQ ID NO: 70764, SEQ ID NO: 70770, SEQ ID NO: 70806, SEQ ID NO: 70968, SEQ ID NO: 70997, SEQ ID NO: 71049, SEQ ID NO: 71075, SEQ ID NO: 71090, SEQ ID NO: 71117, SEQ ID NO: 71151, SEQ ID NO: 71176, SEQ ID NO: 71193, SEQ ID NO: 71203, SEQ ID NO: 71239, SEQ ID NO: 71247, SEQ ID NO: 71249, SEQ ID NO: 71275, SEQ ID NO: 71287, SEQ ID NO: 71328, SEQ ID NOs: 71359 to 71360, SEQ ID NOs: 71367 to 71368, SEQ ID NO: 71392, SEQ ID NO: 71414, SEQ ID NO: 71449, SEQ ID NO: 71476, SEQ ID NO: 71482, SEQ ID NO: 71543, SEQ ID NO: 71547, SEQ ID NO: 71560, SEQ ID NO: 71585, SEQ ID NO: 71612, SEQ ID NO: 71620, SEQ ID NO: 71628, SEQ ID NO: 71636, SEQ ID NO: 71673, SEQ ID NOs: 71688 to 71689, SEQ ID NO: 71696, SEQ ID NO: 71700, SEQ ID NO: 71718, SEQ ID NO: 71725, SEQ ID NO: 71807, SEQ ID NO: 71919, SEQ ID NO: 71935, SEQ ID NO: 71943, SEQ ID NO: 71948, SEQ ID NOs: 71987 to 71988, SEQ ID NO: 72045, SEQ ID NO: 72055, SEQ ID NO: 72076, SEQ ID NO: 72085, SEQ ID NO: 72102, SEQ ID NO: 72159, SEQ ID NO: 72183, SEQ ID NO: 72216, SEQ ID NO: 72241, SEQ ID NO: 72331, SEQ ID NO: 72364, SEQ ID NO: 72372, SEQ ID NO: 72390, SEQ ID NO: 72448, SEQ ID NO: 72528, SEQ ID NO: 72595, SEQ ID NO: 72604, SEQ ID NO: 72648, SEQ ID NO: 72667, SEQ ID NO: 72685, SEQ ID NO: 72721, SEQ ID NO: 72751, SEQ ID NO: 72755, SEQ ID NO: 72805, SEQ ID NO: 72810, SEQ ID NO: 72831, SEQ ID NO: 72837, SEQ ID NO: 72862, SEQ ID NO: 72885, SEQ ID NO: 72989, SEQ ID NO: 73014, SEQ ID NOs: 73045 to 73046, SEQ ID NO: 73086, SEQ ID NO: 73094, SEQ ID NO: 73113, SEQ ID NO: 73122, SEQ ID NO: 73161, SEQ ID NO: 73191, SEQ ID NO: 73224, SEQ ID NOs: 73232 to 73233, SEQ ID NO: 73238, SEQ ID NO: 73290, SEQ ID NO: 73327, SEQ ID NO: 73377, SEQ ID NO: 73382, SEQ ID NO: 73404, SEQ ID NO: 73406, SEQ ID NO: 73422, SEQ ID NOs: 73428 to 73429, SEQ ID NO: 73466, SEQ ID NO: 73475, SEQ ID NO: 73521, SEQ ID NO: 73523, SEQ ID NO: 73532, SEQ ID NO: 73550, SEQ ID NO: 73560, SEQ ID NO: 73591, SEQ ID NO: 73597, SEQ ID NO: 73644, SEQ ID NO: 73657, SEQ ID NO: 73660, SEQ ID NO: 73689, SEQ ID NO: 73729, SEQ ID NO: 73733, SEQ ID NO: 73873, SEQ ID NO: 73886, SEQ ID NO: 73930, SEQ ID NO: 73957, SEQ ID NOs: 73991 to 73992, SEQ ID NO: 74045, SEQ ID NO: 74047, SEQ ID NO: 74072, SEQ ID NO: 74080, SEQ ID NOs: 74096 to 74097, SEQ ID NO: 74107, SEQ ID NO: 74203, SEQ ID NO: 74208, SEQ ID NO: 74210, SEQ ID NO: 74238, SEQ ID NO: 74302, SEQ ID NO: 74350, SEQ ID NO: 74352, SEQ ID NO: 74411, SEQ ID NO: 74448, SEQ ID NO: 74473, SEQ ID NO: 74482, SEQ ID NO: 74515, SEQ ID NO: 74527, SEQ ID NO: 74560, SEQ ID NO: 74616, SEQ ID NO: 74649, SEQ ID NO: 74672, SEQ ID NO: 74674, SEQ ID NO: 74737, SEQ ID NO: 74782, SEQ ID NO: 74808, SEQ ID NO: 74810, SEQ ID NO: 74835, SEQ ID NO: 74886, SEQ ID NO: 74901, SEQ ID NO: 74946, SEQ ID NOs: 74975 to 74976, SEQ ID NO: 75017, SEQ ID NO: 75021, SEQ ID NO: 75040, SEQ ID NO: 75049, SEQ ID NO: 75063, SEQ ID NO: 75066, SEQ ID NO: 75072, SEQ ID NO: 75092, SEQ ID NO: 75094, SEQ ID NO: 75099, SEQ ID NO: 75111, SEQ ID NO: 75148, SEQ ID NO: 75245, SEQ ID NO: 75269, SEQ ID NO: 75388, SEQ ID NO: 75403, SEQ ID NO: 75429, SEQ ID NO: 75455, SEQ ID NO: 75470, SEQ ID NO: 75489, SEQ ID NO: 75506, SEQ ID NO: 75529, SEQ ID NO: 75547, SEQ ID NO: 75551, SEQ ID NOs: 75576 to 75577, SEQ ID NO: 75595, SEQ ID NO: 75701, SEQ ID NO: 75716, SEQ ID NO: 75747, SEQ ID NO: 75757, SEQ ID NO: 75762, SEQ ID NO: 75766, SEQ ID NO: 75874, SEQ ID NO: 75915, SEQ ID NO: 75933, SEQ ID NO: 75975, SEQ ID NO: 75979, SEQ ID NO: 76016, SEQ ID NO: 76023, SEQ ID NO: 76034, SEQ ID NO: 76040, SEQ ID NO: 76064, SEQ ID NO: 76076, SEQ ID NO: 76102, SEQ ID NOs: 76147 to 76148, SEQ ID NO: 76189, SEQ ID NO: 76199, SEQ ID NO: 76369, SEQ ID NO: 76375, SEQ ID NO: 76397, SEQ ID NO: 76410, SEQ ID NO: 76435, SEQ ID NO: 76446, SEQ ID NO: 76451, SEQ ID NOs: 76456 to 76458, SEQ ID NO: 76492, SEQ ID NO: 76544, SEQ ID NO: 76569, SEQ ID NO: 76574, SEQ ID NO: 76611, SEQ ID NO: 76654, SEQ ID NO: 76710, SEQ ID NO: 76753, SEQ ID NO: 76769, SEQ ID NO: 76781, SEQ ID NO: 76797, SEQ ID NO: 76803, SEQ ID NO: 76858, SEQ ID NO: 76860, SEQ ID NO: 76879, SEQ ID NO: 76943, SEQ ID NO: 76971, SEQ ID NO: 76981, SEQ ID NO: 77091, SEQ ID NO: 77133, SEQ ID NOs: 77193 to 77194, SEQ ID NO: 77210, SEQ ID NO: 77219, SEQ ID NO: 77237, SEQ ID NO: 77246, SEQ ID NO: 77251, SEQ ID NO: 77281, SEQ ID NO: 77293, SEQ ID NO: 77323, SEQ ID NO: 77334, SEQ ID NO: 77339, SEQ ID NO: 77396, SEQ ID NO: 77423, SEQ ID NO: 77433, SEQ ID NO: 77437, SEQ ID NO: 77442, SEQ ID NO: 77453, SEQ ID NO: 77485, SEQ ID NO: 77579, SEQ ID NO: 77627, SEQ ID NO: 77639, SEQ ID NO: 77644, SEQ ID NO: 77703, SEQ ID NO: 77773, SEQ ID NO: 77814, SEQ ID NO: 77868, SEQ ID NO: 77874, SEQ ID NO: 77900, SEQ ID NO: 77925, SEQ ID NO: 77995, SEQ ID NO: 78017, SEQ ID NO: 78083, SEQ ID NO: 78086, SEQ ID NO: 78090, SEQ ID NO: 78131, SEQ ID NO: 78139, SEQ ID NO: 78228, SEQ ID NO: 78248, SEQ ID NO: 78260, SEQ ID NO: 78346, SEQ ID NO: 78352, SEQ ID NO: 78377, SEQ ID NO: 78416, SEQ ID NO: 78421, SEQ ID NO: 78440, SEQ ID NO: 78521, SEQ ID NO: 78530, SEQ ID NO: 78532, SEQ ID NO: 78546, SEQ ID NO: 78600, SEQ ID NO: 78631, SEQ ID NO: 78671, SEQ ID NO: 78709, SEQ ID NO: 78714, SEQ ID NO: 78730, SEQ ID NO: 78738, SEQ ID NO: 78810, SEQ ID NO: 78855, SEQ ID NO: 78883, SEQ ID NO: 78917, SEQ ID NOs: 78919 to 78920, SEQ ID NO: 78928, SEQ ID NO: 79035, SEQ ID NO: 79048, SEQ ID NO: 79056, SEQ ID NO: 79086, SEQ ID NO: 79091, SEQ ID NO: 79095, SEQ ID NO: 79107, SEQ ID NO: 79109, SEQ ID NO: 79136, SEQ ID NO: 79142, SEQ ID NO: 79147, SEQ ID NO: 79151, SEQ ID NO: 79194, SEQ ID NO: 79196, SEQ ID NO: 79227, SEQ ID NO: 79247, SEQ ID NO: 79253, SEQ ID NO: 79255, SEQ ID NO: 79269, SEQ ID NO: 79310, SEQ ID NO: 79331, SEQ ID NO: 79357, SEQ ID NO: 79406, SEQ ID NO: 79437, SEQ ID NO: 79448, SEQ ID NO: 79453, SEQ ID NO: 79480, SEQ ID NO: 79483, SEQ ID NO: 79486, SEQ ID NO: 79504, SEQ ID NO: 79508, SEQ ID NO: 79516, SEQ ID NO: 79548, SEQ ID NO: 79575, SEQ ID NO: 79588, SEQ ID NO: 79592, SEQ ID NO: 79609, SEQ ID NO: 79626, SEQ ID NO: 79640, SEQ ID NO: 79697, SEQ ID NO: 79746, SEQ ID NO: 79751, SEQ ID NO: 79766, SEQ ID NO: 79784, SEQ ID NO: 79787, SEQ ID NO: 79816, SEQ ID NO: 79834, SEQ ID NO: 79853, SEQ ID NO: 79858, SEQ ID NO: 79861, SEQ ID NO: 79874, SEQ ID NO: 79877, SEQ ID NO: 79906, SEQ ID NO: 79909, SEQ ID NO: 79939, SEQ ID NO: 79958, SEQ ID NO: 79987, SEQ ID NO: 80000, SEQ ID NO: 80027, SEQ ID NO: 80040, SEQ ID NO: 80139, SEQ ID NO: 80141, SEQ ID NO: 80212, SEQ ID NO: 80232, SEQ ID NO: 80237, SEQ ID NO: 80241, SEQ ID NOs: 80367 to 80368, SEQ ID NO: 80398, SEQ ID NO: 80421, SEQ ID NO: 80461, SEQ ID NO: 80486, SEQ ID NO: 80513, SEQ ID NO: 80527, SEQ ID NO: 80555, SEQ ID NO: 80574, SEQ ID NO: 80583, SEQ ID NO: 80627, SEQ ID NO: 80673, SEQ ID NOs: 80703 to 80704, SEQ ID NOs: 80718 to 80719, SEQ ID NO: 80725, SEQ ID NO: 80796, SEQ ID NO: 80804, SEQ ID NO: 80833, SEQ ID NO: 80869, SEQ ID NO: 80903, SEQ ID NO: 80931, SEQ ID NO: 80936, SEQ ID NO: 80946, SEQ ID NO: 80990, SEQ ID NO: 81021, SEQ ID NO: 81042, SEQ ID NO: 81046, SEQ ID NO: 81054, SEQ ID NO: 81066, SEQ ID NO: 81145, SEQ ID NO: 81166, SEQ ID NO: 81168, SEQ ID NO: 81175, SEQ ID NO: 81185, SEQ ID NO: 81207, SEQ ID NO: 81251, SEQ ID NO: 81259, SEQ ID NO: 81302, SEQ ID NO: 81337, SEQ ID NO: 81342, SEQ ID NO: 81386, SEQ ID NO: 81428, SEQ ID NO: 81446, SEQ ID NO: 81458, SEQ ID NO: 81488, SEQ ID NO: 81505, SEQ ID NO: 81517, SEQ ID NO: 81566, SEQ ID NO: 81687, SEQ ID NO: 81690, SEQ ID NO: 81694, SEQ ID NO: 81713, SEQ ID NO: 81755, SEQ ID NO: 81825, SEQ ID NO: 81856, SEQ ID NO: 81873, SEQ ID NO: 81904, SEQ ID NO: 81916, SEQ ID NO: 81938, SEQ ID NO: 81951, SEQ ID NO: 81963, SEQ ID NO: 82045, SEQ ID NO: 82085, SEQ ID NO: 82117, SEQ ID NO: 82136, SEQ ID NO: 82193, SEQ ID NO: 82239, SEQ ID NO: 82241, SEQ ID NO: 82259, SEQ ID NO: 82320, SEQ ID NO: 82382, SEQ ID NO: 82417, SEQ ID NO: 82459, SEQ ID NO: 82474, SEQ ID NO: 82514, SEQ ID NO: 82556, SEQ ID NO: 82581, SEQ ID NO: 82596, SEQ ID NO: 82633, SEQ ID NO: 82644, SEQ ID NO: 82649, SEQ ID NO: 82676, SEQ ID NO: 82681, SEQ ID NO: 82718, SEQ ID NO: 82731, SEQ ID NO: 82769, SEQ ID NO: 82817, SEQ ID NO: 82870, SEQ ID NO: 82872, SEQ ID NO: 82885, SEQ ID NOs: 82920 to 82921, SEQ ID NO: 82955, SEQ ID NO: 82960, SEQ ID NO: 82985, SEQ ID NO: 82988, SEQ ID NO: 83013, SEQ ID NO: 83018, SEQ ID NO: 83051, SEQ ID NO: 83062, SEQ ID NO: 83099, SEQ ID NO: 83149, SEQ ID NO: 83185, SEQ ID NO: 83193, SEQ ID NO: 83208, SEQ ID NO: 83225, SEQ ID NO: 83235, SEQ ID NO: 83243, SEQ ID NO: 83260, SEQ ID NO: 83269, SEQ ID NO: 83286, SEQ ID NO: 83293, SEQ ID NO: 83349, SEQ ID NO: 83383, SEQ ID NO: 83409, SEQ ID NO: 83426, SEQ ID NO: 83438, SEQ ID NO: 83549, SEQ ID NO: 83605, SEQ ID NO: 83686, SEQ ID NO: 83704, SEQ ID NO: 83714, SEQ ID NO: 83806, SEQ ID NO: 83811, SEQ ID NO: 83821, SEQ ID NOs: 83863 to 83864, SEQ ID NO: 83872, SEQ ID NO: 83891, SEQ ID NO: 83899, SEQ ID NO: 83901, SEQ ID NO: 83921, SEQ ID NO: 83970, SEQ ID NO: 83974, SEQ ID NO: 83988, SEQ ID NO: 84002, SEQ ID NO: 84025, SEQ ID NO: 84070, SEQ ID NO: 84090, SEQ ID NO: 84154, SEQ ID NO: 84182, SEQ ID NOs: 84187 to 84188, SEQ ID NO: 84201, SEQ ID NO: 84212, SEQ ID NO: 84232, SEQ ID NO: 84238, SEQ ID NO: 84248, SEQ ID NO: 84306, SEQ ID NO: 84324, SEQ ID NO: 84348, SEQ ID NO: 84376, SEQ ID NO: 84387, SEQ ID NO: 84390, SEQ ID NO: 84422, SEQ ID NO: 84428, SEQ ID NO: 84437, SEQ ID NO: 84445, SEQ ID NO: 84489, SEQ ID NO: 84501, SEQ ID NO: 84534, SEQ ID NO: 84558, SEQ ID NO: 84593, SEQ ID NO: 84676, SEQ ID NO: 84782, SEQ ID NO: 84795, SEQ ID NO: 84822, SEQ ID NO: 84885, SEQ ID NO: 84991, SEQ ID NO: 85010, SEQ ID NO: 85024, SEQ ID NO: 85054, SEQ ID NO: 85056, SEQ ID NO: 85060, SEQ ID NO: 85101, SEQ ID NO: 85117, SEQ ID NO: 85146, SEQ ID NO: 85219, SEQ ID NOs: 85242 to 85243, SEQ ID NO: 85266, SEQ ID NO: 85310, SEQ ID NO: 85349, SEQ ID NO: 85361, SEQ ID NO: 85370, SEQ ID NO: 85379, SEQ ID NO: 85399, SEQ ID NO: 85417, SEQ ID NO: 85435, SEQ ID NO: 85447, SEQ ID NO: 85463, SEQ ID NO: 85519, SEQ ID NO: 85528, SEQ ID NO: 85530, SEQ ID NO: 85602, SEQ ID NO: 85624, SEQ ID NO: 85629, SEQ ID NO: 85725, SEQ ID NO: 85737, SEQ ID NO: 85848, SEQ ID NO: 85878, SEQ ID NO: 85910, SEQ ID NO: 85959, SEQ ID NO: 85963, SEQ ID NO: 85967, SEQ ID NOs: 85985 to 85986, SEQ ID NO: 86003, SEQ ID NO: 86076, SEQ ID NO: 86159, SEQ ID NO: 86208, SEQ ID NO: 86248, SEQ ID NO: 86279, SEQ ID NO: 86343, SEQ ID NO: 86366, SEQ ID NO: 86417, SEQ ID NO: 86431, SEQ ID NO: 86433, SEQ ID NO: 86473, SEQ ID NO: 86523, SEQ ID NOs: 86526 to 86527, SEQ ID NO: 86541, SEQ ID NO: 86567, SEQ ID NO: 86586, SEQ ID NO: 86589, SEQ ID NO: 86599, SEQ ID NO: 86633, SEQ ID NO: 86665, SEQ ID NO: 86688, SEQ ID NO: 86698, SEQ ID NO: 86725, SEQ ID NO: 86761, SEQ ID NO: 86775, SEQ ID NO: 86825, SEQ ID NO: 86914, SEQ ID NO: 86929, SEQ ID NO: 86940, SEQ ID NO: 86969, SEQ ID NO: 86994, SEQ ID NO: 87027, SEQ ID NO: 87041, SEQ ID NO: 87157, SEQ ID NO: 87160, SEQ ID NO: 87185, SEQ ID NO: 87251, SEQ ID NO: 87255, SEQ ID NO: 87300, SEQ ID NO: 87321, SEQ ID NO: 87358, SEQ ID NO: 87425, SEQ ID NO: 87427, SEQ ID NO: 87431, SEQ ID NO: 87474, SEQ ID NO: 87536, SEQ ID NO: 87550, SEQ ID NO: 87576, SEQ ID NO: 87603, SEQ ID NO: 87623, SEQ ID NO: 87626, SEQ ID NO: 87638, SEQ ID NO: 87708, SEQ ID NO: 87733, SEQ ID NO: 87785, SEQ ID NO: 87799, SEQ ID NO: 87818, SEQ ID NOs: 87865 to 87866, SEQ ID NO: 87875, SEQ ID NO: 87917, SEQ ID NO: 87946, SEQ ID NO: 87951, SEQ ID NO: 88016, SEQ ID NO: 88061, SEQ ID NO: 88120, SEQ ID NO: 88122, SEQ ID NO: 88125, SEQ ID NO: 88144, SEQ ID NO: 88178, SEQ ID NO: 88180, SEQ ID NO: 88186, SEQ ID NO: 88203, SEQ ID NO: 88241, SEQ ID NO: 88272, SEQ ID NO: 88285, SEQ ID NO: 88288, SEQ ID NO: 88359, SEQ ID NO: 88384, SEQ ID NO: 88390, SEQ ID NO: 88474, SEQ ID NO: 88522, SEQ ID NO: 88563, SEQ ID NO: 88643, SEQ ID NO: 88659, SEQ ID NO: 88708, SEQ ID NO: 88710, SEQ ID NO: 88731, SEQ ID NO: 88751, SEQ ID NO: 88806, SEQ ID NO: 88975, SEQ ID NO: 88999, SEQ ID NO: 89010, SEQ ID NO: 89012, SEQ ID NO: 89028, SEQ ID NO: 89035, SEQ ID NO: 89037, SEQ ID NO: 89039, SEQ ID NO: 89045, SEQ ID NO: 89073, SEQ ID NO: 89118, SEQ ID NO: 89126, SEQ ID NO: 89135, SEQ ID NO: 89138, SEQ ID NO: 89147, SEQ ID NO: 89168, SEQ ID NO: 89193, SEQ ID NO: 89228, SEQ ID NO: 89235, SEQ ID NO: 89269, SEQ ID NO: 89286, SEQ ID NO: 89291, SEQ ID NO: 89339, SEQ ID NO: 89342, SEQ ID NO: 89394, SEQ ID NO: 89453, SEQ ID NO: 89492, SEQ ID NO: 89510, SEQ ID NO: 89555, SEQ ID NO: 89595, SEQ ID NO: 89670, SEQ ID NO: 89695, SEQ ID NO: 89785, SEQ ID NO: 89836, SEQ ID NO: 89842, SEQ ID NO: 89921, SEQ ID NO: 89929, SEQ ID NO: 89935, SEQ ID NO: 89938, SEQ ID NO: 89950, SEQ ID NO: 89953, SEQ ID NO: 89960, SEQ ID NO: 89987, SEQ ID NO: 89992, SEQ ID NO: 90030, SEQ ID NO: 90056, SEQ ID NO: 90066, SEQ ID NO: 90085, SEQ ID NO: 90089, SEQ ID NO: 90115, SEQ ID NO: 90120, SEQ ID NO: 90133, SEQ ID NO: 90157, SEQ ID NO: 90159, SEQ ID NO: 90191, SEQ ID NO: 90268, SEQ ID NO: 90274, SEQ ID NO: 90280, SEQ ID NO: 90287, SEQ ID NO: 90315, SEQ ID NO: 90408, SEQ ID NO: 90417, SEQ ID NO: 90443, SEQ ID NO: 90466, SEQ ID NO: 90507, SEQ ID NO: 90555, SEQ ID NO: 90593, SEQ ID NO: 90599, SEQ ID NO: 90621, SEQ ID NO: 90634, SEQ ID NO: 90653, SEQ ID NO: 90696, SEQ ID NO: 90758, SEQ ID NO: 90777, SEQ ID NO: 90835, SEQ ID NO: 90882, SEQ ID NO: 90898, SEQ ID NO: 90938, SEQ ID NO: 90954, SEQ ID NO: 90999, SEQ ID NO: 91045, SEQ ID NO: 91060, SEQ ID NO: 91072, SEQ ID NO: 91076, SEQ ID NO: 91105, SEQ ID NO: 91132, SEQ ID NO: 91222, SEQ ID NO: 91226, SEQ ID NO: 91229, SEQ ID NO: 91306, SEQ ID NO: 91309, SEQ ID NO: 91315, SEQ ID NO: 91346, SEQ ID NO: 91419, SEQ ID NO: 91449, SEQ ID NO: 91498, SEQ ID NO: 91563, SEQ ID NO: 91588, SEQ ID NO: 91681, SEQ ID NO: 91766, SEQ ID NOs: 91775 to 91776, SEQ ID NO: 91780, SEQ ID NO: 91799, SEQ ID NO: 91845, SEQ ID NO: 91852, SEQ ID NOs: 91885 to 91886, SEQ ID NO: 91930, SEQ ID NO: 91935, SEQ ID NO: 91953, SEQ ID NO: 91966, SEQ ID NO: 91984, SEQ ID NO: 92026, SEQ ID NO: 92030, SEQ ID NO: 92069, SEQ ID NO: 92100, SEQ ID NO: 92111, SEQ ID NO: 92189, SEQ ID NO: 92249, SEQ ID NO: 92296, SEQ ID NO: 92400, SEQ ID NO: 92404, SEQ ID NO: 92409, SEQ ID NO: 92429, SEQ ID NO: 92474, SEQ ID NO: 92500, SEQ ID NO: 92515, SEQ ID NO: 92538, SEQ ID NO: 92646, SEQ ID NO: 92659, SEQ ID NO: 92671, SEQ ID NO: 92673, SEQ ID NO: 92675, SEQ ID NO: 92684, SEQ ID NO: 92704, SEQ ID NO: 92832, SEQ ID NO: 92835, SEQ ID NO: 92854, SEQ ID NO: 92858, SEQ ID NO: 92877, SEQ ID NO: 92918, SEQ ID NO: 92920, SEQ ID NO: 93004, SEQ ID NO: 93036, SEQ ID NO: 93042, SEQ ID NO: 93071, SEQ ID NO: 93089, SEQ ID NO: 93136, SEQ ID NO: 93180, SEQ ID NO: 93251, SEQ ID NO: 93325, SEQ ID NO: 93335, SEQ ID NO: 93344, SEQ ID NO: 93356, SEQ ID NO: 93382, SEQ ID NO: 93408, SEQ ID NO: 93420, SEQ ID NO: 93503, SEQ ID NO: 93537, SEQ ID NO: 93617, SEQ ID NO: 93658, SEQ ID NO: 93697, SEQ ID NO: 93710, SEQ ID NO: 93877, SEQ ID NO: 93885, SEQ ID NO: 93888, SEQ ID NO: 93893, SEQ ID NO: 93903, SEQ ID NO: 93912, SEQ ID NO: 93926, SEQ ID NO: 93933, SEQ ID NO: 93982, SEQ ID NO: 93987, SEQ ID NO: 94000, SEQ ID NO: 94054, SEQ ID NO: 94058, SEQ ID NO: 94087, SEQ ID NO: 94090, SEQ ID NO: 94102, SEQ ID NO: 94143, SEQ ID NO: 94269, SEQ ID NO: 94367, SEQ ID NO: 94465, SEQ ID NO: 94477, SEQ ID NO: 94525, SEQ ID NO: 94587, SEQ ID NOs: 95593 to 113807, SEQ ID NO: 217120, SEQ ID NO: 247270, SEQ ID NO: 248009, SEQ ID NOs: 248159 to 248160, SEQ ID NOs: 248735 to 248738, SEQ ID NOs: 249358 to 249362, SEQ ID NOs: 249690 to 249691, SEQ ID NOs: 252562 to 252564, SEQ ID NOs: 252836 to 252837, SEQ ID NO: 256214, SEQ ID NO: 256221, SEQ ID NO: 256226, SEQ ID NO: 256229, SEQ ID NO: 256235, SEQ ID NO: 256705, SEQ ID NO: 257337, SEQ ID NO: 257341, SEQ ID NO: 257345, SEQ ID NO: 257995, SEQ ID NO: 258292, SEQ ID NO: 258295, SEQ ID NOs: 258614 to 258616, SEQ ID NO: 259467, SEQ ID NO: 259471, SEQ ID NO: 259474, SEQ ID NO: 260118, SEQ ID NO: 260122, SEQ ID NO: 260126, SEQ ID NO: 260131, SEQ ID NO: 260138, SEQ ID NO: 260145, SEQ ID NO: 260153, SEQ ID NOs: 260367 to 260384, SEQ ID NO: 260407, SEQ ID NO: 260412, SEQ ID NO: 261788, SEQ ID NO: 261790, SEQ ID NOs: 261792 to 261793, SEQ ID NO: 261795, SEQ ID NO: 261798, SEQ ID NO: 261800, SEQ ID NO: 261803, SEQ ID NO: 261805, SEQ ID NO: 261809, SEQ ID NO: 261811, SEQ ID NO: 261814, SEQ ID NO: 261816, SEQ ID NO: 261821, SEQ ID NO: 261823, SEQ ID NO: 261830, SEQ ID NO: 261832, SEQ ID NO: 261837, SEQ ID NO: 261839, SEQ ID NO: 262119, SEQ ID NO: 262122, SEQ ID NOs: 262261 to 262285, SEQ ID NO: 262313, SEQ ID NO: 262318, SEQ ID NOs: 263471 to 263474, SEQ ID NO: 263494, SEQ ID NO: 263498, SEQ ID NOs: 266653 to 266654, SEQ ID NO: 269139, SEQ ID NO: 269143, SEQ ID NO: 269149, SEQ ID NO: 269156, SEQ ID NO: 269169, SEQ ID NOs: 270516 to 270517, SEQ ID NOs: 270519 to 270520, SEQ ID NOs: 270523 to 270524, SEQ ID NOs: 270527 to 270528, SEQ ID NO: 272016, SEQ ID NO: 272020, SEQ ID NOs: 272214 to 272222, SEQ ID NO: 272243, SEQ ID NO: 272248, SEQ ID NO: 272896, SEQ ID NOs: 273018 to 273020, SEQ ID NOs: 278350 to 278351, SEQ ID NO: 278355, SEQ ID NOs: 278358 to 278359, SEQ ID NOs: 278361 to 278362, SEQ ID NO: 278364, SEQ ID NO: 278367, SEQ ID NO: 278369, SEQ ID NO: 278371, SEQ ID NO: 278373, SEQ ID NO: 278375, SEQ ID NO: 278377, SEQ ID NO: 278383, SEQ ID NO: 278385, SEQ ID NO: 278388, SEQ ID NO: 278390, SEQ ID NO: 278394, SEQ ID NO: 278396, SEQ ID NOs: 281013 to 281014, SEQ ID NO: 281018, SEQ ID NO: 281022, SEQ ID NO: 281026, SEQ ID NO: 281031, SEQ ID NOs: 281037 to 281038, SEQ ID NOs: 281044 to 281045, SEQ ID NOs: 281052 to 281053, SEQ ID NOs: 281151 to 281152, SEQ ID NO: 281155, SEQ ID NO: 281159, SEQ ID NOs: 281162 to 281163, SEQ ID NOs: 281165 to 281166, SEQ ID NO: 281169, SEQ ID NO: 281171, SEQ ID NO: 281174, SEQ ID NO: 281176, SEQ ID NO: 281179, SEQ ID NO: 281181, SEQ ID NO: 281184, SEQ ID NO: 281186, SEQ ID NO: 281190, SEQ ID NO: 281192, SEQ ID NO: 281197, SEQ ID NO: 281199, or SEQ ID NOs: 281350 to 305565.

In some embodiments, the amino acid sequence for a MHC class I and/or MHC class II peptides may be used to create a single target (individual) or combined peptide vaccine for the SSX2 protein having between about 2 and about 40 peptides. In some embodiments, any one of the peptides in the vaccine for the SSX2 protein comprises one or more of the SEQ ID NOs: 162383 to 166443 and SEQ ID NOs: 369027 to 373347. In some embodiments, any one of the peptides in the SSX2 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 162383 to 166443 or SEQ ID NOs: 369027 to 373347.

In some embodiments, the amino acid sequence for a MHC class I and/or MHC class II peptides may be used to create a single target (individual) or combined peptide vaccine for the PRAME protein having between about 2 and about 40 peptides. In some embodiments, any one of the peptides in the vaccine for the PRAME protein comprises one or more of the SEQ ID NOs: 144109 to 162382 and SEQ ID NOs: 342521 to 369026. In some embodiments, any one of the peptides in the PRAME vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 144109 to 162382 or SEQ ID NOs: 342521 to 369026.

In some embodiments, the amino acid sequence for a MHC class I and/or MHC class II peptides may be used to create a single target (individual) or combined peptide vaccine for the KKLC1 protein having between about 2 and about 40 peptides. In some embodiments, any one of the peptides in the vaccine for the KKLC1 protein comprises one or more of the SEQ ID NOs: 37110 to 41320 and SEQ ID NOs: 206663 to 211900. In some embodiments, any one of the peptides in the KKLC1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 37110 to 41320 or SEQ ID NOs: 206663 to 211900.

In some embodiments, the amino acid sequence for a MHC class I and/or MHC class II peptides may be used to create a single target (individual) or combined peptide vaccine for the PMEL protein having between about 2 and about 40 peptides. In some embodiments, any one of the peptides in the vaccine for the PMEL protein comprises one or more of the SEQ ID NOs: 125134 to 144108 and SEQ ID NOs: 317360 to 342520. In some embodiments, any one of the peptides in the PMEL vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 125134 to 144108 or SEQ ID NOs: 317360 to 342520.

In some embodiments, the amino acid sequence for a MHC class I and/or MHC class II peptides may be used to create a single target (individual) or combined peptide vaccine for the TYRP1 protein having between about 2 and about 40 peptides. In some embodiments, any one of the peptides in the vaccine for the TYRP1 protein comprises one or more of the SEQ ID NOs: 166444 to 182573 and SEQ ID NOs: 373348 to 392433. In some embodiments, any one of the peptides in the TYRP1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 166444 to 182573 or SEQ ID NOs: 373348 to 392433.

In some embodiments, the amino acid sequence for a MHC class I and/or MHC class II peptides may be used to create a single target (individual) or combined peptide vaccine for the TYRP2 protein having between about 2 and about 40 peptides. In some embodiments, any one of the peptides in the vaccine for the TYRP2 protein comprises one or more of the SEQ ID NOs: 166476 to 166477, SEQ ID NO: 166486, SEQ ID NO: 166513, SEQ ID NO: 166591, SEQ ID NO: 166606, SEQ ID NO: 166629, SEQ ID NO: 166641, SEQ ID NO: 166667, SEQ ID NOs: 166678 to 166679, SEQ ID NO: 166795, SEQ ID NO: 166799, SEQ ID NO: 166834, SEQ ID NO: 166854, SEQ ID NO: 166909, SEQ ID NO: 166912, SEQ ID NO: 166942, SEQ ID NOs: 166991 to 166992, SEQ ID NO: 167062, SEQ ID NO: 167067, SEQ ID NOs: 167073 to 167074, SEQ ID NO: 167106, SEQ ID NO: 167118, SEQ ID NO: 167151, SEQ ID NO: 167177, SEQ ID NO: 167241, SEQ ID NO: 167271, SEQ ID NO: 167395, SEQ ID NO: 167491, SEQ ID NO: 167505, SEQ ID NO: 167687, SEQ ID NO: 167736, SEQ ID NO: 167740, SEQ ID NO: 167743, SEQ ID NO: 167755, SEQ ID NO: 167810, SEQ ID NO: 167831, SEQ ID NO: 167837, SEQ ID NO: 167844, SEQ ID NOs: 167847 to 167848, SEQ ID NO: 167859, SEQ ID NO: 167880, SEQ ID NO: 167891, SEQ ID NO: 167897, SEQ ID NO: 167933, SEQ ID NO: 168094, SEQ ID NOs: 168111 to 168112, SEQ ID NO: 168132, SEQ ID NO: 168144, SEQ ID NO: 168167, SEQ ID NO: 168211, SEQ ID NO: 168252, SEQ ID NO: 168268, SEQ ID NO: 168343, SEQ ID NO: 168354, SEQ ID NO: 168376, SEQ ID NO: 168396, SEQ ID NO: 168410, SEQ ID NO: 168423, SEQ ID NO: 168460, SEQ ID NO: 168484, SEQ ID NO: 168496, SEQ ID NO: 168616, SEQ ID NO: 168626, SEQ ID NO: 168646, SEQ ID NO: 168660, SEQ ID NO: 168681, SEQ ID NO: 168703, SEQ ID NO: 168711, SEQ ID NO: 168725, SEQ ID NO: 168728, SEQ ID NO: 168760, SEQ ID NOs: 168792 to 168793, SEQ ID NO: 168815, SEQ ID NO: 168851, SEQ ID NO: 168863, SEQ ID NO: 168867, SEQ ID NO: 168871, SEQ ID NO: 168924, SEQ ID NO: 168927, SEQ ID NO: 168947, SEQ ID NO: 168974, SEQ ID NO: 169000, SEQ ID NO: 169024, SEQ ID NO: 169035, SEQ ID NO: 169112, SEQ ID NO: 169150, SEQ ID NO: 169187, SEQ ID NO: 169233, SEQ ID NO: 169240, SEQ ID NO: 169247, SEQ ID NO: 169275, SEQ ID NO: 169375, SEQ ID NO: 169403, SEQ ID NO: 169428, SEQ ID NO: 169460, SEQ ID NO: 169474, SEQ ID NO: 169500, SEQ ID NO: 169530, SEQ ID NO: 169542, SEQ ID NO: 169546, SEQ ID NO: 169548, SEQ ID NO: 169553, SEQ ID NO: 169555, SEQ ID NO: 169563, SEQ ID NO: 169565, SEQ ID NO: 169578, SEQ ID NO: 169584, SEQ ID NO: 169605, SEQ ID NO: 169641, SEQ ID NO: 169665, SEQ ID NO: 169673, SEQ ID NO: 169682, SEQ ID NO: 169700, SEQ ID NO: 169704, SEQ ID NO: 169740, SEQ ID NO: 169768, SEQ ID NO: 169850, SEQ ID NO: 169858, SEQ ID NO: 169867, SEQ ID NO: 169871, SEQ ID NO: 169886, SEQ ID NO: 169915, SEQ ID NO: 169966, SEQ ID NO: 170057, SEQ ID NO: 170061, SEQ ID NO: 170081, SEQ ID NOs: 170178 to 170179, SEQ ID NO: 170261, SEQ ID NO: 170268, SEQ ID NO: 170278, SEQ ID NO: 170290, SEQ ID NO: 170320, SEQ ID NO: 170329, SEQ ID NO: 170390, SEQ ID NO: 170443, SEQ ID NO: 170488, SEQ ID NO: 170543, SEQ ID NO: 170574, SEQ ID NO: 170679, SEQ ID NO: 170704, SEQ ID NOs: 170706 to 170707, SEQ ID NO: 170735, SEQ ID NO: 170754, SEQ ID NO: 170771, SEQ ID NOs: 170809 to 170810, SEQ ID NO: 170834, SEQ ID NO: 170847, SEQ ID NO: 170876, SEQ ID NOs: 170902 to 170903, SEQ ID NO: 170964, SEQ ID NO: 170968, SEQ ID NO: 170970, SEQ ID NO: 170976, SEQ ID NO: 170981, SEQ ID NO: 171011, SEQ ID NO: 171029, SEQ ID NO: 171080, SEQ ID NO: 171085, SEQ ID NO: 171091, SEQ ID NO: 171174, SEQ ID NO: 171182, SEQ ID NO: 171212, SEQ ID NO: 171229, SEQ ID NO: 171242, SEQ ID NO: 171256, SEQ ID NO: 171260, SEQ ID NO: 171263, SEQ ID NO: 171291, SEQ ID NO: 171329, SEQ ID NO: 171334, SEQ ID NO: 171340, SEQ ID NO: 171406, SEQ ID NO: 171412, SEQ ID NO: 171428, SEQ ID NO: 171462, SEQ ID NO: 171474, SEQ ID NO: 171485, SEQ ID NO: 171490, SEQ ID NO: 171526, SEQ ID NO: 171536, SEQ ID NO: 171550, SEQ ID NO: 171581, SEQ ID NO: 171608, SEQ ID NO: 171625, SEQ ID NO: 171655, SEQ ID NO: 171662, SEQ ID NO: 171709, SEQ ID NO: 171732, SEQ ID NO: 171746, SEQ ID NO: 171752, SEQ ID NO: 171768, SEQ ID NO: 171786, SEQ ID NO: 171788, SEQ ID NO: 171814, SEQ ID NO: 171855, SEQ ID NO: 171863, SEQ ID NO: 171980, SEQ ID NO: 172007, SEQ ID NO: 172010, SEQ ID NO: 172062, SEQ ID NO: 172161, SEQ ID NO: 172181, SEQ ID NO: 172203, SEQ ID NO: 172225, SEQ ID NO: 172231, SEQ ID NO: 172255, SEQ ID NO: 172272, SEQ ID NO: 172276, SEQ ID NO: 172294, SEQ ID NO: 172348, SEQ ID NO: 172372, SEQ ID NO: 172375, SEQ ID NO: 172378, SEQ ID NO: 172387, SEQ ID NO: 172389, SEQ ID NO: 172421, SEQ ID NOs: 172439 to 172440, SEQ ID NO: 172484, SEQ ID NO: 172495, SEQ ID NO: 172563, SEQ ID NO: 172594, SEQ ID NO: 172660, SEQ ID NO:

172693, SEQ ID NO: 172702, SEQ ID NO: 172704, SEQ ID NO: 172709, SEQ ID NO: 172717, SEQ ID NO: 172726, SEQ ID NO: 172742, SEQ ID NO: 172793, SEQ ID NO: 172801, SEQ ID NO: 172816, SEQ ID NO: 172849, SEQ ID NO: 172862, SEQ ID NO: 172900, SEQ ID NO: 172907, SEQ ID NO: 172919, SEQ ID NO: 172926, SEQ ID NO: 172990, SEQ ID NO: 172994, SEQ ID NO: 172999, SEQ ID NO: 173004, SEQ ID NO: 173007, SEQ ID NO: 173084, SEQ ID NO: 173202, SEQ ID NO: 173206, SEQ ID NO: 173284, SEQ ID NO: 173288, SEQ ID NO: 173318, SEQ ID NO: 173321, SEQ ID NO: 173412, SEQ ID NO: 173433, SEQ ID NO: 173452, SEQ ID NO: 173467, SEQ ID NOs: 173469 to 173470, SEQ ID NO: 173494, SEQ ID NO: 173497, SEQ ID NO: 173516, SEQ ID NO: 173611, SEQ ID NO: 173633, SEQ ID NO: 173713, SEQ ID NO: 173726, SEQ ID NO: 173762, SEQ ID NO: 173792, SEQ ID NO: 173837, SEQ ID NO: 173849, SEQ ID NO: 173858, SEQ ID NO: 173864, SEQ ID NO: 173884, SEQ ID NO: 173918, SEQ ID NO: 173923, SEQ ID NO: 173929, SEQ ID NO: 173958, SEQ ID NO: 173993, SEQ ID NO: 174020, SEQ ID NO: 174026, SEQ ID NO: 174044, SEQ ID NO: 174047, SEQ ID NO: 174110, SEQ ID NO: 174116, SEQ ID NO: 174161, SEQ ID NO: 174164, SEQ ID NO: 174168, SEQ ID NO: 174180, SEQ ID NO: 174190, SEQ ID NO: 174210, SEQ ID NO: 174228, SEQ ID NO: 174260, SEQ ID NO: 174265, SEQ ID NO: 174277, SEQ ID NO: 174283, SEQ ID NO: 174301, SEQ ID NO: 174311, SEQ ID NO: 174316, SEQ ID NO: 174356, SEQ ID NO: 174387, SEQ ID NO: 174424, SEQ ID NO: 174452, SEQ ID NO: 174486, SEQ ID NO: 174491, SEQ ID NO: 174507, SEQ ID NO: 174510, SEQ ID NO: 174595, SEQ ID NO: 174611, SEQ ID NO: 174633, SEQ ID NO: 174679, SEQ ID NO: 174702, SEQ ID NO: 174724, SEQ ID NO: 174747, SEQ ID NO: 174756, SEQ ID NO: 174779, SEQ ID NO: 174847, SEQ ID NO: 174880, SEQ ID NO: 174904, SEQ ID NO: 174956, SEQ ID NO: 174960, SEQ ID NO: 174978, SEQ ID NO: 175027, SEQ ID NO: 175063, SEQ ID NO: 175076, SEQ ID NO: 175129, SEQ ID NO: 175160, SEQ ID NO: 175175, SEQ ID NO: 175186, SEQ ID NO: 175191, SEQ ID NO: 175251, SEQ ID NO: 175269, SEQ ID NO: 175292, SEQ ID NO: 175295, SEQ ID NO: 175300, SEQ ID NO: 175416, SEQ ID NO: 175423, SEQ ID NO: 175506, SEQ ID NO: 175541, SEQ ID NO: 175557, SEQ ID NO: 175585, SEQ ID NO: 175625, SEQ ID NO: 175649, SEQ ID NO: 175671, SEQ ID NOs: 175721 to 175722, SEQ ID NO: 175820, SEQ ID NO: 175886, SEQ ID NO: 175902, SEQ ID NO: 175951, SEQ ID NOs: 175960 to 175961, SEQ ID NO: 175968, SEQ ID NO: 175975, SEQ ID NO: 175993, SEQ ID NO: 176018, SEQ ID NO: 176041, SEQ ID NO: 176051, SEQ ID NO: 176112, SEQ ID NO: 176118, SEQ ID NO: 176149, SEQ ID NO: 176179, SEQ ID NO: 176248, SEQ ID NO: 176306, SEQ ID NO: 176309, SEQ ID NO: 176312, SEQ ID NO: 176335, SEQ ID NO: 176338, SEQ ID NO: 176355, SEQ ID NO: 176369, SEQ ID NO: 176379, SEQ ID NO: 176452, SEQ ID NO: 176466, SEQ ID NO: 176503, SEQ ID NO: 176548, SEQ ID NO: 176560, SEQ ID NO: 176611, SEQ ID NO: 176621, SEQ ID NO: 176639, SEQ ID NO: 176693, SEQ ID NO: 176700, SEQ ID NO: 176713, SEQ ID NO: 176764, SEQ ID NOs: 176795 to 176796, SEQ ID NO: 176806, SEQ ID NO: 176815, SEQ ID NO: 176953, SEQ ID NO: 176958, SEQ ID NO: 176969, SEQ ID NO: 176980, SEQ ID NO: 176991, SEQ ID NO: 177016, SEQ ID NO: 177033, SEQ ID NO: 177044, SEQ ID NO: 177061, SEQ ID NO: 177065, SEQ ID NO: 177080, SEQ ID NO: 177088, SEQ ID NO: 177102, SEQ ID NO: 177119, SEQ ID NO: 177343, SEQ ID NO: 177358, SEQ ID NO: 177390, SEQ ID NO: 177430, SEQ ID NO: 177437, SEQ ID NO: 177465, SEQ ID NOs: 177482 to 177483, SEQ ID NO: 177492, SEQ ID NO: 177495, SEQ ID NO: 177522, SEQ ID NO: 177585, SEQ ID NO: 177604, SEQ ID NO: 177611, SEQ ID NO: 177664, SEQ ID NO: 177669, SEQ ID NO: 177701, SEQ ID NO: 177707, SEQ ID NO: 177710, SEQ ID NO: 177712, SEQ ID NO: 177714, SEQ ID NO: 177734, SEQ ID NO: 177808, SEQ ID NO: 177841, SEQ ID NO: 177848, SEQ ID NO: 177892, SEQ ID NO: 177918, SEQ ID NO: 177958, SEQ ID NOs: 177989 to 177990, SEQ ID NO: 178023, SEQ ID NO: 178032, SEQ ID NO: 178035, SEQ ID NO: 178039, SEQ ID NO: 178122, SEQ ID NO: 178161, SEQ ID NO: 178195, SEQ ID NO: 178208, SEQ ID NO: 178244, SEQ ID NO: 178272, SEQ ID NO: 178293, SEQ ID NO: 178310, SEQ ID NO: 178338, SEQ ID NO: 178353, SEQ ID NO: 178385, SEQ ID NO: 178399, SEQ ID NO: 178477, SEQ ID NO: 178519, SEQ ID NO: 178568, SEQ ID NO: 178587, SEQ ID NO: 178600, SEQ ID NO: 178612, SEQ ID NO: 178615, SEQ ID NO: 178651, SEQ ID NO: 178726, SEQ ID NO: 178740, SEQ ID NO: 178743, SEQ ID NO: 178750, SEQ ID NO: 178821, SEQ ID NO: 178886, SEQ ID NO: 178895, SEQ ID NO: 178911, SEQ ID NO: 178942, SEQ ID NO: 178946, SEQ ID NO: 178948, SEQ ID NO: 178966, SEQ ID NO: 179020, SEQ ID NO: 179031, SEQ ID NO: 179034, SEQ ID NO: 179130, SEQ ID NO: 179134, SEQ ID NO: 179151, SEQ ID NO: 179154, SEQ ID NO: 179224, SEQ ID NO: 179257, SEQ ID NO: 179387, SEQ ID NO: 179404, SEQ ID NO: 179444, SEQ ID NO: 179455, SEQ ID NO: 179462, SEQ ID NO: 179483, SEQ ID NO: 179544, SEQ ID NO: 179586, SEQ ID NO: 179600, SEQ ID NO: 179612, SEQ ID NO: 179619, SEQ ID NO: 179632, SEQ ID NO: 179677, SEQ ID NO: 179695, SEQ ID NO: 179697, SEQ ID NO: 179760, SEQ ID NO: 179863, SEQ ID NO: 179898, SEQ ID NO: 179904, SEQ ID NO: 179934, SEQ ID NO: 179957, SEQ ID NO: 179981, SEQ ID NO: 180013, SEQ ID NO: 180019, SEQ ID NO: 180036, SEQ ID NO: 180077, SEQ ID NO: 180086, SEQ ID NO: 180167, SEQ ID NO: 180257, SEQ ID NO: 180259, SEQ ID NO: 180271, SEQ ID NO: 180291, SEQ ID NO: 180327, SEQ ID NO: 180348, SEQ ID NO: 180378, SEQ ID NO: 180396, SEQ ID NO: 180430, SEQ ID NO: 180452, SEQ ID NO: 180458, SEQ ID NO: 180481, SEQ ID NO: 180489, SEQ ID NO: 180492, SEQ ID NO: 180528, SEQ ID NO: 180551, SEQ ID NO: 180567, SEQ ID NO: 180577, SEQ ID NO: 180597, SEQ ID NO: 180622, SEQ ID NO: 180683, SEQ ID NO: 180694, SEQ ID NOs: 180720 to 180721, SEQ ID NO: 180772, SEQ ID NO: 180799, SEQ ID NO: 180823, SEQ ID NO: 180843, SEQ ID NO: 180848, SEQ ID NO: 180858, SEQ ID NO: 180866, SEQ ID NO: 180879, SEQ ID NO: 180977, SEQ ID NOs: 181032 to 181033, SEQ ID NO: 181173, SEQ ID NO: 181204, SEQ ID NO: 181259, SEQ ID NO: 181406, SEQ ID NO: 181630, SEQ ID NO: 181685, SEQ ID NO: 181792, SEQ ID NO: 181963, SEQ ID NO: 181984, SEQ ID NOs: 182157 to 182159, SEQ ID NO: 182471, SEQ ID NOs: 182574 to 197896, SEQ ID NO: 379327, SEQ ID NO: 379329, SEQ ID NO: 379332, SEQ ID NO: 379334, SEQ ID NO: 379770, SEQ ID NO: 381531, SEQ ID NO: 382109, SEQ ID NO: 383301, SEQ ID NO: 383305, SEQ ID NO: 383310, SEQ ID NO: 386111, SEQ ID NO: 387057, SEQ ID NO: 387062, and SEQ ID NOs: 392434 to 410309. In some embodiments, any one of the peptides in the TYRP2 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 166476 to 166477, SEQ ID NO: 166486, SEQ ID NO: 166513, SEQ ID NO: 166591, SEQ ID NO: 166606, SEQ ID NO: 166629, SEQ ID NO: 166641, SEQ ID NO: 166667, SEQ ID NOs: 166678 to 166679, SEQ ID NO: 166795, SEQ ID NO: 166799, SEQ ID NO: 166834, SEQ ID NO: 166854, SEQ ID NO: 166909, SEQ ID NO: 166912, SEQ ID NO: 166942, SEQ ID NOs: 166991 to 166992, SEQ ID NO: 167062, SEQ ID NO: 167067, SEQ ID NOs: 167073 to 167074, SEQ ID NO: 167106, SEQ ID NO: 167118, SEQ ID NO: 167151, SEQ ID NO: 167177, SEQ ID NO: 167241, SEQ ID NO: 167271, SEQ ID NO: 167395, SEQ ID NO: 167491, SEQ ID NO: 167505, SEQ ID NO: 167687, SEQ ID NO: 167736, SEQ ID NO: 167740, SEQ ID NO: 167743, SEQ ID NO: 167755, SEQ ID NO: 167810, SEQ ID NO: 167831, SEQ ID NO: 167837, SEQ ID NO: 167844, SEQ ID NOs: 167847 to 167848, SEQ ID NO: 167859, SEQ ID NO: 167880, SEQ ID NO: 167891, SEQ ID NO: 167897, SEQ ID NO: 167933, SEQ ID NO: 168094, SEQ ID NOs: 168111 to 168112, SEQ ID NO: 168132, SEQ ID NO: 168144, SEQ ID NO: 168167, SEQ ID NO: 168211, SEQ ID NO: 168252, SEQ ID NO: 168268, SEQ ID NO: 168343, SEQ ID NO: 168354, SEQ ID NO: 168376, SEQ ID NO: 168396, SEQ ID NO: 168410, SEQ ID NO: 168423, SEQ ID NO: 168460, SEQ ID NO: 168484, SEQ ID NO: 168496, SEQ ID NO: 168616, SEQ ID NO: 168626, SEQ ID NO: 168646, SEQ ID NO: 168660, SEQ ID NO: 168681, SEQ ID NO: 168703, SEQ ID NO: 168711, SEQ ID NO: 168725, SEQ ID NO: 168728, SEQ ID NO: 168760, SEQ ID NOs: 168792 to 168793, SEQ ID NO: 168815, SEQ ID NO: 168851, SEQ ID NO: 168863, SEQ ID NO: 168867, SEQ ID NO: 168871, SEQ ID NO: 168924, SEQ ID NO: 168927, SEQ ID NO: 168947, SEQ ID NO: 168974, SEQ ID NO: 169000, SEQ ID NO: 169024, SEQ ID NO: 169035, SEQ ID NO: 169112, SEQ ID NO: 169150, SEQ ID NO: 169187, SEQ ID NO: 169233, SEQ ID NO: 169240, SEQ ID NO: 169247, SEQ ID NO: 169275, SEQ ID NO: 169375, SEQ ID NO: 169403, SEQ ID NO: 169428, SEQ ID NO: 169460, SEQ ID NO: 169474, SEQ ID NO: 169500, SEQ ID NO: 169530, SEQ ID NO: 169542, SEQ ID NO: 169546, SEQ ID NO: 169548, SEQ ID NO: 169553, SEQ ID NO: 169555, SEQ ID NO: 169563, SEQ ID NO: 169565, SEQ ID NO: 169578, SEQ ID NO: 169584, SEQ ID NO: 169605, SEQ ID NO: 169641, SEQ ID NO: 169665, SEQ ID NO: 169673, SEQ ID NO: 169682, SEQ ID NO: 169700, SEQ ID NO: 169704, SEQ ID NO: 169740, SEQ ID NO: 169768, SEQ ID NO: 169850, SEQ ID NO: 169858, SEQ ID NO: 169867, SEQ ID NO: 169871, SEQ ID NO: 169886, SEQ ID NO: 169915, SEQ ID NO: 169966, SEQ ID NO: 170057, SEQ ID NO: 170061, SEQ ID NO: 170081, SEQ ID NOs: 170178 to 170179, SEQ ID NO: 170261, SEQ ID NO: 170268, SEQ ID NO: 170278, SEQ ID NO: 170290, SEQ ID NO: 170320, SEQ ID NO: 170329, SEQ ID NO: 170390, SEQ ID NO: 170443, SEQ ID NO: 170488, SEQ ID NO: 170543, SEQ ID NO: 170574, SEQ ID NO: 170679, SEQ ID NO: 170704, SEQ ID NOs: 170706 to 170707, SEQ ID NO: 170735, SEQ ID NO: 170754, SEQ ID NO: 170771, SEQ ID NOs: 170809 to 170810, SEQ ID NO: 170834, SEQ ID NO: 170847, SEQ ID NO: 170876, SEQ ID NOs: 170902 to 170903, SEQ ID NO: 170964, SEQ ID NO: 170968, SEQ ID NO: 170970, SEQ ID NO: 170976, SEQ ID NO: 170981, SEQ ID NO: 171011, SEQ ID NO: 171029, SEQ ID NO: 171080, SEQ ID NO: 171085, SEQ ID NO: 171091, SEQ ID NO: 171174, SEQ ID NO: 171182, SEQ ID NO: 171212, SEQ ID NO: 171229, SEQ ID NO: 171242, SEQ ID NO: 171256, SEQ ID NO: 171260, SEQ ID NO: 171263, SEQ ID NO: 171291, SEQ ID NO: 171329, SEQ ID NO: 171334, SEQ ID NO: 171340, SEQ ID NO: 171406, SEQ ID NO: 171412, SEQ ID NO: 171428, SEQ ID NO: 171462, SEQ ID NO: 171474, SEQ ID NO: 171485, SEQ ID NO: 171490, SEQ ID NO: 171526, SEQ ID NO: 171536, SEQ ID NO: 171550, SEQ ID NO: 171581, SEQ ID NO: 171608, SEQ ID NO: 171625, SEQ ID NO: 171655, SEQ ID NO: 171662, SEQ ID NO: 171709, SEQ ID NO: 171732, SEQ ID NO: 171746, SEQ ID NO: 171752, SEQ ID NO: 171768, SEQ ID NO: 171786, SEQ ID NO: 171788, SEQ ID NO: 171814, SEQ ID NO: 171855, SEQ ID NO: 171863, SEQ ID NO: 171980, SEQ ID NO: 172007, SEQ ID NO: 172010, SEQ ID NO: 172062, SEQ ID NO: 172161, SEQ ID NO: 172181, SEQ ID NO: 172203, SEQ ID NO: 172225, SEQ ID NO: 172231, SEQ ID NO: 172255, SEQ ID NO: 172272, SEQ ID NO: 172276, SEQ ID NO: 172294, SEQ ID NO: 172348, SEQ ID NO: 172372, SEQ ID NO: 172375, SEQ ID NO: 172378, SEQ ID NO: 172387, SEQ ID NO: 172389, SEQ ID NO: 172421, SEQ ID NOs: 172439 to 172440, SEQ ID NO: 172484, SEQ ID NO: 172495, SEQ ID NO: 172563, SEQ ID NO: 172594, SEQ ID NO: 172660, SEQ ID NO: 172693, SEQ ID NO: 172702, SEQ ID NO: 172704, SEQ ID NO: 172709, SEQ ID NO: 172717, SEQ ID NO: 172726, SEQ ID NO: 172742, SEQ ID NO: 172793, SEQ ID NO: 172801, SEQ ID NO: 172816, SEQ ID NO: 172849, SEQ ID NO: 172862, SEQ ID NO: 172900, SEQ ID NO: 172907, SEQ ID NO: 172919, SEQ ID NO: 172926, SEQ ID NO: 172990, SEQ ID NO: 172994, SEQ ID NO: 172999, SEQ ID NO: 173004, SEQ ID NO: 173007, SEQ ID NO: 173084, SEQ ID NO: 173202, SEQ ID NO: 173206, SEQ ID NO: 173284, SEQ ID NO: 173288, SEQ ID NO: 173318, SEQ ID NO: 173321, SEQ ID NO: 173412, SEQ ID NO: 173433, SEQ ID NO: 173452, SEQ ID NO: 173467, SEQ ID NOs: 173469 to 173470, SEQ ID NO: 173494, SEQ ID NO: 173497, SEQ ID NO: 173516, SEQ ID NO: 173611, SEQ ID NO: 173633, SEQ ID NO: 173713, SEQ ID NO: 173726, SEQ ID NO: 173762, SEQ ID NO: 173792, SEQ ID NO: 173837, SEQ ID NO: 173849, SEQ ID NO: 173858, SEQ ID NO: 173864, SEQ ID NO: 173884, SEQ ID NO: 173918, SEQ ID NO: 173923, SEQ ID NO: 173929, SEQ ID NO: 173958, SEQ ID NO: 173993, SEQ ID NO: 174020, SEQ ID NO: 174026, SEQ ID NO: 174044, SEQ ID NO: 174047, SEQ ID NO: 174110, SEQ ID NO: 174116, SEQ ID NO: 174161, SEQ ID NO: 174164, SEQ ID NO: 174168, SEQ ID NO: 174180, SEQ ID NO: 174190, SEQ ID NO: 174210, SEQ ID NO: 174228, SEQ ID NO: 174260, SEQ ID NO: 174265, SEQ ID NO: 174277, SEQ ID NO: 174283, SEQ ID NO: 174301, SEQ ID NO: 174311, SEQ ID NO: 174316, SEQ ID NO: 174356, SEQ ID NO: 174387, SEQ ID NO: 174424, SEQ ID NO: 174452, SEQ ID NO: 174486, SEQ ID NO: 174491, SEQ ID NO: 174507, SEQ ID NO: 174510, SEQ ID NO: 174595, SEQ ID NO: 174611, SEQ ID NO: 174633, SEQ ID NO: 174679, SEQ ID NO: 174702, SEQ ID NO: 174724, SEQ ID NO: 174747, SEQ ID NO: 174756, SEQ ID NO: 174779, SEQ ID NO: 174847, SEQ ID NO: 174880, SEQ ID NO: 174904, SEQ ID NO: 174956, SEQ ID NO: 174960, SEQ ID NO: 174978, SEQ ID NO: 175027, SEQ ID NO: 175063, SEQ ID NO: 175076, SEQ ID NO: 175129, SEQ ID NO: 175160, SEQ ID NO: 175175, SEQ ID NO: 175186, SEQ ID NO: 175191, SEQ ID NO: 175251, SEQ ID NO: 175269, SEQ ID NO: 175292, SEQ ID NO: 175295, SEQ ID NO: 175300, SEQ ID NO: 175416, SEQ ID NO: 175423, SEQ ID NO: 175506, SEQ ID NO: 175541, SEQ ID NO: 175557, SEQ ID NO: 175585, SEQ ID NO: 175625, SEQ ID NO: 175649, SEQ ID NO: 175671, SEQ ID NOs: 175721 to 175722, SEQ ID NO: 175820, SEQ ID NO: 175886, SEQ ID NO: 175902, SEQ ID NO: 175951, SEQ ID NOs: 175960 to 175961, SEQ ID NO: 175968, SEQ ID NO: 175975, SEQ ID NO: 175993, SEQ ID NO: 176018, SEQ ID NO: 176041, SEQ ID NO: 176051, SEQ ID NO: 176112, SEQ ID NO: 176118, SEQ ID NO: 176149, SEQ ID NO: 176179, SEQ ID NO: 176248, SEQ ID NO: 176306, SEQ ID NO: 176309, SEQ ID NO: 176312, SEQ ID NO: 176335, SEQ ID NO: 176338, SEQ ID NO: 176355, SEQ ID NO: 176369, SEQ ID NO: 176379, SEQ ID NO: 176452, SEQ ID NO: 176466, SEQ ID NO: 176503, SEQ ID NO: 176548, SEQ ID NO: 176560, SEQ ID NO: 176611, SEQ ID NO: 176621, SEQ ID NO: 176639, SEQ ID NO: 176693, SEQ ID NO: 176700, SEQ ID NO: 176713, SEQ ID NO: 176764, SEQ ID NOs: 176795 to 176796, SEQ ID NO: 176806, SEQ ID NO: 176815, SEQ ID NO: 176953, SEQ ID NO: 176958, SEQ ID NO: 176969, SEQ ID NO: 176980, SEQ ID NO: 176991, SEQ ID NO: 177016, SEQ ID NO: 177033, SEQ ID NO: 177044, SEQ ID NO: 177061, SEQ ID NO: 177065, SEQ ID NO: 177080, SEQ ID NO: 177088, SEQ ID NO: 177102, SEQ ID NO: 177119, SEQ ID NO: 177343, SEQ ID NO: 177358, SEQ ID NO: 177390, SEQ ID NO: 177430, SEQ ID NO: 177437, SEQ ID NO: 177465, SEQ ID NOs: 177482 to 177483, SEQ ID NO: 177492, SEQ ID NO: 177495, SEQ ID NO: 177522, SEQ ID NO: 177585, SEQ ID NO: 177604, SEQ ID NO: 177611, SEQ ID NO: 177664, SEQ ID NO: 177669, SEQ ID NO: 177701, SEQ ID NO: 177707, SEQ ID NO: 177710, SEQ ID NO: 177712, SEQ ID NO: 177714, SEQ ID NO: 177734, SEQ ID NO: 177808, SEQ ID NO: 177841, SEQ ID NO: 177848, SEQ ID NO: 177892, SEQ ID NO: 177918, SEQ ID NO: 177958, SEQ ID NOs: 177989 to 177990, SEQ ID NO: 178023, SEQ ID NO: 178032, SEQ ID NO: 178035, SEQ ID NO: 178039, SEQ ID NO: 178122, SEQ ID NO: 178161, SEQ ID NO: 178195, SEQ ID NO: 178208, SEQ ID NO: 178244, SEQ ID NO: 178272, SEQ ID NO: 178293, SEQ ID NO: 178310, SEQ ID NO: 178338, SEQ ID NO: 178353, SEQ ID NO: 178385, SEQ ID NO: 178399, SEQ ID NO: 178477, SEQ ID NO: 178519, SEQ ID NO: 178568, SEQ ID NO: 178587, SEQ ID NO: 178600, SEQ ID NO: 178612, SEQ ID NO: 178615, SEQ ID NO: 178651, SEQ ID NO: 178726, SEQ ID NO: 178740, SEQ ID NO: 178743, SEQ ID NO: 178750, SEQ ID NO: 178821, SEQ ID NO: 178886, SEQ ID NO: 178895, SEQ ID NO: 178911, SEQ ID NO: 178942, SEQ ID NO: 178946, SEQ ID NO: 178948, SEQ ID NO: 178966, SEQ ID NO: 179020, SEQ ID NO: 179031, SEQ ID NO: 179034, SEQ ID NO: 179130, SEQ ID NO: 179134, SEQ ID NO: 179151, SEQ ID NO: 179154, SEQ ID NO: 179224, SEQ ID NO: 179257, SEQ ID NO: 179387, SEQ ID NO: 179404, SEQ ID NO: 179444, SEQ ID NO: 179455, SEQ ID NO: 179462, SEQ ID NO: 179483, SEQ ID NO: 179544, SEQ ID NO: 179586, SEQ ID NO: 179600, SEQ ID NO: 179612, SEQ ID NO: 179619, SEQ ID NO: 179632, SEQ ID NO: 179677, SEQ ID NO: 179695, SEQ ID NO: 179697, SEQ ID NO: 179760, SEQ ID NO: 179863, SEQ ID NO: 179898, SEQ ID NO: 179904, SEQ ID NO: 179934, SEQ ID NO: 179957, SEQ ID NO: 179981, SEQ ID NO: 180013, SEQ ID NO: 180019, SEQ ID NO: 180036, SEQ ID NO: 180077, SEQ ID NO: 180086, SEQ ID NO: 180167, SEQ ID NO: 180257, SEQ ID NO: 180259, SEQ ID NO: 180271, SEQ ID NO: 180291, SEQ ID NO: 180327, SEQ ID NO: 180348, SEQ ID NO: 180378, SEQ ID NO: 180396, SEQ ID NO: 180430, SEQ ID NO: 180452, SEQ ID NO: 180458, SEQ ID NO: 180481, SEQ ID NO: 180489, SEQ ID NO: 180492, SEQ ID NO: 180528, SEQ ID NO: 180551, SEQ ID NO: 180567, SEQ ID NO: 180577, SEQ ID NO: 180597, SEQ ID NO: 180622, SEQ ID NO: 180683, SEQ ID NO: 180694, SEQ ID NOs: 180720 to 180721, SEQ ID NO: 180772, SEQ ID NO: 180799, SEQ ID NO: 180823, SEQ ID NO: 180843, SEQ ID NO: 180848, SEQ ID NO: 180858, SEQ ID NO: 180866, SEQ ID NO: 180879, SEQ ID NO: 180977, SEQ ID NOs: 181032 to 181033, SEQ ID NO: 181173, SEQ ID NO: 181204, SEQ ID NO: 181259, SEQ ID NO: 181406, SEQ ID NO: 181630, SEQ ID NO: 181685, SEQ ID NO: 181792, SEQ ID NO: 181963, SEQ ID NO: 181984, SEQ ID NOs: 182157 to 182159, SEQ ID NO: 182471, SEQ ID NOs: 182574 to 197896, SEQ ID NO: 379327, SEQ ID NO: 379329, SEQ ID NO: 379332, SEQ ID NO: 379334, SEQ ID NO: 379770, SEQ ID NO: 381531, SEQ ID NO: 382109, SEQ ID NO: 383301, SEQ ID NO: 383305, SEQ ID NO: 383310, SEQ ID NO: 386111, SEQ ID NO: 387057, SEQ ID NO: 387062, or SEQ ID NOs: 392434 to 410309.

In some embodiments, the amino acid sequence for a MHC class I and/or MHC class II peptides may be used to create a single target (individual) or combined peptide vaccine for the MAR1 protein having between about 2 and about 40 peptides. In some embodiments, any one of the peptides in the vaccine for the MAR1 protein comprises one or more of the SEQ ID NOs: 113808 to 116477 and SEQ ID NOs: 305566 to 307669. In some embodiments, any one of the peptides in the MAR1 vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 113808 to 116477 or SEQ ID NOs: 305566 to 307669.

In some embodiments, any combination of MHC class I and/or MHC class II peptides disclosed herein (SEQ ID NOs: 1 to 34168, 37110 to 116477, 125134 to 203516, 206663 to 307669, or 317360 to 410309) may be used to create a single target (individual) or combined peptide vaccine having between about 2 and about 40 peptides. In some embodiments, any one of the peptides (peptides 1 to 34168, 37110 to 116477, 125134 to 203516, 206663 to 307669, or 317360 to 410309; SEQ ID NOs: 1 to 34168, 37110 to 116477, 125134 to 203516, 206663 to 307669, or 317360 to 410309) in the combined vaccine comprises an amino acid sequence 80, 81, 82, 83, 84, 85, 86, 87, 88, 89, 90, 91, 92, 93, 94, 95, 96, 97, 98 or 99% identical to any of SEQ ID NOs: 1 to 34168, 37110 to 116477, 125134 to 203516, 206663 to 307669, or 317360 to 410309.

Vaccines for Autoimmune Diseases

MHC Class I Peptide Sequences

In some embodiments, the amino acid sequence for a MHC class I peptide vaccine for the INS protein comprises one or more of the SEQ ID NOs: 34169 to 34224. In some embodiments, any one of the peptides in the INS vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 34169 to 34224.

In some embodiments, the amino acid sequence for a MHC class I peptide vaccine for the INS protein comprises one or more of the SEQ ID NOs: 34169 to 37109. In some embodiments, any one of the peptides in the INS vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 34169 to 37109.

In some embodiments, the amino acid sequence for a MHC class I peptide vaccine for the INS protein comprises two or more of the SEQ ID NOs: 34169 to 34224. In some embodiments, any one of the peptides in the INS vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 34169 to 34224.

In some embodiments, the amino acid sequence for a MHC class I peptide vaccine for the INS protein comprises two or more of the SEQ ID NOs: 34169 to 37109. In some embodiments, any one of the peptides in the INS vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 34169 to 37109.

In some embodiments, the amino acid sequence for a MHC class I peptide vaccine for the MOG protein comprises one or more of the SEQ ID NOs: 116478 to 116563. In some embodiments, any one of the peptides in the MOG vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 116478 to 116563.

In some embodiments, the amino acid sequence for a MHC class I peptide vaccine for the MOG protein comprises one or more of the SEQ ID NOs: 116478 to 125133. In some embodiments, any one of the peptides in the MOG vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 116478 to 125133.

In some embodiments, the amino acid sequence for a MHC class I peptide vaccine for the MOG protein comprises two or more of the SEQ ID NOs: 116478 to 116563. In some embodiments, any one of the peptides in the MOG vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 116478 to 116563.

In some embodiments, the amino acid sequence for a MHC class I peptide vaccine for the MOG protein comprises two or more of the SEQ ID NOs: 116478 to 125133. In some embodiments, any one of the peptides in the MOG vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 116478 to 125133.

MHC Class II Peptide Sequences

In some embodiments, the amino acid sequence for a MHC class II peptide vaccine for the INS protein comprises one or more of the SEQ ID NOs: 203517 to 203524. In some embodiments, any one of the peptides in the INS vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 203517 to 203524.

In some embodiments, the amino acid sequence for a MHC class II peptide vaccine for the INS protein comprises one or more of the SEQ ID NOs: 203517 to 206662. In some embodiments, any one of the peptides in the INS vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 203517 to 206662.

In some embodiments, the amino acid sequence for a MHC class II peptide vaccine for the INS protein comprises two or more of the SEQ ID NOs: 203517 to 203524. In some embodiments, any one of the peptides in the INS vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 203517 to 203524.

In some embodiments, the amino acid sequence for a MHC class II peptide vaccine for the INS protein comprises two or more of the SEQ ID NOs: 203517 to 206662. In some embodiments, any one of the peptides in the INS vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 203517 to 206662.

In some embodiments, the amino acid sequence for a MHC class II peptide vaccine for the MOG protein comprises one or more of the SEQ ID NOs: 307670 to 307685. In some embodiments, any one of the peptides in the MOG vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 307670 to 307685.

In some embodiments, the amino acid sequence for a MHC class II peptide vaccine for the MOG protein comprises one or more of the SEQ ID NOs: 307670 to 317359. In some embodiments, any one of the peptides in the MOG vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 307670 to 317359.

In some embodiments, the amino acid sequence for a MHC class II peptide vaccine for the MOG protein comprises two or more of the SEQ ID NOs: 307670 to 307685. In some embodiments, any one of the peptides in the MOG vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 307670 to 307685.

In some embodiments, the amino acid sequence for a MHC class II peptide vaccine for the MOG protein comprises two or more of the SEQ ID NOs: 307670 to 317359. In some embodiments, any one of the peptides in the MOG vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 307670 to 317359.

In some embodiments, the amino acid sequence for a MHC class I and/or MHC class II peptides may be used to create a single target (individual) or combined peptide vaccine for the INS protein having between about 2 and about 40 peptides. In some embodiments, any one of the peptides in the vaccine for the INS protein comprises one or more of the SEQ ID NOs: 34169 to 37109 and SEQ ID NOs: 203517 to 206662. In some embodiments, any one of the peptides in the INS vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 34169 to 37109 or SEQ ID NOs: 203517 to 206662.

In some embodiments, the amino acid sequence for a MHC class I and/or MHC class II peptides may be used to create a single target (individual) or combined peptide vaccine for the MOG protein having between about 2 and about 40 peptides. In some embodiments, any one of the peptides in the vaccine for the MOG protein comprises one or more of the SEQ ID NOs: 116478 to 125133 and SEQ ID NOs: 307670 to 317359. In some embodiments, any one of the peptides in the MOG vaccine comprise an amino acid sequence 80, 81, 82, 83, 84, 85, 86, 87, 88, 89, 90, 91, 92, 93, 94, 95, 96, 97, 98 or 99% identical to SEQ ID NOs: 116478 to 125133 or SEQ ID NOs: 307670 to 317359.

TABLE 1

Example Vaccine Peptides (MHC class I)

| SEQ ID NO | Sequence corresponding to SEQ ID NO | Target | Seed SEQ ID NO | Seed | Heteroclitic Modification p2 | Heteroclitic Modification C-term | Note |
|---|---|---|---|---|---|---|---|
| SEQ ID NO: 1 | KFIKTWPRK | AKT1E17K | SEQ ID NO: 1761 | KYIKTWRPRY | Y2F | Y10K | Individual AKT1_E17K Vaccine (5-peptide, NetMHCpan, Set 1); Individual AKT1_E17K Vaccine (5-peptide, NetMHCpan, Set 2) |
| SEQ ID NO: 2 | KVIKTWRPRY | AKT1E17K | SEQ ID NO: 1761 | KYIKTWRPRY | Y2V | — | Individual AKT1_E17K Vaccine (5-peptide, NetMHCpan, Set 1) |
| SEQ ID NO: 3 | RVKYIKTWR | AKT1E17K | SEQ ID NO: 1762 | RGKYIKTWR | G2V | — | Individual AKT1_E17K Vaccine (5-peptide, NetMHCpan, Set 1) |
| SEQ ID NO: 4 | WAHKRGKYL | AKT1E17K | SEQ ID NO: 1764 | WLHKRGKYI | L2A | I9L | Individual AKT1_E17K Vaccine (5-peptide, NetMHCpan, Set 1) |
| SEQ ID NO: 5 | GTLHKRGKY | AKT1E17K | SEQ ID NO: 1765 | GMLHKRGKY | W2T | — | Individual AKT1_E17K Vaccine (5-peptide, NetMHCpan, Set 1) |
| SEQ ID NO: 6 | KRGKYIKTF | AKT1E17K | SEQ ID NO: 1767 | KRGKYIKTW | W9F | — | Individual AKT1_E17K Vaccine (8-peptide, MHCflurry, Set 1); Individual AKT1_E17K Vaccine (8-peptide, MHCflurry, Set 2) |
| SEQ ID NO: 7 | KRGKYIKTY | AKT1E17K | SEQ ID NO: 1767 | KRGKYIKTW | — | W9Y | Individual AKT1_E17K Vaccine (8-peptide, MHCflurry, Set 1) |
| SEQ ID NO: 8 | KTGKYIKTF | AKT1E17K | SEQ ID NO: 1767 | KRGKYIKTW | R2T | W9F | Individual AKT1_E17K Vaccine (8-peptide, MHCflurry, Set 1) |
| SEQ ID NO: 9 | KYIKTWRPRF | AKT1E17K | SEQ ID NO: 1761 | KYIKTWRPRY | — | Y10F | Individual AKT1_E17K Vaccine (8-peptide, MHCflurry, Set 1); Individual AKT1_E17K Vaccine (8-peptide, MHCflurry, Set 2) |
| SEQ ID NO: 10 | RTKYIKTWK | AKT1E17K | SEQ ID NO: 1762 | RGKYIKTWR | G2T | R9K | Individual AKT1_E17K Vaccine (8-peptide, MHCflurry, Set 1); Individual AKT1_E17K Vaccine (8-peptide, MHCflurry, Set 2) |
| SEQ ID NO: 11 | RVKYIKTWK | AKT1E17K | SEQ ID NO: 1762 | RGKYIKTWR | G2V | R9K | Individual AKT1_E17K Vaccine (8-peptide, MHCflurry, Set 1) |
| SEQ ID NO: 12 | WLHKRGKYV | AKT1E17K | SEQ ID NO: 1764 | WLHKRGKYI | — | I9V | Individual AKT1_E17K Vaccine (8-peptide, MHCflurry, Set 1); Individual AKT1_E17K Vaccine (5-peptide, NetMHCpan, Set 2) |
| SEQ ID NO: 13 | KMIKTWRPRY | AKT1E17K | SEQ ID NO: 1761 | KYIKTWRPRY | Y2M | — | Individual AKT1_E17K Vaccine (5-peptide, NetMHCpan, Set 2); Individual AKT1_E17K Vaccine (8-peptide, MHCflurry, Set 2) |
| SEQ ID NO: 14 | RMKYIKTWR | AKT1E17K | SEQ ID NO: 1762 | RGKYIKTWR | G2M | — | Individual AKT1_E17K Vaccine (5-peptide, NetMHCpan, Set 2) |
| SEQ ID NO: 15 | GMLHKRGKY | AKT1E17K | SEQ ID NO: 1765 | GMLHKRGKY | W2M | — | Individual AKT1_E17K Vaccine (8-peptide, MHCflurry, Set 2) |
| SEQ ID NO: 16 | KRGKYIKTL | AKT1E17K | SEQ ID NO: 1767 | KRGKYIKTW | — | W9L | Individual AKT1_E17K Vaccine (8-peptide, MHCflurry, Set 2) |

TABLE 1-continued

Example Vaccine Peptides (MHC class I)

| SEQ ID NO | Sequence corresponding to SEQ ID | Target | Seed SEQ ID NO | Seed | Heteroclitic Modification p2 | Heteroclitic Modification C-term | Note |
|---|---|---|---|---|---|---|---|
| SEQ ID NO: 17 | RSKYIKTWK | AKT1E17K | SEQ ID NO: 1762 | RGKYIKTWR | G25 | R9K | Individual AKT1_E17K Vaccine (8-peptide, MHCflurry, Set 2) |
| SEQ ID NO: 18 | WMHKRGKYV | AKT1E17K | SEQ ID NO: 1764 | WLHKRGKYI | L2M | I9V | Individual AKT1_E17K Vaccine (8-peptide, MHCflurry, Set 2) |
| SEQ ID NO: 19 | FSLATEKSRW | BRAF V600E | SEQ ID NO: 2323 | FGLATEKSRW | G25 | — | Individual BRAF_V600E Vaccine (5-peptide, NetMHCpan, Set 1); Skin Cancer Vaccine (20-peptide); Thyroid Cancer Vaccine (10-peptide); Individual BRAF_V600E Vaccine (4-peptide, NetMHCpan, Set 2); Individual BRAF_V600E Vaccine (8-peptide, MHCflurry, Set 2) |
| SEQ ID NO: 20 | FTLATEKSRW | BRAF V600E | SEQ ID NO: 2323 | FGLATEKSRW | G2T | — | Individual BRAF_V600E Vaccine (5-peptide, NetMHCpan, Set 1); Colorectal Cancer Vaccine (20-peptide); Skin Cancer Vaccine (20-peptide); Thyroid Cancer Vaccine (10-peptide) |
| SEQ ID NO: 21 | KMGDFGLATEK | BRAF V600E | SEQ ID NO: 2324 | KIGDFGLATEK | I2M | — | Individual BRAF_V600E Vaccine (5-peptide, NetMHCpan, Set 1); Colorectal Cancer Vaccine (20-peptide); Skin Cancer Vaccine (20-peptide); Thyroid Cancer Vaccine (10-peptide); Individual BRAF_V600E Vaccine (4-peptide, NetMHCpan, Set 2) |
| SEQ ID NO: 22 | KTGDFGLATEK | BRAF V600E | SEQ ID NO: 2324 | KIGDFGLATEK | I2T | — | Individual BRAF_V600E Vaccine (5-peptide, NetMHCpan, Set 1); Colorectal Cancer Vaccine (20-peptide); Skin Cancer Vaccine (20-peptide); Thyroid Cancer Vaccine (10-peptide); Individual BRAF_V600E Vaccine (4-peptide, NetMHCpan, Set 2) |
| SEQ ID NO: 23 | KVGDFGLATER | BRAF V600E | SEQ ID NO: 2324 | KIGDFGLATEK | I2V | K11R | Individual BRAF_V600E Vaccine (5-peptide, NetMHCpan, Set 1); Colorectal Cancer Vaccine (20-peptide); Skin Cancer Vaccine (20-peptide); Thyroid Cancer Vaccine (10-peptide); Individual BRAF_V600E Vaccine (8-peptide, MHCflurry, Set 1); Individual BRAF_V600E Vaccine (8-peptide, MHCflurry, Set 2) |
| SEQ ID NO: 24 | FTLATEKSR | BRAF V600E | SEQ ID NO: 2325 | FGLATEKSR | G2T | — | Individual BRAF_V600E Vaccine (8-peptide, MHCflurry, Set 1); Individual BRAF_V600E Vaccine (8-peptide, MHCflurry, Set 2) |
| SEQ ID NO: 25 | GAFGLATEL | BRAF V600E | SEQ ID NO: 2326 | GDFGLATEK | D2A | K9L | Individual BRAF_V600E Vaccine (8-peptide, MHCflurry, Set 1) |

TABLE 1-continued

Example Vaccine Peptides (MHC class I)

| SEQ ID NO | Sequence corresponding to SEQ ID | Target | Seed SEQ ID NO | Seed | Heteroclitic Modification p2 | Heteroclitic Modification C-term | Note |
|---|---|---|---|---|---|---|---|
| SEQ ID NO: 26 | GQATEKSRL | BRAF V600E | SEQ ID NO: 2327 | GLATEKSRW | L2Q | W9L | Individual BRAF_V600E Vaccine (8-peptide, MHCflurry, Set 1); Individual BRAF_V600E Vaccine (8-peptide, MHCflurry, Set 2) |
| SEQ ID NO: 27 | GSATEKSRW | BRAF V600E | SEQ ID NO: 2327 | GLATEKSRW | L25 | — | Individual BRAF_V600E Vaccine (8-peptide, MHCflurry, Set 1) |
| SEQ ID NO: 28 | ISDFGLATEY | BRAF V600E | SEQ ID NO: 2328 | IGDFGLATEK | G25 | K10Y | Individual BRAF_V600E Vaccine (8-peptide, MHCflurry, Set 1) |
| SEQ ID NO: 29 | KAGDFGLATEY | BRAF V600E | SEQ ID NO: 2324 | KIGDFGLATEK | I2A | K11Y | Individual BRAF_V600E Vaccine (8-peptide, MHCflurry, Set 1); Individual BRAF_V600E Vaccine (8-peptide, MHCflurry, Set 2) |
| SEQ ID NO: 30 | KVGDFGLATEK | BRAF V600E | SEQ ID NO: 2324 | KIGDFGLATEK | I2V | — | Individual BRAF_V600E Vaccine (8-peptide, MHCflurry, Set 1); Individual BRAF_V600E Vaccine (8-peptide, MHCflurry, Set 2) |
| SEQ ID NO: 31 | KMGDFGLATER | BRAF V600E | SEQ ID NO: 2324 | KIGDFGLATEK | I2M | K11R | Individual BRAF_V600E Vaccine (4-peptide, NetMHCpan, Set 2) |
| SEQ ID NO: 32 | GAFGLATEF | BRAF V600E | SEQ ID NO: 2326 | GDFGLATEK | D2A | K9F | Individual BRAF_V600E Vaccine (8-peptide, MHCflurry, Set 2) |
| SEQ ID NO: 33 | IADFGLATEY | BRAF V600E | SEQ ID NO: 2328 | IGDFGLATEK | G2A | K10Y | Individual BRAF_V600E Vaccine (8-peptide, MHCflurry, Set 2) |
| SEQ ID NO: 34 | AYMKSRWSGK | BRAF V600M | SEQ ID NO: 3160 | ATMKSRWSGS | T2Y | S10K | Individual BRAF_V600M Vaccine (5-peptide, NetMHCpan, Set 1); Skin Cancer Vaccine (20-peptide) |
| SEQ ID NO: 35 | FTLATMKSRW | BRAF V600M | SEQ ID NO: 3163 | FGLATMKSRW | G2T | — | Individual BRAF_V600M Vaccine (5-peptide, NetMHCpan, Set 1); Skin Cancer Vaccine (20-peptide) |
| SEQ ID NO: 36 | KMGDFGLATM | BRAF V600M | SEQ ID NO: 3164 | KIGDFGLATMK | I2M | — | Individual BRAF_V600M Vaccine (5-peptide, NetMHCpan, Set 1); Skin Cancer Vaccine (20-peptide); Individual BRAF_V600M Vaccine (5-peptide, NetMHCpan, Set 2) |
| SEQ ID NO: 37 | KTGDFGLATM | BRAF V600M | SEQ ID NO: 3164 | KIGDFGLATMK | I2T | — | Individual BRAF_V600M Vaccine (5-peptide, NetMHCpan, Set 1); Skin Cancer Vaccine (20-peptide); Individual BRAF_V600M Vaccine (8-peptide, MHCflurry, Set 1); Individual BRAF_V600M Vaccine (5-peptide, NetMHCpan, Set 2) |
| SEQ ID NO: 38 | MMSRWSGSHQF | BRAF V600M | SEQ ID NO: 3166 | MKSRWSGSHQF | K2M | — | Individual BRAF_V600M Vaccine (5-peptide, NetMHCpan, Set 1); Skin Cancer Vaccine (20-peptide) |

TABLE 1-continued

Example Vaccine Peptides (MHC class I)

| SEQ ID NO | Sequence corresponding to SEQ ID | Target | Seed SEQ ID NO | Seed | Heteroclitic Modification p2 | Heteroclitic Modification C-term | Note |
|---|---|---|---|---|---|---|---|
| SEQ ID NO: 39 | FTLATMKSR | BRAF V600M | SEQ ID NO: 3162 | FGLATMKSR | G2T | — | Skin Cancer Vaccine (20-peptide); Individual BRAF_V600M Vaccine (8-peptide, MHCflurry, Set 1); Individual BRAF_V600M Vaccine (4-peptide, MHCflurry, Set 2) |
| SEQ ID NO: 40 | KYGDFGLATMR | BRAF V600M | SEQ ID NO: 3164 | KIGDFGLATMK | I2Y | K11R | Skin Cancer Vaccine (20-peptide) |
| SEQ ID NO: 41 | FTLATMKSK | BRAF V600M | SEQ ID NO: 3162 | FGLATMKSR | G2T | R9K | Individual BRAF_V600M Vaccine (8-peptide, MHCflurry, Set 1) |
| SEQ ID NO: 42 | FVLATMKSR | BRAF V600M | SEQ ID NO: 3162 | FGLATMKSR | G2V | — | Individual BRAF_V600M Vaccine (8-peptide, MHCflurry, Set 1) |
| SEQ ID NO: 43 | GSATMKSRW | BRAF V600M | SEQ ID NO: 3168 | GLATMKSRW | L2S | — | Individual BRAF_V600M Vaccine (8-peptide, MHCflurry, Set 1) |
| SEQ ID NO: 44 | GTATMKSRW | BRAF V600M | SEQ ID NO: 3168 | GLATMKSRW | L2T | — | Individual BRAF_V600M Vaccine (8-peptide, MHCflurry, Set 1); Individual BRAF_V600M Vaccine (4-peptide, MHCflurry, Set 2) |
| SEQ ID NO: 45 | KTGDFGLATMR | BRAF V600M | SEQ ID NO: 3164 | KIGDFGLATMK | I2T | K11R | Individual BRAF_V600M Vaccine (8-peptide, MHCflurry, Set 1) |
| SEQ ID NO: 46 | KVGDFGLATMK | BRAF V600M | SEQ ID NO: 3164 | KIGDFGLATMK | I2V | — | Individual BRAF_V600M Vaccine (8-peptide, MHCflurry, Set 1); Individual BRAF_V600M Vaccine (4-peptide, MHCflurry, Set 2) |
| SEQ ID NO: 47 | ATMKSRWSK | BRAF V600M | SEQ ID NO: 3159 | ATMKSRWSG | — | G9K | Individual BRAF_V600M Vaccine (5-peptide, NetMHCpan, Set 2) |
| SEQ ID NO: 48 | FSLATMKSRW | BRAF V600M | SEQ ID NO: 3163 | FGLATMKSRW | G2S | — | Individual BRAF_V600M Vaccine (5-peptide, NetMHCpan, Set 2) |
| SEQ ID NO: 49 | MQSRWSGSHQF | BRAF V600M | SEQ ID NO: 3166 | MKSRWSGSHQF | K2Q | — | Individual BRAF_V600M Vaccine (5-peptide, NetMHCpan, Set 2) |
| SEQ ID NO: 50 | ITDFGLATMY | BRAF V600M | SEQ ID NO: 3169 | IGDFGLATMK | G2T | K10Y | Individual BRAF_V600M Vaccine (4-peptide, MHCflurry, Set 2) |
| SEQ ID NO: 51 | KMSFGVTCVK | EGFR A289V | SEQ ID NO: 4046 | KYSFGVTCVK | Y2M | — | Individual EGFR_A289V Vaccine (5-peptide, NetMHCpan, Set 1); Brain Cancer Vaccine (25-peptide); Individual EGFR_A289V Vaccine (5-peptide, NetMHCpan, Set 2) |
| SEQ ID NO: 52 | KYSFGVTCL | EGFR A289V | SEQ ID NO: 4045 | KYSFGVTCV | — | V9L | Individual EGFR_A289V Vaccine (5-peptide, NetMHCpan, Set 1); Brain Cancer Vaccine (25-peptide); Individual EGFR_A289V Vaccine (8-peptide, MHCflurry, Set 1); Individual EGFR_A289V Vaccine (8-peptide, MHCflurry, Set 2) |

TABLE 1-continued

Example Vaccine Peptides (MHC class I)

| SEQ ID NO | Sequence corresponding to SEQ ID | Target | Seed SEQ ID NO | Seed | Heteroclitic Modification p2 | Heteroclitic Modification C-term | Note |
|---|---|---|---|---|---|---|---|
| SEQ ID NO: 53 | YAFGVTCM | EGFR A289V | SEQ ID NO: 4050 | YSFGVTCV | 52A | V8M | Individual EGFR_A289V Vaccine (5-peptide, NetMHCpan, Set 1); Brain Cancer Vaccine (25-peptide); Individual EGFR_A289V Vaccine (5-peptide, NetMHCpan, Set 2) |
| SEQ ID NO: 54 | YTFGVTCVR | EGFR A289V | SEQ ID NO: 4051 | YSFGVTCVK | 52T | K9R | Individual EGFR_A289V Vaccine (5-peptide, NetMHCpan, Set 1); Brain Cancer Vaccine (25-peptide); Individual EGFR_A289V Vaccine (5-peptide, NetMHCpan, Set 2); Individual EGFR_A289V Vaccine (8-peptide, MHCflurry, Set 2) |
| SEQ ID NO: 55 | YVFGVTCVM | EGFR A289V | SEQ ID NO: 4051 | YSFGVTCVK | 52V | K9M | Individual EGFR_A289V Vaccine (5-peptide, NetMHCpan, Set 1); Brain Cancer Vaccine (25-peptide) |
| SEQ ID NO: 56 | GRYSFGVTF | EGFR A289V | SEQ ID NO: 4054 | GKYSFGVTC | K2R | C9F | Individual EGFR_A289V Vaccine (8-peptide, MHCflurry, Set 1) |
| SEQ ID NO: 57 | KYSFGVTCF | EGFR A289V | SEQ ID NO: 4045 | KYSFGVTCV | — | V9F | Individual EGFR_A289V Vaccine (8-peptide, MHCflurry, Set 1); Individual EGFR_A289V Vaccine (5-peptide, NetMHCpan, Set 2); Individual EGFR_A289V Vaccine (8-peptide, MHCflurry, Set 2) |
| SEQ ID NO: 58 | YMFGVTCVK | EGFR A289V | SEQ ID NO: 4051 | YSFGVTCVK | 52M | — | Individual EGFR_A289V Vaccine (8-peptide, MHCflurry, Set 1) |
| SEQ ID NO: 59 | YSFGVTCVM | EGFR A289V | SEQ ID NO: 4051 | YSFGVTCVK | — | K9M | Individual EGFR_A289V Vaccine (8-peptide, MHCflurry, Set 1) |
| SEQ ID NO: 60 | YTFGVTCVK | EGFR A289V | SEQ ID NO: 4051 | YSFGVTCVK | 52T | — | Individual EGFR_A289V Vaccine (8-peptide, MHCflurry, Set 1); Individual EGFR_A289V Vaccine (8-peptide, MHCflurry, Set 2) |
| SEQ ID NO: 61 | YTFGVTCVY | EGFR A289V | SEQ ID NO: 4051 | YSFGVTCVK | 52T | K9Y | Individual EGFR_A289V Vaccine (8-peptide, MHCflurry, Set 1); Individual EGFR_A289V Vaccine (8-peptide, MHCflurry, Set 2) |
| SEQ ID NO: 62 | YVFGVTCVR | EGFR A289V | SEQ ID NO: 4051 | YSFGVTCVK | 52V | K9R | Individual EGFR_A289V Vaccine (8-peptide, MHCflurry, Set 1) |
| SEQ ID NO: 63 | YMFGVTCVY | EGFR A289V | SEQ ID NO: 4051 | YSFGVTCVK | 52M | K9Y | Individual EGFR_A289V Vaccine (5-peptide, NetMHCpan, Set 2) |
| SEQ ID NO: 64 | GQYSFGVTL | EGFR A289V | SEQ ID NO: 4054 | GKYSFGVTC | K2Q | C9L | Individual EGFR_A289V Vaccine (8-peptide, MHCflurry, Set 2) |
| SEQ ID NO: 65 | YLFGVTCVK | EGFR A289V | SEQ ID NO: 4051 | YSFGVTCVK | 52L | — | Individual EGFR_A289V Vaccine (8-peptide, MHCflurry, Set 2) |
| SEQ ID NO: 66 | YTFGVTCVM | EGFR A289V | SEQ ID NO: 4051 | YSFGVTCVK | 52T | K9M | Individual EGFR_A289V Vaccine (8-peptide, MHCflurry, Set 2) |

TABLE 1-continued

Example Vaccine Peptides (MHC class I)

| SEQ ID NO | Sequence corresponding to SEQ ID | Target | Seed SEQ ID NO | Seed | Heteroclitic Modification p2 | Heteroclitic Modification C-term | Note |
|---|---|---|---|---|---|---|---|
| SEQ ID NO: 67 | VMMGENNTLV | EGFR G598V | SEQ ID NO: 4715 | VVMGENNTLV | V2M | — | Individual EGFR_G598V Vaccine (5-peptide, NetMHCpan, Set 1); Brain Cancer Vaccine (25-peptide); Individual EGFR_G598V Vaccine (5-peptide, NetMHCpan, Set 2) |
| SEQ ID NO: 68 | VMMGENNTV | EGFR G598V | SEQ ID NO: 4714 | VVMGENNTL | V2M | L9V | Individual EGFR_G598V Vaccine (5-peptide, NetMHCpan, Set 1); Brain Cancer Vaccine (25-peptide); Individual EGFR_G598V Vaccine (8-peptide, MHCflurry, Set 1); Individual EGFR_G598V Vaccine (5-peptide, NetMHCpan, Set 2); Individual EGFR_G598V Vaccine (8-peptide, MHCflurry, Set 2) |
| SEQ ID NO: 69 | VSMGENNTLV | EGFR G598V | SEQ ID NO: 4716 | VVMGENNTLVW | V2S | — | Individual EGFR_G598V Vaccine (5-peptide, NetMHCpan, Set 1); Brain Cancer Vaccine (25-peptide); Individual EGFR_G598V Vaccine (5-peptide, NetMHCpan, Set 2) |
| SEQ ID NO: 70 | VSMGENNTM | EGFR G598V | SEQ ID NO: 4714 | VVMGENNTL | V2S | L9M | Individual EGFR_G598V Vaccine (5-peptide, NetMHCpan, Set 1); Brain Cancer Vaccine (25-peptide) |
| SEQ ID NO: 71 | VSTCPAVF | EGFR G598V | SEQ ID NO: 4713 | VKTCPAVVM | K2S | M9F | Individual EGFR_G598V Vaccine (5-peptide, NetMHCpan, Set 1) |
| SEQ ID NO: 72 | VAMGENNTM | EGFR G598V | SEQ ID NO: 4714 | VVMGENNTL | V2A | L9M | Brain Cancer Vaccine (25-peptide) |
| SEQ ID NO: 73 | VQTCPAVL | EGFR G598V | SEQ ID NO: 4713 | VKTCPAVVM | K2Q | M9L | Brain Cancer Vaccine (25-peptide) |
| SEQ ID NO: 74 | VAMGENNTL | EGFR G598V | SEQ ID NO: 4714 | VVMGENNTL | V2A | — | Individual EGFR_G598V Vaccine (8-peptide, MHCflurry, Set 1); Individual EGFR_G598V Vaccine (5-peptide, NetMHCpan, Set 2); Individual EGFR_G598V Vaccine (8-peptide, MHCflurry, Set 2) |
| SEQ ID NO: 75 | VLMGENNTW | EGFR G598V | SEQ ID NO: 4714 | VVMGENNTL | V2L | L9W | Individual EGFR_G598V Vaccine (8-peptide, MHCflurry, Set 1); Individual EGFR_G598V Vaccine (8-peptide, MHCflurry, Set 2) |
| SEQ ID NO: 76 | VPMGENNTL | EGFR G598V | SEQ ID NO: 4714 | VVMGENNTL | V2P | — | Individual EGFR_G598V Vaccine (8-peptide, MHCflurry, Set 1); Individual EGFR_G598V Vaccine (8-peptide, MHCflurry, Set 2) |
| SEQ ID NO: 77 | VPMGENNTLV | EGFR G598V | SEQ ID NO: 4716 | VVMGENNTLVW | V2P | — | Individual EGFR_G598V Vaccine (8-peptide, MHCflurry, Set 1); Individual EGFR_G598V Vaccine (8-peptide, MHCflurry, Set 2) |

TABLE 1-continued

Example Vaccine Peptides (MHC class I)

| SEQ ID NO | Sequence corresponding to SEQ ID | Target | Seed SEQ ID NO | Seed | Heteroclitic Modification p2 | Heteroclitic Modification C-term | Note |
|---|---|---|---|---|---|---|---|
| SEQ ID NO: 78 | VRMGENNTL | EGFR G598V | SEQ ID NO: 4714 | VVMGENNTL | V2R | — | Individual EGFR_G598V Vaccine (8-peptide, MHCflurry, Set 1); Individual EGFR_G598V Vaccine (8-peptide, MHCflurry, Set 2) |
| SEQ ID NO: 79 | VTMGENNTLV W | EGFR G598V | SEQ ID NO: 4716 | VVMGENNTLVW | V2T | — | Individual EGFR_G598V Vaccine (8-peptide, MHCflurry, Set 1); Individual EGFR_G598V Vaccine (8-peptide, MHCflurry, Set 2) |
| SEQ ID NO: 80 | VTMGENNTV | EGFR G598V | SEQ ID NO: 4714 | VVMGENNTL | V2T | L9V | Individual EGFR_G598V Vaccine (8-peptide, MHCflurry, Set 1); Individual EGFR_G598V Vaccine (8-peptide, MHCflurry, Set 2) |
| SEQ ID NO: 81 | VQTCPAVVF | EGFR 0598V | SEQ ID NO: 4713 | VKTCPAVVM | K2Q | M9F | Individual EGFR_0598V Vaccine (5-peptide, NetMHCpan, Set 2) |
| SEQ ID NO: 82 | FQRAKLLGL | EGFR L858R | SEQ ID NO: 5745 | FGRAKLLGA | G2Q | A9L | Individual EGFR_L858R Vaccine (5-peptide, NetMHCpan, Set 1); Bronchus Aand Lung Cancer Vaccine (30-peptide) |
| SEQ ID NO: 83 | IADFGRAKM | EGFR L858R | SEQ ID NO: 5747 | ITDFGRAKL | T2A | L9M | Individual EGFR_L858R Vaccine (5-peptide, NetMHCpan, Set 1); Bronchus Aand Lung Cancer Vaccine (30-peptide); Individual EGFR_L858R Vaccine (5-peptide, NetMHCpan, Set 2) |
| SEQ ID NO: 84 | KMTDFGRAK | EGFR L858R | SEQ ID NO: 5749 | KITDFGRAK | I2M | — | Individual EGFR_L858R Vaccine (5-peptide, NetMHCpan, Set 1); Bronchus Aand Lung Cancer Vaccine (30-peptide); Individual EGFR_L858R Vaccine (5-peptide, NetMHCpan, Set 2) |
| SEQ ID NO: 85 | KTTDFGRAK | EGFR L858R | SEQ ID NO: 5749 | KITDFGRAK | I2T | — | Individual EGFR_L858R Vaccine (5-peptide, NetMHCpan, Set 1); Bronchus Aand Lung Cancer Vaccine (30-peptide); Individual EGFR_L858R Vaccine (8-peptide, MHCflurry, Set 1); Individual EGFR_L858R Vaccine (5-peptide, NetMHCpan, Set 2); Individual EGFR_L858R Vaccine (8-peptide, MHCflurry, Set 2) |
| SEQ ID NO: 86 | KVTDFGRAR | EGFR L858R | SEQ ID NO: 5749 | KITDFGRAK | I2V | K9R | Individual EGFR_L858R Vaccine (5-peptide, NetMHCpan, Set 1); Bronchus Aand Lung Cancer Vaccine (30-peptide) |
| SEQ ID NO: 87 | FPRAKLLGL | EGFR L858R | SEQ ID NO: 5745 | FGRAKLLGA | G2P | A9L | Individual EGFR_L858R Vaccine (8-peptide, MHCflurry, Set 1); Individual EGFR_L858R Vaccine (8-peptide, MHCflurry, Set 2) |
| SEQ ID NO: 88 | IADFGRAKL | EGFR L858R | SEQ ID NO: 5747 | ITDFGRAKL | T2A | — | Individual EGFR_L858R Vaccine (8-peptide, MHCflurry, Set 1); Individual EGFR_L858R Vaccine (8-peptide, MHCflurry, Set 2) |

TABLE 1-continued

Example Vaccine Peptides (MHC class I)

| SEQ ID NO | Sequence corresponding to SEQ ID | Target | Seed SEQ ID NO | Seed | Heteroclitic Modification p2 | Heteroclitic Modification C-term | Note |
|---|---|---|---|---|---|---|---|
| SEQ ID NO: 89 | ITDFGRAKW | EGFR L858R | SEQ ID NO: 5747 | ITDFGRAKL | — | L9W | Individual EGFR_L858R Vaccine (8-peptide, MHCflurry, Set 1) |
| SEQ ID NO: 90 | ITDFGRAKY | EGFR L858R | SEQ ID NO: 5747 | ITDFGRAKL | — | L9Y | Individual EGFR_L858R Vaccine (8-peptide, MHCflurry, Set 1) |
| SEQ ID NO: 91 | KLTDFGRAKV | EGFR L858R | SEQ ID NO: 5753 | KITDFGRAKL | I2L | L10V | Individual EGFR_L858R Vaccine (8-peptide, MHCflurry, Set 1); Individual EGFR_L858R Vaccine (8-peptide, MHCflurry, Set 2) |
| SEQ ID NO: 92 | TEFGRAKLV | EGFR L858R | SEQ ID NO: 5756 | TDFGRAKLL | D2E | L9V | Individual EGFR_L858R Vaccine (8-peptide, MHCflurry, Set 1) |
| SEQ ID NO: 93 | TQFGRAKLL | EGFR L858R | SEQ ID NO: 5756 | TDFGRAKLL | D2Q | — | Individual EGFR_L858R Vaccine (8-peptide, MHCflurry, Set 1); Individual EGFR_L858R Vaccine (8-peptide, MHCflurry, Set 2) |
| SEQ ID NO: 94 | FMRAKLLGL | EGFR L858R | SEQ ID NO: 5745 | FGRAKLLGA | G2M | A9L | Individual EGFR_L858R Vaccine (5-peptide, NetMHCpan, Set 2) |
| SEQ ID NO: 95 | KMTDFGRAR | EGFR L858R | SEQ ID NO: 5749 | KITDFGRAK | I2M | K9R | Individual EGFR_L858R Vaccine (5-peptide, NetMHCpan, Set 2) |
| SEQ ID NO: 96 | ISDFGRAKW | EGFR L858R | SEQ ID NO: 5747 | ITDFGRAKL | T25 | L9W | Individual EGFR_L858R Vaccine (8-peptide, MHCflurry, Set 2) |
| SEQ ID NO: 97 | ISDFGRAKY | EGFR L858R | SEQ ID NO: 5747 | ITDFGRAKL | T25 | L9Y | Individual EGFR_L858R Vaccine (8-peptide, MHCflurry, Set 2) |
| SEQ ID NO: 98 | TEFGRAKLI | EGFR L858R | SEQ ID NO: 5756 | TDFGRAKLL | D2E | L9I | Individual EGFR_L858R Vaccine (8-peptide, MHCflurry, Set 2) |
| SEQ ID NO: 99 | HAKERIRFL | GTF2I L424H | SEQ ID NO: 6482 | HAKERIRFV | — | V9L | Individual GTF2I_L424H Vaccine (8-peptide, NetMHCpan, Set 1); Individual GTF2I_L424H Vaccine (10-peptide, MHCflurry, Set 1); Individual GTF2I_L424H Vaccine (5-peptide, NetMHCpan, Set 2); Individual GTF2I_L424H Vaccine (8-peptide, MHCflurry, Set 2) |
| SEQ ID NO: 100 | HAKERIRFM | GTF2I L424H | SEQ ID NO: 6482 | HAKERIRFV | — | V9M | Individual GTF2I_L424H Vaccine (8-peptide, NetMHCpan, Set 1) |
| SEQ ID NO: 101 | HRKERIRFV | GTF2I L424H | SEQ ID NO: 6482 | HAKERIRFV | A2R | — | Individual GTF2I_L424H Vaccine (8-peptide, NetMHCpan, Set 1) |
| SEQ ID NO: 102 | IPRLERILHM | GTF2I L424H | SEQ ID NO: 6487 | IPRLERILHA | — | A10M | Individual GTF2I_L424H Vaccine (10-peptide, MHCflurry, Set 1); Individual GTF2I_L424H Vaccine (5-peptide, NetMHCpan, Set 2); Individual GTF2I_L424H Vaccine (8-peptide, MHCflurry, Set 2) |
| SEQ ID NO: 103 | RMERILHAK | GTF2I L424H | SEQ ID NO: 6492 | RLERILHAK | L2M | — | Individual GTF2I_L424H Vaccine (8-peptide, MHCflurry, Set 2) |

TABLE 1-continued

Example Vaccine Peptides (MHC class I)

| SEQ ID NO | Sequence corresponding to SEQ ID | Target | Seed SEQ ID NO | Seed | Heteroclitic Modification p2 | Heteroclitic Modification C-term | Note |
|---|---|---|---|---|---|---|---|
| SEQ ID NO: 104 | RMLHAKERW | GTF2I L424H | SEQ ID NO: 6490 | RILHAKERI | I2M | I9W | Individual GTF2I_L424H Vaccine (8-peptide, NetMHCpan, Set 1) |
| SEQ ID NO: 105 | RTERILHAK | GTF2I L424H | SEQ ID NO: 6492 | RLERILHAK | L2T | — | Individual GTF2I_L424H Vaccine (8-peptide, NetMHCpan, Set 1); Individual GTF2I_L424H Vaccine (5-peptide, NetMHCpan, Set 2) |
| SEQ ID NO: 106 | RVERILHAK | GTF2I L424H | SEQ ID NO: 6492 | RLERILHAK | L2V | — | Individual GTF2I_L424H Vaccine (8-peptide, NetMHCpan, Set 1); Individual GTF2I_L424H Vaccine (10-peptide, MHCflurry, Set 1); Individual GTF2I_L424H Vaccine (8-peptide, MHCflurry, Set 2) |
| SEQ ID NO: 107 | HPKERIRFL | GTF2I L424H | SEQ ID NO: 6482 | HAKERIRFV | A2P | V9L | Individual GTF2I_L424H Vaccine (10-peptide, MHCflurry, Set 1); Individual GTF2I_L424H Vaccine (8-peptide, MHCflurry, Set 2) |
| SEQ ID NO: 108 | HQKERIRFL | GTF2I L424H | SEQ ID NO: 6482 | HAKERIRFV | A2Q | V9L | Individual GTF2I_L424H Vaccine (10-peptide, MHCflurry, Set 1) |
| SEQ ID NO: 109 | HYKERIRFM | GTF2I L424H | SEQ ID NO: 6482 | HAKERIRFV | A2Y | V9M | Individual GTF2I_L424H Vaccine (10-peptide, MHCflurry, Set 1) |
| SEQ ID NO: 110 | RQLHAKERI | GTF2I L424H | SEQ ID NO: 6490 | RILHAKERI | I2Q | I9V | Individual GTF2I_L424H Vaccine (10-peptide, MHCflurry, Set 1) |
| SEQ ID NO: 111 | RTERILHAR | GTF2I L424H | SEQ ID NO: 6492 | RLERILHAK | L2T | K9R | Individual GTF2I_L424H Vaccine (10-peptide, MHCflurry, Set 1); Individual GTF2I_L424H Vaccine (8-peptide, MHCflurry, Set 2) |
| SEQ ID NO: 112 | RTLHAKERY | GTF2I L424H | SEQ ID NO: 6490 | RILHAKERI | I2T | I9Y | Individual GTF2I_L424H Vaccine (10-peptide, MHCflurry, Set 1) |
| SEQ ID NO: 113 | RVLHAKERIRY | GTF2I L424H | SEQ ID NO: 6498 | RILHAKERIRF | I2V | F11Y | Individual GTF2I_L424H Vaccine (10-peptide, MHCflurry, Set 1) |
| SEQ ID NO: 114 | HRKERIRFM | GTF2I L424H | SEQ ID NO: 6482 | HAKERIRFV | A2R | V9M | Individual GTF2I_L424H Vaccine (5-peptide, NetMHCpan, Set 2) |
| SEQ ID NO: 115 | IPRLERILHL | GTF2I L424H | SEQ ID NO: 6487 | IPPLERILHA | — | A10L | Individual GTF2I_L424H Vaccine (5-peptide, NetMHCpan, Set 2) |
| SEQ ID NO: 116 | HFKERIRFL | GTF2I L424H | SEQ ID NO: 6482 | HAKERIRFV | A2F | V9L | Individual GTF2I_L424H Vaccine (8-peptide, MHCflurry, Set 2) |
| SEQ ID NO: 117 | RMLHAKERL | GTF2I L424H | SEQ ID NO: 6490 | RILHAKERI | I2M | I9L | Individual GTF2I_L424H Vaccine (8-peptide, MHCflurry, Set 2) |
| SEQ ID NO: 118 | RQLHAKERL | GTF2I L424H | SEQ ID NO: 6490 | RILHAKERI | I2Q | I9L | Individual GTF2I_L424H Vaccine (8-peptide, MHCflurry, Set 2) |
| SEQ ID NO: 119 | KMIIIGCHAY | IDH1 R132C | SEQ ID NO: 6732 | KPIIIGCHAY | P2M | — | Individual IDH1_R132C Vaccine (2-peptide, NetMHCpan, Set 1); Brain Cancer Vaccine (25-peptide); Individual IDH1_R132C Vaccine (2-peptide, NetMHCpan, Set 2); Individual IDH1_R132C Vaccine (3-peptide, MHCflurry, Set 2) |

TABLE 1-continued

Example Vaccine Peptides (MHC class I)

| SEQ ID NO | Sequence corresponding to SEQ ID | Target | Seed SEQ ID NO | Seed | Heteroclitic Modification p2 | Heteroclitic Modification C-term | Note |
|---|---|---|---|---|---|---|---|
| SEQ ID NO: 120 | KPIIIGCHL | IDH1 R132C | SEQ ID NO: 460 | KPIIIGCHA | — | A9L | Individual IDH1_R132C Vaccine (2-peptide, NetMHCpan, Set 1); Brain Cancer Vaccine (25-peptide); Individual IDH1_R132C Vaccine (2-peptide, NetMHCpan, Set 2) |
| SEQ ID NO: 121 | KPIIIGCHAA | IDH1 R132C | SEQ ID NO: 6732 | KPIIIGCHAY | — | Y10A | Individual IDH1_R132C Vaccine (5-peptide, MHCflurry, Set 1); Individual IDH1_R132C Vaccine (3-peptide, MHCflurry, Set 2) |
| SEQ ID NO: 122 | KPIIIGCHAL | IDH1 R132C | SEQ ID NO: 6732 | KPIIIGCHAY | — | Y10L | Individual IDH1_R132C Vaccine (5-peptide, MHCflurry, Set 1) |
| SEQ ID NO: 123 | KPIIIGCHAM | IDH1 R132C | SEQ ID NO: 6732 | KPIIIGCHAY | — | Y10M | Individual IDH1_R132C Vaccine (5-peptide, MHCflurry, Set 1); Individual IDH1_R132C Vaccine (3-peptide, MHCflurry, Set 2) |
| SEQ ID NO: 124 | KQIIIGCHAY | IDH1 R132C | SEQ ID NO: 6732 | KPIIIGCHAY | P2Q | — | Individual IDH1_R132C Vaccine (5-peptide, MHCflurry, Set 1) |
| SEQ ID NO: 125 | IMHHAYGDQY | IDH1 R132H | SEQ ID NO: 7089 | IGHHAYGDQY | G2M | — | Individual IDH1_R132H Vaccine (5-peptide, NetMHCpan, Set 1); Brain Cancer Vaccine (25-peptide); Individual IDH1_R132H Vaccine (5-peptide, NetMHCpan, Set 2) |
| SEQ ID NO: 126 | IMHHAYGDQYR | IDH1 R132H | SEQ ID NO: 7090 | IGHHAYGDQYR | G2M | — | Individual IDH1_R132H Vaccine (5-peptide, NetMHCpan, Set 1); Brain Cancer Vaccine (25-peptide); Individual IDH1_R132H Vaccine (5-peptide, NetMHCpan, Set 2) |
| SEQ ID NO: 127 | KMIIIGHHAY | IDH1 R132H | SEQ ID NO: 7092 | KPIIIGHHAY | P2M | — | Individual IDH1_R132H Vaccine (5-peptide, NetMHCpan, Set 1); Brain Cancer Vaccine (25-peptide); Individual IDH1_R132H Vaccine (5-peptide, NetMHCpan, Set 2) |
| SEQ ID NO: 128 | KPIIIGHHM | IDH1 R132H | SEQ ID NO: 461 | KPIIIGHHA | — | A9M | Individual IDH1_R132H Vaccine (5-peptide, NetMHCpan, Set 1); Brain Cancer Vaccine (25-peptide) |
| SEQ ID NO: 129 | VMPIIIGHHA | IDH1 R132H | SEQ ID NO: 7094 | VKPIIIGHHA | K2M | — | Individual IDH1_R132H Vaccine (5-peptide, NetMHCpan, Set 1); Brain Cancer Vaccine (25-peptide); Individual IDH1_R132H Vaccine (5-peptide, NetMHCpan, Set 2) |
| SEQ ID NO: 130 | KQIIIGHHAM | IDH1 R132H | SEQ ID NO: 7092 | KPIIIGHHAY | P2Q | Y10M | Brain Cancer Vaccine (25-peptide) |
| SEQ ID NO: 131 | HHAYGDQL | IDH1 R132H | SEQ ID NO: 7096 | HHAYGDQY | — | Y8L | Individual IDH1_R132H Vaccine (8-peptide, MHCflurry, Set 1) |
| SEQ ID NO: 132 | HYAYGDQYR | IDH1 R132H | SEQ ID NO: 7097 | HHAYGDQYR | H2Y | — | Individual IDH1_R132H Vaccine (8-peptide, MHCflurry, Set 1) |

TABLE 1-continued

Example Vaccine Peptides (MHC class I)

| SEQ ID NO | Sequence corresponding to SEQ ID | Target | Seed SEQ ID NO | Seed | Heteroclitic Modification p2 | Heteroclitic Modification C-term | Note |
|---|---|---|---|---|---|---|---|
| SEQ ID NO: 133 | IAIGHHAL | IDH1 R132H | SEQ ID NO: 7091 | IIIGHHAY | I2A | Y8L | Individual IDH1_R132H Vaccine (8-peptide, MHCflurry, Set 1); Individual IDH1_R132H Vaccine (8-peptide, MHCflurry, Set 2) |
| SEQ ID NO: 134 | IQIGHHAY | IDH1 R132H | SEQ ID NO: 7091 | IIIGHHAY | I2Q | — | Individual IDH1_R132H Vaccine (8-peptide, MHCflurry, Set 1); Individual IDH1_R132H Vaccine (8-peptide, MHCflurry, Set 2) |
| SEQ ID NO: 135 | KHIIGHHA | IDH1 R132H | SEQ ID NO: 461 | KPIIGHHA | P2H | — | Individual IDH1_R132H Vaccine (8-peptide, MHCflurry, Set 1); Individual IDH1_R132H Vaccine (8-peptide, MHCflurry, Set 2) |
| SEQ ID NO: 136 | KPIIGHHL | IDH1 R132H | SEQ ID NO: 461 | KPIIGHHA | — | A9L | Individual IDH1_R132H Vaccine (8-peptide, MHCflurry, Set 1); Individual IDH1_R132H Vaccine (5-peptide, NetMHCpan, Set 2); Individual IDH1_R132H Vaccine (8-peptide, MHCflurry, Set 2) |
| SEQ ID NO: 137 | PPIGHHAY | IDH1 R132H | SEQ ID NO: 7093 | PIIGHHAY | I2P | — | Individual IDH1_R132H Vaccine (8-peptide, MHCflurry, Set 1) |
| SEQ ID NO: 138 | HHAYGDQF | IDH1 R132H | SEQ ID NO: 7096 | HHAYGDQY | — | Y8F | Individual IDH1_R132H Vaccine (8-peptide, MHCflurry, Set 2) |
| SEQ ID NO: 139 | HTAYGDQYR | IDH1 R132H | SEQ ID NO: 7097 | HHAYGDQYR | H2T | — | Individual IDH1_R132H Vaccine (8-peptide, MHCflurry, Set 2) |
| SEQ ID NO: 140 | PAIGHHAY | IDH1 R132H | SEQ ID NO: 7093 | PIIGHHAY | I2A | — | Individual IDH1_R132H Vaccine (8-peptide, MHCflurry, Set 2) |
| SEQ ID NO: 141 | LMVVGAAGV | KRAS G12A | SEQ ID NO: 462 | LVVVGAAGV | V2M | — | Individual KRAS_G12A Vaccine (4-peptide, NetMHCpan, Set 1); Bronchus Aand Lung Cancer Vaccine (30-peptide); Individual KRAS_G12A Vaccine (8-peptide, MHCflurry, Set 1); Individual KRAS_G12A Vaccine (8-peptide, MHCflurry, Set 2) |
| SEQ ID NO: 142 | LQVVGAAGV | KRAS G12A | SEQ ID NO: 462 | LVVVGAAGV | V2Q | — | Individual KRAS_G12A Vaccine (4-peptide, NetMHCpan, Set 1); Bronchus Aand Lung Cancer Vaccine (30-peptide); Individual KRAS_G12A Vaccine (4-peptide, NetMHCpan, Set 2) |
| SEQ ID NO: 143 | LTVVGAAGV | KRAS G12A | SEQ ID NO: 462 | LVVVGAAGV | V2T | — | Individual KRAS_G12A Vaccine (4-peptide, NetMHCpan, Set 1); Bronchus Aand Lung Cancer Vaccine (30-peptide); Individual KRAS_G12A Vaccine (4-peptide, NetMHCpan, Set 2); Individual KRAS_G12A Vaccine (8-peptide, MHCflurry, Set 2) |

TABLE 1-continued

Example Vaccine Peptides (MHC class I)

| SEQ ID NO | Sequence corresponding to SEQ ID | Target | Seed SEQ ID NO | Seed | Heteroclitic Modification p2 | Heteroclitic Modification C-term | Note |
|---|---|---|---|---|---|---|---|
| SEQ ID NO: 144 | VTVGAAGVGRK | KRAS G12A | SEQ ID NO: 7875 | VVVGAAGVG | V2T | K10R | Individual KRAS_G12A Vaccine (4-peptide, NetMHCpan, Set 1); Bronchus Aand Lung Cancer Vaccine (30-peptide); Individual KRAS_G12A Vaccine (4-peptide, NetMHCpan, Set 2) |
| SEQ ID NO: 145 | GAAGVGKSL | KRAS G12A | SEQ ID NO: 7876 | GAAGVGKSA | — | A9L | Individual KRAS_G12A Vaccine (8-peptide, MHCflurry, Set 1); Individual KRAS_G12A Vaccine (8-peptide, MHCflurry, Set 2) |
| SEQ ID NO: 146 | GAAGVGKSM | KRAS G12A | SEQ ID NO: 7876 | GAAGVGKSA | — | A9M | Individual KRAS_G12A Vaccine (8-peptide, MHCflurry, Set 1); Individual KRAS_012A Vaccine (8-peptide, MHCflurry, Set 2) |
| SEQ ID NO: 147 | GPAGVGKSA | KRAS G12A | SEQ ID NO: 7876 | GAAGVGKSA | A2P | — | Individual KRAS_G12A Vaccine (8-peptide, MHCflurry, Set 1) |
| SEQ ID NO: 148 | GPAGVGKSAL | KRAS G12A | SEQ ID NO: 7877 | GAAGVGKSA | A2P | — | Individual KRAS_G12A Vaccine (8-peptide, MHCflurry, Set 1); Individual KRAS_G12A Vaccine (8-peptide, MHCflurry, Set 2) |
| SEQ ID NO: 149 | VTVGAAGVGK | KRAS G12A | SEQ ID NO: 7875 | VVVGAAGVG | V2T | — | Individual KRAS_G12A Vaccine (8-peptide, MHCflurry, Set 1) |
| SEQ ID NO: 150 | VVVGAAGVGRK | KRAS G12A | SEQ ID NO: 7875 | VVVGAAGVG | — | K10R | Individual KRAS_G12A Vaccine (8-peptide, MHCflurry, Set 1); Individual KRAS_G12A Vaccine (8-peptide, MHCflurry, Set 2) |
| SEQ ID NO: 151 | LLVVGAAGV | KRAS G12A | SEQ ID NO: 462 | LVVVGAAGV | V2L | — | Individual KRAS_G12A Vaccine (4-peptide, NetMHCpan, Set 2) |
| SEQ ID NO: 152 | GPAGVGKSV | KRAS G12A | SEQ ID NO: 7876 | GAAGVGKSA | A2P | A9V | Individual KRAS_G12A Vaccine (8-peptide, MHCflurry, Set 2) |
| SEQ ID NO: 153 | VMVGAAGVGK | KRAS G12A | SEQ ID NO: 7875 | VVVGAAGVG | V2M | — | Individual KRAS_G12A Vaccine (8-peptide, MHCflurry, Set 2) |
| SEQ ID NO: 154 | LMVVGACGV | KRAS G12C | SEQ ID NO: 8425 | LVVVGACGV | V2M | — | Individual KRAS_G12C Vaccine (5-peptide, NetMHCpan, Set 1); Bronchus Aand Lung Cancer Vaccine (30-peptide); Individual KRAS_G12C Vaccine (8-peptide, MHCflurry, Set 1); Individual KRAS_G12C Vaccine (5-peptide, NetMHCpan, Set 2); Individual KRAS_G12C Vaccine (8-peptide, MHCflurry, Set 2) |
| SEQ ID NO: 155 | LQVVGACGV | KRAS G12C | SEQ ID NO: 8425 | LVVVGACGV | V2Q | — | Individual KRAS_G12C Vaccine (5-peptide, NetMHCpan, Set 1); Bronchus Aand Lung Cancer Vaccine (30-peptide); Individual KRAS_G12C Vaccine (5-peptide, NetMHCpan, Set 2) |

TABLE 1-continued

Example Vaccine Peptides (MHC class I)

| SEQ ID NO | Sequence corresponding to SEQ ID | Target | Seed SEQ ID NO | Seed | Heteroclitic Modification p2 | Heteroclitic Modification C-term | Note |
|---|---|---|---|---|---|---|---|
| SEQ ID NO: 156 | LTVVGACGV | KRAS G12C | SEQ ID NO: 8425 | LVVGACGV | V2T | — | Individual KRAS_G12C Vaccine (5-peptide, NetMHCpan, Set 1); Bronchus Aand Lung Cancer Vaccine (30-peptide); Individual KRAS_G12C Vaccine (8-peptide, MHCflurry, Set 1); Individual KRAS_G12C Vaccine (5-peptide, NetMHC, Set 2); Individual KRAS_G12C Vaccine (8-peptide, MHCflurry, Set 2) |
| SEQ ID NO: 157 | VMGACGVGR | KRAS G12C | SEQ ID NO: 8426 | VVGACGVGK | V2M | K9R | Individual KRAS_G12C Vaccine (5-peptide, NetMHCpan, Set 1); Bronchus Aand Lung Cancer Vaccine (30-peptide); Individual KRAS_G12C Vaccine (5-peptide, NetMHCpan, Set 2) |
| SEQ ID NO: 158 | VVVGACGVGRK | KRAS G12C | SEQ ID NO: 463 | VVVGACGVGK | K10R | — | Individual KRAS_G12C Vaccine (5-peptide, NetMHCpan, Set 1); Bronchus Aand Lung Cancer Vaccine (30-peptide) |
| SEQ ID NO: 159 | VMGACGVGK | KRAS G12C | SEQ ID NO: 8427 | VVGACGVGK | V2M | — | Bronchus And Lung Cancer Vaccine (30-peptide) |
| SEQ ID NO: 160 | GACGVGKSL | KRAS G12C | SEQ ID NO: 8427 | GACGVGKSA | A9L | — | Individual KRAS_G12C Vaccine (8-peptide, MHCflurry, Set 1); Individual KRAS_G12C Vaccine (8-peptide, MHCflurry, Set 2) |
| SEQ ID NO: 161 | GPCGVGKSA | KRAS G12C | SEQ ID NO: 8428 | GACGVGKSA | A2P | — | Individual KRAS_G12C Vaccine (8-peptide, MHCflurry, Set 1); Individual KRAS_G12C Vaccine (8-peptide, MHCflurry, Set 2) |
| SEQ ID NO: 162 | GPCGVGKSAL | KRAS G12C | SEQ ID NO: 8428 | GACGVGKSA | A2P | L10M | Individual KRAS_G12C Vaccine (8-peptide, MHCflurry, Set 1) |
| SEQ ID NO: 163 | VMVGACGVGK | KRAS G12C | SEQ ID NO: 463 | VVVGACGVG | V2M | — | Individual KRAS_G12C Vaccine (8-peptide, MHCflurry, Set 1); Individual KRAS_G12C Vaccine (8-peptide, MHCflurry, Set 2) |
| SEQ ID NO: 164 | VTVGACGVGR K | KRAS G12C | SEQ ID NO: 463 | VVVGACGVG | V2T | K10R | Individual KRAS_G12C Vaccine (8-peptide, MHCflurry, Set 1); Individual KRAS_G12C Vaccine (5-peptide, NetMHCpan, Set 2); Individual KRAS_G12C Vaccine (8-peptide, MHCflurry, Set 2) |
| SEQ ID NO: 165 | GPCGVGKSAL | KRAS G12C | SEQ ID NO: 8428 | GACGVGKSA | A2P | — | Individual KRAS_G12C Vaccine (8-peptide, MHCflurry, Set 2) |
| SEQ ID NO: 166 | VTVGACGVGK | KRAS G12C | SEQ ID NO: 463 | VVVGACGVG | V2T | — | Individual KRAS_012C Vaccine (8-peptide, MHCflurry, Set 2) |
| SEQ ID NO: 167 | LLVVGADGV | KRAS G12D | SEQ ID NO: 9725 | LVVVGADGV | V2L | — | Individual KRAS_G12D Vaccine (5-peptide, NetMHCpan, Set 1); Colorectal Cancer Vaccine (20-peptide) |

TABLE 1-continued

Example Vaccine Peptides (MHC class I)

| SEQ ID NO | Sequence corresponding to SEQ ID | Target | Seed SEQ ID NO | Seed | Heteroclitic Modification p2 | Heteroclitic Modification C-term | Note |
|---|---|---|---|---|---|---|---|
| SEQ ID NO: 168 | LMVVGADGV | KRAS G12D | SEQ ID NO: 9725 | LVVVGADGV | V2M | — | Individual KRAS_G12D Vaccine (5-peptide, NetMHCpan, Set 1); Pancreatic Cancer Vaccine (10-peptide); Bronchus Aand Lung Cancer Vaccine (30-peptide); Colorectal Cancer Vaccine (20-peptide); Individual KRAS_G12D Vaccine (8-peptide, MHCflurry, Set 1); Individual KRAS_G12D Vaccine (3-peptide, NetMHCpan, Set 2); Individual KRAS_G12D Vaccine (8-peptide, MHCflurry, Set 2) |
| SEQ ID NO: 169 | LTVVGADGV | KRAS G12D | SEQ ID NO: 9725 | LVVVGADGV | V2T | — | Individual KRAS_G12D Vaccine (5-peptide, NetMHCpan, Set 1); Pancreatic Cancer Vaccine (10-peptide); Bronchus Aand Lung Cancer Vaccine (30-peptide); Colorectal Cancer Vaccine (20-peptide); Individual KRAS_G12D Vaccine (3-peptide, NetMHCpan, Set 2) |
| SEQ ID NO: 170 | VTVGADGVGRK | KRAS G12D | SEQ ID NO: 464 | VVVGADGVG | V2T | K10R | Individual KRAS_G12D Vaccine (5-peptide, NetMHCpan, Set 1); Individual KRAS_G12D Vaccine (8-peptide, MHCflurry, Set 1); Individual KRAS_G12D Vaccine (3-peptide, NetMHCpan, Set 2); Individual KRAS_G12D Vaccine (8-peptide, MHCflurry, Set 2) |
| SEQ ID NO: 171 | VVVGADGVGRK | KRAS G12D | SEQ ID NO: 464 | VVVGADGVG | K10R | — | Individual KRAS_G12D Vaccine (5-peptide, NetMHCpan, Set 1); Pancreatic Cancer Vaccine (10-peptide); Bronchus Aand Lung Cancer Vaccine (30-peptide); Colorectal Cancer Vaccine (20-peptide) |
| SEQ ID NO: 172 | GFDGVGKSL | KRAS G12D | SEQ ID NO: 9728 | GADGVGKSA | A2F | A9L | Individual KRAS_G12D Vaccine (8-peptide, MHCflurry, Set 1); Individual KRAS_G12D Vaccine (8-peptide, MHCflurry, Set 2) |
| SEQ ID NO: 173 | VAADGVGKSAF | KRAS G12D | SEQ ID NO: 9733 | VGADGVGKSAL | G2A | L11F | Individual KRAS_G12D Vaccine (8-peptide, MHCflurry, Set 1); Individual KRAS_G12D Vaccine (8-peptide, MHCflurry, Set 2) |
| SEQ ID NO: 174 | VAADGVGKSAL | KRAS G12D | SEQ ID NO: 9733 | VGADGVGKS | G2A | — | Individual KRAS_G12D Vaccine (8-peptide, MHCflurry, Set 1); Individual KRAS_G12D Vaccine (8-peptide, MHCflurry, Set 2) |
| SEQ ID NO: 175 | VRADGVGKSAF | KRAS G12D | SEQ ID NO: 9733 | VGADGVGKS | G2R | L11F | Individual KRAS_G12D Vaccine (8-peptide, MHCflurry, Set 1); Individual KRAS_G12D Vaccine (8-peptide, MHCflurry, Set 2) |

TABLE 1-continued

Example Vaccine Peptides (MHC class I)

| SEQ ID NO | Sequence corresponding to SEQ ID | Target | Seed SEQ ID NO | Seed | Heteroclitic Modification p2 | Heteroclitic Modification C-term | Note |
|---|---|---|---|---|---|---|---|
| SEQ ID NO: 176 | VTADGVGKSAF AL | KRAS G12D | SEQ ID NO: 9733 | VGADGVGKS | G2T | L11F | Individual KRAS_G12D Vaccine (8-peptide, MHCflurry, Set 1) |
| SEQ ID NO: 177 | VSADGVGKSAF AL | KRAS G12D | SEQ ID NO: 9733 | VGADGVGKS | G2S | L11F | Individual KRAS_G12D Vaccine (8-peptide, MHCflurry, Set 2) |
| SEQ ID NO: 178 | VTVGADGVGK | KRAS G12D | SEQ ID NO: 464 | VVVGADGVG | V2T | — | Individual KRAS_G12D Vaccine (8-peptide, MHCflurry, Set 2) |
| SEQ ID NO: 179 | GPRGVGKSAV L | KRAS G12R | SEQ ID NO: 10229 | GARGVGKSA | A2P | L10V | Individual KRAS_G12R Vaccine (5-peptide, NetMHCpan, Set 1); Pancreatic Cancer Vaccine (10-peptide) |
| SEQ ID NO: 180 | LLVVGARGV | KRAS G12R | SEQ ID NO: 10231 | LVVVGARGV | V2L | — | Individual KRAS_G12R Vaccine (5-peptide, NetMHCpan, Set 1); Pancreatic Cancer Vaccine (10-peptide) |
| SEQ ID NO: 181 | LMVVGARGV | KRAS G12R | SEQ ID NO: 10231 | LVVVGARGV | V2M | — | Individual KRAS_G12R Vaccine (5-peptide, NetMHCpan, Set 1); Individual KRAS_G12R Vaccine (8-peptide, MHCflurry, Set 1); Individual KRAS_G12R Vaccine (4-peptide, NetMHCpan, Set 2); Individual KRAS_G12R Vaccine (8-peptide, MHCflurry, Set 2) |
| SEQ ID NO: 182 | VMGARGVGK | KRAS G12R | SEQ ID NO: 10232 | VVGARGVGK | V2M | — | Individual KRAS_G12R Vaccine (5-peptide, NetMHCpan, Set 1); Pancreatic Cancer Vaccine (10-peptide); Individual KRAS_G12R Vaccine (4-peptide, NetMHCpan, Set 2) |
| SEQ ID NO: 183 | VVVGARGVGR K | KRAS G12R | SEQ ID NO: 465 | VVVGARGVG | K10R | — | Individual KRAS_G12R Vaccine (5-peptide, NetMHCpan, Set 1); Pancreatic Cancer Vaccine (10-peptide) |
| SEQ ID NO: 184 | GARGVGKSY | KRAS G12R | SEQ ID NO: 10233 | GARGVGKSA | A9Y | — | Individual KRAS_012R Vaccine (8-peptide, MHCflurry, Set 1) |
| SEQ ID NO: 185 | GPRGVGKSA | KRAS G12R | SEQ ID NO: 10233 | GARGVGKSA | A2P | — | Individual KRAS_G12R Vaccine (8-peptide, MHCflurry, Set 1); Individual KRAS_G12R Vaccine (8-peptide, MHCflurry, Set 2) |
| SEQ ID NO: 186 | GPRGVGKSAL | KRAS G12R | SEQ ID NO: 10229 | GARGVGKSA L | A2P | — | Individual KRAS_G12R Vaccine (8-peptide, MHCflurry, Set 1); Individual KRAS_G12R Vaccine (4-peptide, NetMHCpan, Set 2); Individual KRAS_G12R Vaccine (8-peptide, MHCflurry, Set 2) |
| SEQ ID NO: 187 | VAGARGVGM | KRAS G12R | SEQ ID NO: 10232 | VVGARGVGK | V2A | K9M | Individual KRAS_G12R Vaccine (8-peptide, MHCflurry, Set 1) |
| SEQ ID NO: 188 | VMVGARGVGK | KRAS G12R | SEQ ID NO: 465 | VVVGARGVG K | V2M | — | Individual KRAS_G12R Vaccine (8-peptide, MHCflurry, Set 1); Individual KRAS_G12R Vaccine (8-peptide, MHCflurry, Set 2) |

TABLE 1-continued

Example Vaccine Peptides (MHC class I)

| SEQ ID NO | Sequence corresponding to SEQ ID | Target | Seed SEQ ID NO | Seed | Heteroclitic Modification p2 | Heteroclitic Modification C-term | Note |
|---|---|---|---|---|---|---|---|
| SEQ ID NO: 189 | VTVGARGVGR K | KRAS G12R | SEQ ID NO: 465 | VVVGARGVG | V2T | K10R | Individual KRAS_G12R Vaccine (8-peptide, MHCflurry, Set 1); Individual KRAS_G12R Vaccine (4-peptide, NetMHCpan, Set 2); Individual KRAS_G12R Vaccine (8-peptide, MHCflurry, Set 2) |
| SEQ ID NO: 190 | VAGARGVGL | KRAS G12R | SEQ ID NO: 10232 | VVGARGVGK | V2A | K9L | Individual KRAS_G12R Vaccine (8-peptide, MHCflurry, Set 2) |
| SEQ ID NO: 191 | VTVGARGVGK K | KRAS G12R | SEQ ID NO: 465 | VVVGARGVG | V2T | — | Individual KRAS_G12R Vaccine (8-peptide, MHCflurry, Set 2) |
| SEQ ID NO: 192 | LMVVGASGV | KRAS G12S | SEQ ID NO: 11001 | LVVVGASGV | V2M | — | Individual KRAS_G12S Vaccine (5-peptide, NetMHCpan, Set 1); Individual KRAS_G12S Vaccine (8-peptide, MHCflurry, Set 1); Individual KRAS_G125 Vaccine (5-peptide, NetMHCpan, Set 2); Individual KRAS_G12S Vaccine (8-peptide, MHCflurry, Set 2) |
| SEQ ID NO: 193 | LQVVGASGV | KRAS G12S | SEQ ID NO: 11001 | LVVVGASGV | V2Q | — | Individual KRAS_G12S Vaccine (5-peptide, NetMHCpan, Set 1); Individual KRAS_G12S Vaccine (5-peptide, NetMHCpan, Set 2) |
| SEQ ID NO: 194 | LTVVGASGV | KRAS G12S | SEQ ID NO: 11001 | LVVVGASGV | V2T | — | Individual KRAS_G12S Vaccine (5-peptide, NetMHCpan, Set 1); Individual KRAS_G12S Vaccine (8-peptide, MHCflurry, Set 1); Individual KRAS_G12S Vaccine (5-peptide, NetMHCpan, Set 2) |
| SEQ ID NO: 195 | VTVGASGVGK | KRAS G12S | SEQ ID NO: 11003 | VVVGASGVG K | V2T | — | Individual KRAS_G12S Vaccine (5-peptide, NetMHCpan, Set 1); Individual KRAS_G12S Vaccine (8-peptide, MHCflurry, Set 1); Individual KRAS_G12S Vaccine (5-peptide, NetMHCpan, Set 2); Individual KRAS_G12S Vaccine (8-peptide, MHCflurry, Set 2) |
| SEQ ID NO: 196 | VVVGASGVGR | KRAS G12S | SEQ ID NO: 11003 | VVVGASGVG K | — | K10R | Individual KRAS_G12S Vaccine (8-peptide, MHCflurry, Set 1) |
| SEQ ID NO: 197 | GASGVGKSL | KRAS G12S | SEQ ID NO: 11004 | GASGVGKSA | A9L | — | Individual KRAS_G12S Vaccine (8-peptide, MHCflurry, Set 1) |
| SEQ ID NO: 198 | GPSGVGKSAM | KRAS G12S | SEQ ID NO: 11005 | GASGVGKSAL | A2P | L10M | Individual KRAS_G12S Vaccine (8-peptide, MHCflurry, Set 1) |
| SEQ ID NO: 199 | VAVGASGVGY | KRAS G12S | SEQ ID NO: 11003 | VVVGASGVG K | V2A | K10Y | Individual KRAS_G12S Vaccine (8-peptide, MHCflurry, Set 1); Individual KRAS_G12S Vaccine (8-peptide, MHCflurry, Set 2) |

TABLE 1-continued

Example Vaccine Peptides (MHC class I)

| SEQ ID NO | Sequence corresponding to SEQ ID | Target | Seed SEQ ID NO | Seed | Heteroclitic Modification p2 | Heteroclitic Modification C-term | Note |
|---|---|---|---|---|---|---|---|
| SEQ ID NO: 200 | VTVGASGVGR | KRAS G12S | SEQ ID NO: 11003 | VVVGASGVGK | V2T | K10R | Individual KRAS_G12S Vaccine (8-peptide, MHCflurry, Set 1); Individual KRAS_G12S Vaccine (5-peptide, NetMHCpan, Set 2); Individual KRAS_G12S Vaccine (8-peptide, MHCflurry, Set 2) |
| SEQ ID NO: 201 | VTVGASGVGY | KRAS G12S | SEQ ID NO: 11003 | VVVGASGVGK | V2T | K10Y | Individual KRAS_G12S Vaccine (8-peptide, MHCflurry, Set 1); Individual KRAS_G12S Vaccine (8-peptide, MHCflurry, Set 2) |
| SEQ ID NO: 202 | GPSGVGKSAL | KRAS G12S | SEQ ID NO: 11005 | GASGVGKSAL | A2P | — | Individual KRAS_G12S Vaccine (8-peptide, MHCflurry, Set 2) |
| SEQ ID NO: 203 | LMVVGAVGV | KRAS G12V | SEQ ID NO: 11736 | LVVVGAVGV | V2M | — | Individual KRAS_G12V Vaccine (5-peptide, NetMHCpan, Set 1); Pancreatic Cancer Vaccine (10-peptide); Bronchus Aand Lung Cancer Vaccine (30-peptide); Colorectal Cancer Vaccine (20-peptide); Individual KRAS_G12V Vaccine (8-peptide, MHCflurry, Set 1); Individual KRAS_G12V Vaccine (5-peptide, NetMHCpan, Set 2); Individual KRAS_G12V Vaccine (8-peptide, MHCflurry, Set 2) |
| SEQ ID NO: 204 | LTVVGAVGV | KRAS G12V | SEQ ID NO: 11736 | LVVVGAVGV | V2T | — | Individual KRAS_G12V Vaccine (5-peptide, NetMHCpan, Set 1); Pancreatic Cancer Vaccine (10-peptide); Bronchus Aand Lung Cancer Vaccine (30-peptide); Colorectal Cancer Vaccine (20-peptide); Individual KRAS_G12V Vaccine (8-peptide, MHCflurry, Set 1); Individual KRAS_G12V Vaccine (5-peptide, NetMHCpan, Set 2); Individual KRAS_G12V Vaccine (8-peptide, MHCflurry, Set 2) |
| SEQ ID NO: 205 | VMGAVGVGK | KRAS G12V | SEQ ID NO: 11737 | VVGAVGVGK | V2M | — | Individual KRAS_G12V Vaccine (5-peptide, NetMHCpan, Set 1); Colorectal Cancer Vaccine (20-peptide); Individual KRAS_G12V Vaccine (5-peptide, NetMHCpan, Set 2) |
| SEQ ID NO: 206 | VMGAVGVGR | KRAS G12V | SEQ ID NO: 11737 | VVGAVGVGK | V2M | K9R | Individual KRAS_G12V Vaccine (5-peptide, NetMHCpan, Set 1); Colorectal Cancer Vaccine (20-peptide); Individual KRAS_G12V Vaccine (5-peptide, NetMHCpan, Set 2) |

TABLE 1-continued

Example Vaccine Peptides (MHC class I)

| SEQ ID NO | Sequence corresponding to SEQ ID | Target | Seed SEQ ID NO | Seed | Heteroclitic Modification p2 | Heteroclitic Modification C-term | Note |
|---|---|---|---|---|---|---|---|
| SEQ ID NO: 207 | VTVGAVGVGK | KRAS G12V | SEQ ID NO: 11738 | VVVGAVGVG K | V2T | — | Individual KRAS_G12V Vaccine (5-peptide, NetMHCpan, Set 1); Pancreatic Cancer Vaccine (10-peptide); Bronchus Aand Lung Cancer Vaccine (30-peptide); Colorectal Cancer Vaccine (20-peptide); Individual KRAS_G12V Vaccine (8-peptide, MHCflurry, Set 1); Individual KRAS_G12V Vaccine (5-peptide, NetMHCpan, Set 2); Individual KRAS_G12V Vaccine (8-peptide, MHCflurry, Set 2) |
| SEQ ID NO: 208 | GAVGVGKSL | KRAS G12V | SEQ ID NO: 11739 | GAVGVGKSA | A9L | — | Individual KRAS_G12V Vaccine (8-peptide, MHCflurry, Set 1); Individual KRAS_G12V Vaccine (8-peptide, MHCflurry, Set 2) |
| SEQ ID NO: 209 | GPVGVGKSA | KRAS G12V | SEQ ID NO: 11739 | GAVGVGKSA | A2P | — | Individual KRAS_G12V Vaccine (8-peptide, MHCflurry, Set 1) |
| SEQ ID NO: 210 | GPVGVGKSAL | KRAS G12V | SEQ ID NO: 11740 | GAVGVGKSA L | A2P | — | Individual KRAS_G12V Vaccine (8-peptide, MHCflurry, Set 1); Individual KRAS_G12V Vaccine (8-peptide, MHCflurry, Set 2) |
| SEQ ID NO: 211 | VMGVGAVGVGR | KRAS G12V | SEQ ID NO: 11738 | VVVGAVGVG K | V2M | K10R | Individual KRAS_G12V Vaccine (8-peptide, MHCflurry, Set 1); Individual KRAS_G12V Vaccine (8-peptide, MHCflurry, Set 2) |
| SEQ ID NO: 212 | VVVGAVGVGR | KRAS G12V | SEQ ID NO: 11738 | VVVGAVGVG K | — | K10R | Individual KRAS_G12V Vaccine (8-peptide, MHCflurry, Set 1); Individual KRAS_G12V Vaccine (8-peptide, MHCflurry, Set 2) |
| SEQ ID NO: 213 | GPVGVGKSV | KRAS G12V | SEQ ID NO: 11739 | GAVGVGKSA | A2P | A9V | Individual KRAS_G12V Vaccine (8-peptide, MHCflurry, Set 2) |
| SEQ ID NO: 214 | ASDVGKSAL | KRAS G13D | SEQ ID NO: 12804 | AGDVGKSAL | G25 | — | Individual KRAS_G13D Vaccine (5-peptide, NetMHCpan, Set 1) |
| SEQ ID NO: 215 | ASDVGKSAM | KRAS G13D | SEQ ID NO: 12804 | AGDVGKSAL | G25 | L9M | Individual KRAS_G13D Vaccine (5-peptide, NetMHCpan, Set 1); Colorectal Cancer Vaccine (20-peptide) |
| SEQ ID NO: 216 | KMVVVGAGDV V | KRAS G13D | SEQ ID NO: 466 | KLVVVGAGD V | L2M | — | Individual KRAS_G13D Vaccine (5-peptide, NetMHCpan, Set 1); Colorectal Cancer Vaccine (20-peptide); Individual KRAS_G13D Vaccine (3-peptide, NetMHCpan, Set 2) |
| SEQ ID NO: 217 | VVVGAGDVGR | KRAS G13D | SEQ ID NO: 12806 | VVVGAGDVG K | — | K10R | Individual KRAS_013D Vaccine (5-peptide, NetMHCpan, Set 1); Colorectal Cancer Vaccine (20-peptide); Individual KRAS_G13D Vaccine (8-peptide, MHCflurry, Set 1); Individual KRAS_G13D Vaccine (8-peptide, MHCflurry, Set 2) |

TABLE 1-continued

Example Vaccine Peptides (MHC class I)

| SEQ ID NO | Sequence corresponding to SEQ ID | Target | Seed SEQ ID NO | Seed | Heteroclitic Modification p2 | Heteroclitic Modification C-term | Note |
|---|---|---|---|---|---|---|---|
| SEQ ID NO: 218 | AADVGKSAM | KRAS G13D | SEQ ID NO: 12804 | AGDVGKSAL | G2A | L9M | Individual KRAS_G13D Vaccine (8-peptide, MHCflurry, Set 1); Individual KRAS_G13D Vaccine (8-peptide, MHCflurry, Set 2) |
| SEQ ID NO: 219 | AYDVGKSAM | KRAS G13D | SEQ ID NO: 12804 | AGDVGKSAL | G2Y | L9M | Individual KRAS_G13D Vaccine (8-peptide, MHCflurry, Set 1) |
| SEQ ID NO: 220 | DAGKSALTV | KRAS G13D | SEQ ID NO: 12808 | DVGKSALTI | V2A | I9V | Individual KRAS_G13D Vaccine (8-peptide, MHCflurry, Set 1); Individual KRAS_G13D Vaccine (8-peptide, MHCflurry, Set 2) |
| SEQ ID NO: 221 | DVGKSALTY | KRAS G13D | SEQ ID NO: 12808 | DVGKSALTI | — | I9Y | Individual KRAS_G13D Vaccine (8-peptide, MHCflurry, Set 1) |
| SEQ ID NO: 222 | GAGDVGKSM | KRAS G13D | SEQ ID NO: 12809 | GAGDVGKSA | — | A9M | Individual KRAS_G13D Vaccine (8-peptide, MHCflurry, Set 1); Individual KRAS_G13D Vaccine (8-peptide, MHCflurry, Set 2) |
| SEQ ID NO: 223 | VTVGAGDVGK | KRAS G13D | SEQ ID NO: 12806 | VVVGAGDVGK | V2T | — | Individual KRAS_G13D Vaccine (8-peptide, MHCflurry, Set 1); Individual KRAS_G13D Vaccine (8-peptide, MHCflurry, Set 2) |
| SEQ ID NO: 224 | VVAGDVGKSAW | KRAS G13D | SEQ ID NO: 12814 | VGAGDVGKSAL | G2V | L11W | Individual KRAS_G13D Vaccine (8-peptide, MHCflurry, Set 1) |
| SEQ ID NO: 225 | AADVGKSAL | KRAS G13D | SEQ ID NO: 12804 | AGDVGKSAL | G2A | — | Individual KRAS_G13D Vaccine (3-peptide, NetMHCpan, Set 2) |
| SEQ ID NO: 226 | VTVGAGDVGR | KRAS G13D | SEQ ID NO: 12806 | VVVGAGDVGK | V2T | K10R | Individual KRAS_G13D Vaccine (3-peptide, NetMHCpan, Set 2) |
| SEQ ID NO: 227 | AYDVGKSAL | KRAS G13D | SEQ ID NO: 12804 | AGDVGKSAL | G2Y | — | Individual KRAS_G13D Vaccine (8-peptide, MHCflurry, Set 2) |
| SEQ ID NO: 228 | DVGKSALTF | KRAS G13D | SEQ ID NO: 12808 | DVGKSALTI | — | I9F | Individual KRAS_G13D Vaccine (8-peptide, MHCflurry, Set 2) |
| SEQ ID NO: 229 | VSAGDVGKSAF | KRAS G13D | SEQ ID NO: 12814 | VGAGDVGKSAL | G25 | L11F | Individual KRAS_G13D Vaccine (8-peptide, MHCflurry, Set 2) |
| SEQ ID NO: 230 | ATKEEYSAMR | NRAS Q61K | SEQ ID NO: 13426 | AGKEEYSAMR | G2T | — | Individual NRAS_Q61K Vaccine (2-peptide, NetMHCpan, Set 1); Skin Cancer Vaccine (20-peptide); Thyroid Cancer Vaccine (10-peptide); Individual NRAS_Q61K Vaccine (2-peptide, NetMHCpan, Set 2) |
| SEQ ID NO: 231 | ITDTAGKEEY | NRAS Q61K | SEQ ID NO: 13427 | ILDTAGKEEY | L2T | — | Individual NRAS_Q61K Vaccine (2-peptide, NetMHCpan, Set 1); Skin Cancer Vaccine (20-peptide); Thyroid Cancer Vaccine (10-peptide); Individual NRAS_Q61K Vaccine (8-peptide, MHCflurry, Set 1); Individual NRAS_Q61K Vaccine (2-peptide, NetMHCpan, Set 2); Individual NRAS_Q61K Vaccine (8-peptide, MHCflurry, Set 2) |

TABLE 1-continued

Example Vaccine Peptides (MHC class I)

| SEQ ID NO | Sequence corresponding to SEQ ID | Target | Seed SEQ ID NO | Seed | Heteroclitic Modification p2 | Heteroclitic Modification C-term | Note |
|---|---|---|---|---|---|---|---|
| SEQ ID NO: 232 | AAKEEYSAL | NRAS_Q61K | SEQ ID NO: 13428 | AGKEEYSAM | G2A | M9L | Individual NRAS_Q61K Vaccine (8-peptide, MHCflurry, Set 1); Individual NRAS_Q61K Vaccine (8-peptide, MHCflurry, Set 2) |
| SEQ ID NO: 233 | AAKEEYSAY | NRAS_Q61K | SEQ ID NO: 13428 | AGKEEYSAM | G2A | M9Y | Individual NRAS_Q61K Vaccine (8-peptide, MHCflurry, Set 1); Individual NRAS_Q61K Vaccine (8-peptide, MHCflurry, Set 2) |
| SEQ ID NO: 234 | ARKEEYSAY | NRAS_Q61K | SEQ ID NO: 13428 | AGKEEYSAM | G2R | M9Y | Individual NRAS_Q61K Vaccine (8-peptide, MHCflurry, Set 1); Individual NRAS_Q61K Vaccine (8-peptide, MHCflurry, Set 2) |
| SEQ ID NO: 235 | ILDTAGKEEL | NRAS_Q61K | SEQ ID NO: 13427 | ILDTAGKEEY | — | Y10L | Individual NRAS_Q61K Vaccine (8-peptide, MHCflurry, Set 1); Individual NRAS_Q61K Vaccine (8-peptide, MHCflurry, Set 2) |
| SEQ ID NO: 236 | IMDTAGKEEL | NRAS_Q61K | SEQ ID NO: 13427 | ILDTAGKEEY | L2M | Y10L | Individual NRAS_Q61K Vaccine (8-peptide, MHCflurry, Set 1); Individual NRAS_Q61K Vaccine (8-peptide, MHCflurry, Set 2) |
| SEQ ID NO: 237 | LETAGKEEM | NRAS_Q61K | SEQ ID NO: 13432 | LDTAGKEEY | D2E | Y9M | Individual NRAS_Q61K Vaccine (8-peptide, MHCflurry, Set 1); Individual NRAS_Q61K Vaccine (8-peptide, MHCflurry, Set 2) |
| SEQ ID NO: 238 | LETAGKEEW | NRAS_Q61K | SEQ ID NO: 13432 | LDTAGKEEY | D2E | Y9W | Individual NRAS_Q61K Vaccine (8-peptide, MHCflurry, Set 1); Individual NRAS_Q61K Vaccine (8-peptide, MHCflurry, Set 2) |
| SEQ ID NO: 239 | ATLEEYSAF | NRAS_Q61L | SEQ ID NO: 14306 | AGLEEYSAM | G2T | M9F | Individual NRAS_Q61L Vaccine (5-peptide, NetMHCpan, Set 1); Skin Cancer Vaccine (20-peptide) |
| SEQ ID NO: 240 | DTAGLEEYSV | NRAS_Q61L | SEQ ID NO: 14308 | DTAGLEEYSA | A10V | — | Individual NRAS_Q61L Vaccine (5-peptide, NetMHCpan, Set 1); Individual NRAS_Q61L Vaccine (8-peptide, MHCflurry, Set 1); Individual NRAS_Q61L Vaccine (3-peptide, NetMHCpan, Set 2); Individual NRAS_Q61L Vaccine (8-peptide, MHCflurry, Set 2) |
| SEQ ID NO: 241 | DVAGLEEYSV | NRAS_Q61L | SEQ ID NO: 14308 | DTAGLEEYSA | T2V | A10V | Individual NRAS_Q61L Vaccine (5-peptide, NetMHCpan, Set 1); Skin Cancer Vaccine (20-peptide) |
| SEQ ID NO: 242 | ISDTAGLEEY | NRAS_Q61L | SEQ ID NO: 14310 | ILDTAGLEEY | — | L2S | Individual NRAS_Q61L Vaccine (5-peptide, NetMHCpan, Set 1); Skin Cancer Vaccine (20-peptide) |

TABLE 1-continued

Example Vaccine Peptides (MHC class I)

| SEQ ID NO | Sequence corresponding to SEQ ID | Target | Seed SEQ ID NO | Seed | Heteroclitic Modification p2 | Heteroclitic Modification C-term | Note |
|---|---|---|---|---|---|---|---|
| SEQ ID NO: 243 | ITDTAGLEEY | NRAS Q61L | SEQ ID NO: 14310 | ILDTAGLEEY | L2T | — | Individual NRAS_Q61L Vaccine (5-peptide, NetMHCpan, Set 1); Individual NRAS_Q61L Vaccine (3-peptide, NetMHCpan, Set 2) |
| SEQ ID NO: 244 | AALEEYSAL | NRAS Q61L | SEQ ID NO: 14306 | AGLEEYSAM | G2A | M9L | Individual NRAS_Q61L Vaccine (8-peptide, MHCflurry, Set 1); Individual NRAS_Q61L Vaccine (8-peptide, MHCflurry, Set 2) |
| SEQ ID NO: 245 | DVLDTAGLEER | NRAS Q61L | SEQ ID NO: 14311 | DILDTAGLEEY | I2V | Y11R | Individual NRAS_Q61L Vaccine (8-peptide, MHCflurry, Set 1) |
| SEQ ID NO: 246 | DVLDTAGLEEY | NRAS Q61L | SEQ ID NO: 14311 | DILDTAGLEEY | I2V | — | Individual NRAS_Q61L Vaccine (8-peptide, MHCflurry, Set 1) |
| SEQ ID NO: 247 | IMDTAGLEEM | NRAS Q61L | SEQ ID NO: 14310 | ILDTAGLEEY | L2M | Y10M | Individual NRAS_Q61L Vaccine (8-peptide, MHCflurry, Set 1); Individual NRAS_Q61L Vaccine (8-peptide, MHCflurry, Set 2) |
| SEQ ID NO: 248 | IVDTAGLEEY | NRAS Q61L | SEQ ID NO: 14310 | ILDTAGLEEY | L2V | — | Individual NRAS_Q61L Vaccine (8-peptide, MHCflurry, Set 1) |
| SEQ ID NO: 249 | LETAGLEEM | NRAS Q61L | SEQ ID NO: 14313 | LDTAGLEEY | D2E | Y9M | Individual NRAS_Q61L Vaccine (8-peptide, MHCflurry, Set 1) |
| SEQ ID NO: 250 | LMTAGLEEY | NRAS Q61L | SEQ ID NO: 14313 | LDTAGLEEY | D2M | — | Individual NRAS_Q61L Vaccine (8-peptide, MHCflurry, Set 1); Individual NRAS_Q61L Vaccine (8-peptide, MHCflurry, Set 2) |
| SEQ ID NO: 251 | AQLEEYSAF | NRAS Q61L | SEQ ID NO: 14306 | AGLEEYSAM | G2Q | M9F | Individual NRAS_Q61L Vaccine (3-peptide, NetMHCpan, Set 2) |
| SEQ ID NO: 252 | DTLDTAGLEEY | NRAS Q61L | SEQ ID NO: 14311 | DILDTAGLEEY | I2T | — | Individual NRAS_Q61L Vaccine (8-peptide, MHCflurry, Set 2) |
| SEQ ID NO: 253 | DVLDTAGLEEK | NRAS Q61L | SEQ ID NO: 14311 | DILDTAGLEEY | I2V | Y11K | Individual NRAS_Q61L Vaccine (8-peptide, MHCflurry, Set 2) |
| SEQ ID NO: 254 | IMDTAGLEEY | NRAS Q61L | SEQ ID NO: 14310 | ILDTAGLEEY | L2M | — | Individual NRAS_Q61L Vaccine (8-peptide, MHCflurry, Set 2) |
| SEQ ID NO: 255 | LETAGLEEF | NRAS Q61L | SEQ ID NO: 14313 | LDTAGLEEY | D2E | Y9F | Individual NRAS_Q61L Vaccine (8-peptide, MHCflurry, Set 2) |
| SEQ ID NO: 256 | ASREEYSAF | NRAS Q61R | SEQ ID NO: 14831 | AGREEYSAM | G25 | M9F | Individual NRAS_Q61R Vaccine (5-peptide, NetMHCpan, Set 1) |
| SEQ ID NO: 257 | ATREEYSAMR | NRAS Q61R | SEQ ID NO: 14832 | AGREEYSAMR | G2T | — | Individual NRAS_Q61R Vaccine (5-peptide, NetMHCpan, Set 1) |
| SEQ ID NO: 258 | AVREEYSAF | NRAS Q61R | SEQ ID NO: 14831 | AGREEYSAM | G2V | M9F | Individual NRAS_Q61R Vaccine (5-peptide, NetMHCpan, Set 1) |
| SEQ ID NO: 259 | ISDTAGREEY | NRAS Q61R | SEQ ID NO: 14833 | ILDTAGREEY | L25 | — | Individual NRAS_Q61R Vaccine (5-peptide, NetMHCpan, Set 1); Skin Cancer Vaccine (20-peptide); Thyroid Cancer Vaccine (10-peptide); Individual NRAS_Q61R Vaccine (8-peptide, |
| SEQ ID NO: 260 | ITDTAGREEY | NRAS Q61R | SEQ ID NO: 14833 | ILDTAGREEY | L2T | — | Individual NRAS_Q61R Vaccine (8-peptide, |

TABLE 1-continued

Example Vaccine Peptides (MHC class I)

| SEQ ID NO | Sequence corresponding to SEQ ID | Target | Seed SEQ ID NO | Seed | Heteroclitic Modification p2 | Heteroclitic Modification C-term | Note |
|---|---|---|---|---|---|---|---|
| SEQ ID NO: 261 | AVREEYSAY | NRAS Q61R | SEQ ID NO: 14831 | AGREEYSAM | G2V | M9Y | MHCflurry, Set 1); Individual NRAS_Q61R Vaccine (3-peptide, NetMHCpan, Set 2); Individual NRAS_Q61R Vaccine (8-peptide, MHCflurry, Set 2) |
| SEQ ID NO: 262 | AYREEYSAMR | NRAS Q61R | SEQ ID NO: 14832 | AGREEYSAMR | G2Y | | Skin Cancer Vaccine (20-peptide); Thyroid Cancer Vaccine (10-peptide); Skin Cancer Vaccine (20-peptide); Thyroid Cancer Vaccine (10-peptide) |
| SEQ ID NO: 263 | AAREEYSAL | NRAS Q61R | SEQ ID NO: 14831 | AGREEYSAM | G2A | M9L | Individual NRAS_Q61R Vaccine (8-peptide, MHCflurry, Set 1); Individual NRAS_Q61R Vaccine (8-peptide, MHCflurry, Set 2) |
| SEQ ID NO: 264 | AAREEYSAY | NRAS Q61R | SEQ ID NO: 14831 | AGREEYSAM | G2A | M9Y | Individual NRAS_Q61R Vaccine (8-peptide, MHCflurry, Set 1); Individual NRAS_Q61R Vaccine (8-peptide, MHCflurry, Set 2) |
| SEQ ID NO: 265 | ARREEYSAL | NRAS Q61R | SEQ ID NO: 14831 | AGREEYSAM | G2R | M9L | Individual NRAS_Q61R Vaccine (8-peptide, MHCflurry, Set 1) |
| SEQ ID NO: 266 | DVLDTAGREEW | NRAS Q61R | SEQ ID NO: 14834 | DILDTAGREEY | I2V | Y11W | Individual NRAS_Q61R Vaccine (8-peptide, MHCflurry, Set 1); Individual NRAS_Q61R Vaccine (8-peptide, MHCflurry, Set 2) |
| SEQ ID NO: 267 | IMDTAGREEL | NRAS Q61R | SEQ ID NO: 14833 | ILDTAGREEY | L2M | Y10L | Individual NRAS_Q61R Vaccine (8-peptide, MHCflurry, Set 1); Individual NRAS_Q61R Vaccine (8-peptide, MHCflurry, Set 2) |
| SEQ ID NO: 268 | LETAGREEM | NRAS Q61R | SEQ ID NO: 14835 | LDTAGREEY | D2E | Y9M | Individual NRAS_Q61R Vaccine (8-peptide, MHCflurry, Set 1); Individual NRAS_Q61R Vaccine (8-peptide, MHCflurry, Set 2) |
| SEQ ID NO: 269 | REEYSAMRDQW | NRAS Q61R | SEQ ID NO: 14836 | REEYSAMRDQ | QY | Y11W | Individual NRAS_Q61R Vaccine (8-peptide, MHCflurry, Set 1); Individual NRAS_Q61R Vaccine (8-peptide, MHCflurry, Set 2) |
| SEQ ID NO: 270 | AMREEYSAMR | NRAS Q61R | SEQ ID NO: 14832 | AGREEYSAMR | G2M | — | Individual NRAS_Q61R Vaccine (3-peptide, NetMHCpan, Set 2) |
| SEQ ID NO: 271 | AQREEYSAF | NRAS Q61R | SEQ ID NO: 14831 | AGREEYSAM | G2Q | M9F | Individual NRAS_Q61R Vaccine (3-peptide, NetMHCpan, Set 2) |
| SEQ ID NO: 272 | ARREEYSAF | NRAS Q61R | SEQ ID NO: 14831 | AGREEYSAM | G2R | M9F | Individual NRAS_Q61R Vaccine (8-peptide, MHCflurry, Set 2) |
| SEQ ID NO: 273 | KSTEQEKDFLW | PIK3CA E542K | SEQ ID NO: 15616 | KITEQEKDFLW | I2S | — | Individual PIK3CA_E542K Vaccine (5-peptide, NetMHCpan, Set 1); Individual PIK3CA_E542K Vaccine (3-peptide, NetMHCpan, Set 2) |
| SEQ ID NO: 274 | KTTEQEKDFLW | PIK3CA E542K | SEQ ID NO: 15616 | KITEQEKDFLW | I2T | — | Individual PIK3CA_E542K Vaccine (5-peptide, NetMHCpan, Set 1); Bronchus Aand Lung Cancer Vaccine (30-peptide); |

TABLE 1-continued

Example Vaccine Peptides (MHC class I)

| SEQ ID NO | Sequence corresponding to SEQ ID | Target | Seed SEQ ID NO | Seed | Heteroclitic Modification p2 | Heteroclitic Modification C-term | Note |
|---|---|---|---|---|---|---|---|
| SEQ ID NO: 275 | SARDPLSKF | PIK3CA E542K | SEQ ID NO: 15618 | STRDPLSKI | T2A | I9F | Individual PIK3CA_E542K Vaccine (8-peptide, MHCflurry, Set 1); Individual PIK3CA_E542K Vaccine (8-peptide, MHCflurry, Set 2) |
| SEQ ID NO: 276 | STRDPLSKV | PIK3CA E542K | SEQ ID NO: 15618 | STRDPLSKI | — | I9V | Individual PIK3CA_E542K Vaccine (5-peptide, NetMHCpan, Set 1); Bronchus Aand Lung Cancer Vaccine (30-peptide); Individual PIK3CA_E542K Vaccine (3-peptide, NetMHCpan, Set 2) |
| SEQ ID NO: 277 | SVRDPLSKK | PIK3CA E542K | SEQ ID NO: 15618 | STRDPLSKI | T2V | I9K | Individual PIK3CA_E542K Vaccine (5-peptide, NetMHCpan, Set 1); Bronchus Aand Lung Cancer Vaccine (30-peptide) |
| SEQ ID NO: 278 | SARDPLSKL | PIK3CA E542K | SEQ ID NO: 15618 | STRDPLSKI | T2A | I9L | Individual PIK3CA_E542K Vaccine (5-peptide, NetMHCpan, Set 1) |
| SEQ ID NO: 279 | SSRDPLSKL | PIK3CA E542K | SEQ ID NO: 15618 | STRDPLSKI | T2S | I9L | Individual PIK3CA_E542K Vaccine (8-peptide, MHCflurry, Set 1); Individual PIK3CA_E542K Vaccine (8-peptide, MHCflurry, Set 2) |
| SEQ ID NO: 280 | SSRDPLSKY | PIK3CA E542K | SEQ ID NO: 15618 | STRDPLSKI | T2S | I9Y | Individual PIK3CA_E542K Vaccine (8-peptide, MHCflurry, Set 1); Individual PIK3CA_E542K Vaccine (8-peptide, MHCflurry, Set 2) |
| SEQ ID NO: 281 | STRDPLSKR | PIK3CA E542K | SEQ ID NO: 15618 | STRDPLSKI | — | I9R | Individual PIK3CA_E542K Vaccine (8-peptide, MHCflurry, Set 1); Individual PIK3CA_E542K Vaccine (8-peptide, MHCflurry, Set 2) |
| SEQ ID NO: 282 | STRDPLSKW | PIK3CA E542K | SEQ ID NO: 15618 | STRDPLSKI | — | I9W | Individual PIK3CA_E542K Vaccine (8-peptide, MHCflurry, Set 1); Individual PIK3CA_E542K Vaccine (8-peptide, MHCflurry, Set 2) |
| SEQ ID NO: 283 | SVRDPLSKV | PIK3CA E542K | SEQ ID NO: 15618 | STRDPLSKI | T2V | I9V | Individual PIK3CA_E542K Vaccine (8-peptide, MHCflurry, Set 1); Individual PIK3CA_E542K Vaccine (8-peptide, MHCflurry, Set 2) |
| SEQ ID NO: 284 | TYDPLSKL | PIK3CA E542K | SEQ ID NO: 15624 | TRDPLSKI | R2Y | I8L | Individual PIK3CA_E542K Vaccine (8-peptide, MHCflurry, Set 1); Individual PIK3CA_E542K Vaccine (8-peptide, MHCflurry, Set 2) |
| SEQ ID NO: 285 | STRDPLSKIK | PIK3CA E542K | SEQ ID NO: 15619 | STRDPLSKIT | — | T10K | Individual PIK3CA_E542K Vaccine (3-peptide, NetMHCpan, Set 2) |

TABLE 1-continued

Example Vaccine Peptides (MHC class I)

| SEQ ID NO | Sequence corresponding to SEQ ID | Target | Seed SEQ ID NO | Seed | Heteroclitic Modification p2 | Heteroclitic Modification C-term | Note |
|---|---|---|---|---|---|---|---|
| SEQ ID NO: 286 | IAKQEKDFLW | PIK3CA E545K | SEQ ID NO: 467 | ITKQEKDFLW | T2A | — | Individual PIK3CA_E545K Vaccine (4-peptide, NetMHCpan, Set 1); Individual PIK3CA_E545K Vaccine (8-peptide, MHCflurry, Set 1); Individual PIK3CA_E545K Vaccine (3-peptide, NetMHCpan, Set 2) |
| SEQ ID NO: 287 | ISKQEKDFLW | PIK3CA E545K | SEQ ID NO: 467 | ITKQEKDFLW | T2S | — | Individual PIK3CA_E545K Vaccine (4-peptide, NetMHCpan, Set 1); Individual PIK3CA_E545K Vaccine (8-peptide, MHCflurry, Set 1); Individual PIK3CA_E545K Vaccine (3-peptide, NetMHCpan, Set 2) |
| SEQ ID NO: 288 | SEITKQEKDW | PIK3CA E545K | SEQ ID NO: 15902 | SEITKQEKDF | — | F10W | Individual PIK3CA_E545K Vaccine (4-peptide, NetMHCpan, Set 1); Bronchus Aand Lung Cancer Vaccine (30-peptide); Colorectal Cancer Vaccine (20-peptide); Individual PIK3CA_E545K Vaccine (8-peptide, MHCflurry, Set 1); Individual PIK3CA_E545K Vaccine (3-peptide, NetMHCpan, Set 2) |
| SEQ ID NO: 289 | LSEITKQEY | PIK3CA E545K | SEQ ID NO: 15904 | LSEITKQEK | — | K9Y | Individual PIK3CA_E545K Vaccine (8-peptide, MHCflurry, Set 1) |
| SEQ ID NO: 290 | LTEITKQEY | PIK3CA E545K | SEQ ID NO: 15904 | LSEITKQEK | S2T | K9Y | Individual PIK3CA_E545K Vaccine (8-peptide, MHCflurry, Set 1); Individual PIK3CA_E545K Vaccine (4-peptide, MHCflurry, Set 2) |
| SEQ ID NO: 291 | SEITKQEKDFW | PIK3CA E545K | SEQ ID NO: 15906 | SEITKQEKDFL | — | L11W | Individual PIK3CA_E545K Vaccine (8-peptide, MHCflurry, Set 1); Individual PIK3CA_E545K Vaccine (4-peptide, MHCflurry, Set 2) |
| SEQ ID NO: 292 | SEITKQEKV | PIK3CA E545K | SEQ ID NO: 15905 | SEITKQEKD | — | D9V | Individual PIK3CA_E545K Vaccine (8-peptide, MHCflurry, Set 1) |
| SEQ ID NO: 293 | SEITKQEKA | PIK3CA E545K | SEQ ID NO: 15905 | SEITKQEKD | — | D9A | Individual PIK3CA_E545K Vaccine (4-peptide, MHCflurry, Set 2) |
| SEQ ID NO: 294 | DTRHGGWTTR | PIK3CA H1047R | SEQ ID NO: 16271 | DARHGGWTTK | A2T | K10R | Individual PIK3CA_H1047R Vaccine (5-peptide, NetMHCpan, Set 1); Individual PIK3CA_H1047R Vaccine (2-peptide, NetMHCpan, Set 2); Individual PIK3CA_H1047R Vaccine (8-peptide, MHCflurry, Set 2) |
| SEQ ID NO: 295 | KRMNDARHF | PIK3CA H1047R | SEQ ID NO: 16272 | KQMNDARHG | Q2R | G9F | Individual PIK3CA_H1047R Vaccine (5-peptide, NetMHCpan, Set 1) |
| SEQ ID NO: 296 | KVMNDARHY | PIK3CA H1047R | SEQ ID NO: 16272 | KQMNDARHG | Q2V | G9Y | Individual PIK3CA_H1047R Vaccine (5-peptide, NetMHCpan, Set 1) |
| SEQ ID NO: 297 | RMGGWTTKY | PIK3CA H1047R | SEQ ID NO: 16273 | RHGGWTTKM | H2M | M9Y | Individual PIK3CA_H1047R Vaccine (5-peptide, NetMHCpan, Set 1) |

TABLE 1-continued

Example Vaccine Peptides (MHC class I)

| SEQ ID NO | Sequence corresponding to SEQ ID | Target | Seed SEQ ID NO | Seed | Heteroclitic Modification p2 | Heteroclitic Modification C-term | Note |
|---|---|---|---|---|---|---|---|
| SEQ ID NO: 298 | RQGGWTTKM | PIK3CA H1047R | SEQ ID NO: 16273 | RHGGWTTKM | H2Q | — | Individual PIK3CA_H1047R Vaccine (5-peptide, NetMHCpan, Set 1) |
| SEQ ID NO: 299 | DVRHGGWTTK | PIK3CA H1047R | SEQ ID NO: 16271 | DARHGGWTTK | A2V | — | Individual PIK3CA_H1047R Vaccine (8-peptide, MHCflurry, Set 1) |
| SEQ ID NO: 300 | DVRHGGWTTR | PIK3CA H1047R | SEQ ID NO: 16271 | DARHGGWTTK | A2V | K10R | Individual PIK3CA_H1047R Vaccine (8-peptide, MHCflurry, Set 1) |
| SEQ ID NO: 301 | KEMNDARHGGW | PIK3CA H1047R | SEQ ID NO: 16274 | KQMNDARHGGW | Q2E | — | Individual PIK3CA_H1047R Vaccine (8-peptide, MHCflurry, Set 1); Individual PIK3CA_H1047R Vaccine (8-peptide, MHCflurry, Set 2) |
| SEQ ID NO: 302 | KQMNDARHGF | PIK3CA H1047R | SEQ ID NO: 16274 | KQMNDARHGGW | — | W11F | Individual PIK3CA_H1047R Vaccine (8-peptide, MHCflurry, Set 1); Individual PIK3CA_H1047R Vaccine (8-peptide, MHCflurry, Set 2) |
| SEQ ID NO: 303 | KQMNDARHGY | PIK3CA H1047R | SEQ ID NO: 16274 | KQMNDARHGGW | — | W11Y | Individual PIK3CA_H1047R Vaccine (8-peptide, MHCflurry, Set 1); Individual PIK3CA_H1047R Vaccine (8-peptide, MHCflurry, Set 2) |
| SEQ ID NO: 304 | KTMNDARHGGW | PIK3CA H1047R | SEQ ID NO: 16274 | KQMNDARHGGW | Q2T | — | Individual PIK3CA_H1047R Vaccine (8-peptide, MHCflurry, Set 1); Individual PIK3CA_H1047R Vaccine (8-peptide, MHCflurry, Set 2) |
| SEQ ID NO: 305 | RRGGWTTKF | PIK3CA H1047R | SEQ ID NO: 16273 | RHGGWTTKM | H2R | M9F | Individual PIK3CA_H1047R Vaccine (8-peptide, MHCflurry, Set 1); Individual PIK3CA_H1047R Vaccine (8-peptide, MHCflurry, Set 2) |
| SEQ ID NO: 306 | RRGGWTTKY | PIK3CA H1047R | SEQ ID NO: 16273 | RHGGWTTKM | H2R | M9Y | Individual PIK3CA_H1047R Vaccine (8-peptide, MHCflurry, Set 1) |
| SEQ ID NO: 307 | KQMNDARHF | PIK3CA H1047R | SEQ ID NO: 16272 | KQMNDARHG | — | G9F | Individual PIK3CA_H1047R Vaccine (2-peptide, NetMHCpan, Set 2) |
| SEQ ID NO: 308 | KAMNDARHGGW | PIK3CA H1047R | SEQ ID NO: 16274 | KQMNDARHGGW | Q2A | — | Individual PIK3CA_H1047R Vaccine (8-peptide, MHCflurry, Set 2) |
| SEQ ID NO: 309 | RRGGWTTKL | PIK3CA H1047R | SEQ ID NO: 16273 | RHGGWTTKM | H2R | M9L | Individual PIK3CA_H1047R Vaccine (8-peptide, MHCflurry, Set 2) |
| SEQ ID NO: 310 | EMRQLCDLR | PIK3CA R88Q | SEQ ID NO: 468 | ETRQLCDLR | T2M | — | Individual PIK3CA_R88Q Vaccine (5-peptide, NetMHCpan, Set 1); Individual PIK3CA_R88Q Vaccine (5-peptide, NetMHCpan, Set 2) |
| SEQ ID NO: 311 | EVRQLCDLR | PIK3CA R88Q | SEQ ID NO: 468 | ETRQLCDLR | T2V | — | Individual PIK3CA_R88Q Vaccine (8-peptide, MHCflurry, Set 1); Individual PIK3CA_R88Q Vaccine (8-peptide, MHCflurry, Set 2) |
| SEQ ID NO: 312 | FYDETRQL | PIK3CA R88Q | SEQ ID NO: 17332 | FFDETRQL | F2Y | — | Individual PIK3CA_R88Q Vaccine (5-peptide, NetMHCpan, Set 1) |

TABLE 1-continued

Example Vaccine Peptides (MHC class I)

| SEQ ID NO | Sequence corresponding to SEQ ID | Target | Seed SEQ ID NO | Seed | Heteroclitic Modification p2 | Heteroclitic Modification C-term | Note |
|---|---|---|---|---|---|---|---|
| SEQ ID NO: 313 | FYDETRQM | PIK3CA R88Q | SEQ ID NO: 17332 | FFDETRQL | F2Y | L8M | Individual PIK3CA_R88Q Vaccine (5-peptide, NetMHCpan, Set 1) |
| SEQ ID NO: 314 | EAFDETRQY | PIK3CA R88Q | SEQ ID NO: 17331 | EFFDETRQL | F2A | L9Y | Individual PIK3CA_R88Q Vaccine (8-peptide, MHCflurry, Set 1); Individual PIK3CA_R88Q Vaccine (8-peptide, MHCflurry, Set 2) |
| SEQ ID NO: 315 | EIRQLCDLR | PIK3CA R88Q | SEQ ID NO: 468 | ETRQLCDLR | T2I | — | Individual PIK3CA_R88Q Vaccine (8-peptide, MHCflurry, Set 1); Individual PIK3CA_R88Q Vaccine (8-peptide, MHCflurry, Set 2) |
| SEQ ID NO: 316 | FADETRQL | PIK3CA R88Q | SEQ ID NO: 17332 | FFDETRQL | F2A | — | Individual PIK3CA_R88Q Vaccine (8-peptide, MHCflurry, Set 1); Individual PIK3CA_R88Q Vaccine (8-peptide, MHCflurry, Set 2) |
| SEQ ID NO: 317 | FFDETRQLL | PIK3CA R88Q | SEQ ID NO: 17341 | FFDETRQLC | — | C9L | Individual PIK3CA_R88Q Vaccine (8-peptide, MHCflurry, Set 1); Individual PIK3CA_R88Q Vaccine (8-peptide, MHCflurry, Set 2) |
| SEQ ID NO: 318 | FFDETRQLM | PIK3CA R88Q | SEQ ID NO: 17341 | FFDETRQLC | — | C9M | Individual PIK3CA_R88Q Vaccine (8-peptide, MHCflurry, Set 1); Individual PIK3CA_R88Q Vaccine (8-peptide, MHCflurry, Set 2) |
| SEQ ID NO: 319 | FYDETRQLM | PIK3CA R88Q | SEQ ID NO: 17341 | FFDETRQLC | F2Y | C9M | Individual PIK3CA_R88Q Vaccine (8-peptide, MHCflurry, Set 1); Individual PIK3CA_R88Q Vaccine (8-peptide, MHCflurry, Set 2) |
| SEQ ID NO: 320 | DFTRQLCDLR | PIK3CA R88Q | SEQ ID NO: 17330 | DETRQLCDLR | E2F | — | Individual PIK3CA_R88Q Vaccine (5-peptide, NetMHCpan, Set 2) |
| SEQ ID NO: 321 | EYFDETRQM | PIK3CA R88Q | SEQ ID NO: 17331 | EFFDETRQL | F2Y | L9M | Individual PIK3CA_R88Q Vaccine (8-peptide, MHCflurry, Set 1); Individual PIK3CA_R88Q Vaccine (8-peptide, MHCflurry, Set 2) |
| SEQ ID NO: 322 | ESRQLCDLR | PIK3CA R88Q | SEQ ID NO: 468 | ETRQLCDLR | T2S | — | Individual PIK3CA_R88Q Vaccine (8-peptide, MHCflurry, Set 2) |
| SEQ ID NO: 323 | GLGVMICAYV | PTEN R130G | SEQ ID NO: 17863 | GTGVMICAYL | T2L | L10V | Individual PTEN_R130G Vaccine (5-peptide, NetMHCpan, Set 1) |
| SEQ ID NO: 324 | GMGVMICAYL | PTEN R130G | SEQ ID NO: 17863 | GTGVMICAYL | T2M | — | Individual PTEN_R130G Vaccine (5-peptide, NetMHCpan, Set 1) |
| SEQ ID NO: 325 | GMGVMICAYV | PTEN R130G | SEQ ID NO: 17863 | GTGVMICAYL | T2M | L10V | Individual PTEN_R130G Vaccine (5-peptide, NetMHCpan, Set 1); Individual PTEN_R130G Vaccine (2-peptide, NetMHCpan, Set 2) |
| SEQ ID NO: 326 | GQGVMICAF | PTEN R130G | SEQ ID NO: 17862 | GTGVMICAY | T2Q | Y9F | Individual PTEN_R130G Vaccine (5-peptide, NetMHCpan, Set 1) |
| SEQ ID NO: 327 | GQGVMICAY | PTEN R130G | SEQ ID NO: 17862 | GTGVMICAY | T2Q | — | Individual PTEN_R130G Vaccine (5-peptide, NetMHCpan, Set 1); Individual PTEN_R130G Vaccine (2-peptide, |

TABLE 1-continued

Example Vaccine Peptides (MHC class I)

| SEQ ID NO | Sequence corresponding to SEQ ID | Target | Seed SEQ ID NO | Seed | Heteroclitic Modification p2 | Heteroclitic Modification C-term | Note |
|---|---|---|---|---|---|---|---|
| SEQ ID NO: 328 | AAKGGTGVL | PTEN R130G | SEQ ID NO: 17864 | AGKGGTGVM | G2A | M9L | NetMHCpan, Set 2); Individual PTEN_R130G Vaccine (7-peptide, MHCflurry, Set 2) |
| SEQ ID NO: 329 | AAKGGTGVY | PTEN R130G | SEQ ID NO: 17864 | AGKGGTGVM | G2A | M9Y | Individual PTEN_R130G Vaccine (8-peptide, MHCflurry, Set 1); Individual PTEN_R130G Vaccine (7-peptide, MHCflurry, Set 2) |
| SEQ ID NO: 330 | APKGGTGVM | PTEN R1300 | SEQ ID NO: 17864 | AGKGGTGVM | G2P | — | Individual PTEN_R130G Vaccine (8-peptide, MHCflurry, Set 1) |
| SEQ ID NO: 331 | AYKGGTGVF | PTEN R130G | SEQ ID NO: 17864 | AGKGGTGVM | G2Y | M9F | Individual PTEN_R130G Vaccine (8-peptide, MHCflurry, Set 1); Individual PTEN_R130G Vaccine (7-peptide, MHCflurry, Set 2) |
| SEQ ID NO: 332 | KMGKGGTGV | PTEN R130G | SEQ ID NO: 17865 | KAGKGGTGV | A2M | — | Individual PTEN_R130G Vaccine (8-peptide, MHCflurry, Set 1) |
| SEQ ID NO: 333 | KSGKGGTGVM W | PTEN R130G | SEQ ID NO: 17867 | KAGKGGTGV MI | A25 | I11W | Individual PTEN_R130G Vaccine (8-peptide, MHCflurry, Set 1) |
| SEQ ID NO: 334 | KTGKGGTGVM W | PTEN R130G | SEQ ID NO: 17867 | KAGKGGTGV MI | A2T | I11W | Individual PTEN_R130G Vaccine (8-peptide, MHCflurry, Set 1) |
| SEQ ID NO: 335 | APKGGTGVL | PTEN R130G | SEQ ID NO: 17864 | AGKGGTGVM | G2P | M9L | Individual PTEN_R130G Vaccine (7-peptide, MHCflurry, Set 2) |
| SEQ ID NO: 336 | KAGKGGTGVM W | PTEN R130G | SEQ ID NO: 17867 | KAGKGGTGV MI | — | I11W | Individual PTEN_R130G Vaccine (7-peptide, MHCflurry, Set 2) |
| SEQ ID NO: 337 | KVGKGGTGV | PTEN R130G | SEQ ID NO: 17865 | KAGKGGTGV | A2V | — | Individual PTEN_R130G Vaccine (7-peptide, MHCflurry, Set 2) |
| SEQ ID NO: 338 | QQGVMICAF | PTEN R130Q | SEQ ID NO: 18200 | QTGVMICAY | T2Q | Y9F | Individual PTEN_R130Q Vaccine (5-peptide, NetMHCpan, Set 1) |
| SEQ ID NO: 339 | QQGVMICAY | PTEN R130Q | SEQ ID NO: 18200 | QTGVMICAY | T2Q | — | Individual PTEN_R130Q Vaccine (5-peptide, NetMHCpan, Set 1) |
| SEQ ID NO: 340 | QSGVMICAYV | PTEN R130Q | SEQ ID NO: 18201 | QTGVMICAYL | T25 | L10V | Individual PTEN_R130Q Vaccine (5-peptide, NetMHCpan, Set 1) |
| SEQ ID NO: 341 | QTGVMICAYI | PTEN R130Q | SEQ ID NO: 18201 | QTGVMICAYL | — | L10I | Individual PTEN_R130Q Vaccine (5-peptide, NetMHCpan, Set 1) |
| SEQ ID NO: 342 | QTGVMICAYV | PTEN R130Q | SEQ ID NO: 18201 | QTGVMICAYL | — | L10V | Individual PTEN_R130Q Vaccine (5-peptide, NetMHCpan, Set 1); Individual PTEN_R130Q Vaccine (2-peptide, NetMHCpan, Set 2) |
| SEQ ID NO: 343 | AAKGQTGVF | PTEN R130Q | SEQ ID NO: 18202 | AGKGQTGVM | G2A | M9F | Individual PTEN_R130Q Vaccine (8-peptide, MHCflurry, Set 1) |
| SEQ ID NO: 344 | AAKGQTGVL | PTEN R130Q | SEQ ID NO: 18202 | AGKGQTGVM | G2A | M9L | Individual PTEN_R130Q Vaccine (8-peptide, MHCflurry, Set 1); Individual PTEN_R130Q Vaccine (6-peptide, MHCflurry, Set 2) |

TABLE 1-continued

Example Vaccine Peptides (MHC class I)

| SEQ ID NO | Sequence corresponding to SEQ ID | Target | Seed SEQ ID NO | Seed | Heteroclitic Modification p2 | Heteroclitic Modification C-term | Note |
|---|---|---|---|---|---|---|---|
| SEQ ID NO: 345 | AAKGQTGVY | PTEN R130Q | SEQ ID NO: 18202 | AGKGQTGVM | G2A | M9Y | Individual PTEN_R130Q Vaccine (8-peptide, MHCflurry, Set 1); Individual PTEN_R130Q Vaccine (6-peptide, MHCflurry, Set 2) |
| SEQ ID NO: 346 | AQKGQTGVY | PTEN R130Q | SEQ ID NO: 18202 | AGKGQTGVM | G2Q | M9Y | Individual PTEN_R130Q Vaccine (8-peptide, MHCflurry, Set 1) |
| SEQ ID NO: 347 | KQGKGQTGV | PTEN R130Q | SEQ ID NO: 18203 | KAGKGQTGV | A2Q | — | Individual PTEN_R130Q Vaccine (8-peptide, MHCflurry, Set 1); Individual PTEN_R130Q Vaccine (6-peptide, MHCflurry, Set 2) |
| SEQ ID NO: 348 | KVGKGQTGV | PTEN R130Q | SEQ ID NO: 18203 | KAGKGQTGV | A2V | — | Individual PTEN_R130Q Vaccine (8-peptide, MHCflurry, Set 1); Individual PTEN_R130Q Vaccine (6-peptide, MHCflurry, Set 2) |
| SEQ ID NO: 349 | QVGVMICAK | PTEN R130Q | SEQ ID NO: 18200 | QTGVMICAY | T2V | Y9K | Individual PTEN_R130Q Vaccine (8-peptide, MHCflurry, Set 1) |
| SEQ ID NO: 350 | QVGVMICAR | PTEN R130Q | SEQ ID NO: 18200 | QTGVMICAY | T2V | Y9R | Individual PTEN_R130Q Vaccine (8-peptide, MHCflurry, Set 1) |
| SEQ ID NO: 351 | QMGVMICAY | PTEN R130Q | SEQ ID NO: 18200 | QTGVMICAY | T2M | — | Individual PTEN_R130Q Vaccine (2-peptide, NetMHCpan, Set 2) |
| SEQ ID NO: 352 | QTGVMICAK | PTEN R130Q | SEQ ID NO: 18200 | QTGVMICAY | — | Y9K | Individual PTEN_R130Q Vaccine (6-peptide, MHCflurry, Set 2) |
| SEQ ID NO: 353 | QTGVMICAR | PTEN R130Q | SEQ ID NO: 18200 | QTGVMICAY | — | Y9R | Individual PTEN_R130Q Vaccine (6-peptide, MHCflurry, Set 2) |
| SEQ ID NO: 354 | VMRRCPHRER | TP53 H179R | SEQ ID NO: 18410 | VVRRCPHRER | V2M | — | Individual TP53_H179R Vaccine (2-peptide, NetMHCpan, Set 1); Individual TP53_H179R Vaccine (1-peptide, NetMHCpan, Set 2) |
| SEQ ID NO: 355 | EFVRRCPHRER | TP53 H179R | SEQ ID NO: 18407 | EVVRRCPHRER | V2F | — | Individual TP53_H179R Vaccine (2-peptide, NetMHCpan, Set 1) |
| SEQ ID NO: 356 | RQCPHRERL | TP53 H179R | SEQ ID NO: 18412 | RRCPHRERC | R2Q | C9L | Individual TP53_H179R Vaccine (2-peptide, MHCflurry, Set 1); Individual TP53_H179R Vaccine (2-peptide, MHCflurry, Set 2) |
| SEQ ID NO: 357 | RRCPHRERY | TP53 H179R | SEQ ID NO: 18412 | RRCPHRERC | — | C9Y | Individual TP53_H179R Vaccine (2-peptide, NetMHCpan, Set 1) |
| SEQ ID NO: 358 | RRCPHRERF | TP53 H179R | SEQ ID NO: 18412 | RRCPHRERC | — | C9F | Individual TP53_H179R Vaccine (2-peptide, MHCflurry, Set 2) |
| SEQ ID NO: 359 | GQRVLAMAIY | TP53 R158L | SEQ ID NO: 19394 | GTRVLAMAIY | T2Q | — | Individual TP53_R158L Vaccine (5-peptide, NetMHCpan, Set 1); Bronchus Aand Lung Cancer Vaccine (30-peptide) |
| SEQ ID NO: 360 | GTRVLAMAY | TP53 R158L | SEQ ID NO: 19393 | GTRVLAMAI | — | I9Y | Individual TP53_R158L Vaccine (5-peptide, NetMHCpan, Set 1); Individual TP53_R158L Vaccine (5-peptide, NetMHCpan, Set 2) |
| SEQ ID NO: 361 | RMLAMAIF | TP53 R158L | SEQ ID NO: 19397 | RVLAMAIY | V2M | Y8F | Individual TP53_R158L Vaccine (5-peptide, NetMHCpan, Set 1) |

TABLE 1-continued

Example Vaccine Peptides (MHC class I)

| SEQ ID NO | Sequence corresponding to SEQ ID | Target | Seed SEQ ID NO | Seed | Heteroclitic Modification p2 | Heteroclitic Modification C-term | Note |
|---|---|---|---|---|---|---|---|
| SEQ ID NO: 362 | RMLAMAIYK | TP53 R158L | SEQ ID NO: 469 | RVLAMAIYK | V2M | — | Individual TP53_R158L Vaccine (5-peptide, NetMHCpan, Set 1); Bronchus Aand Lung Cancer Vaccine (30-peptide); Individual TP53_R158L Vaccine (5-peptide, NetMHCpan, Set 2) |
| SEQ ID NO: 363 | TMVLAMAIYK | TP53 R158L | SEQ ID NO: 19401 | TRVLAMAIYK | R2M | — | Individual TP53_R158L Vaccine (5-peptide, NetMHCpan, Set 1); Bronchus Aand Lung Cancer Vaccine (30-peptide); Individual TP53_R158L Vaccine (5-peptide, NetMHCpan, Set 2) |
| SEQ ID NO: 364 | RQLAMAIY | TP53 R158L | SEQ ID NO: 19397 | RVLAMAIY | V2Q | — | Bronchus And Lung Cancer Vaccine (30-peptide) |
| SEQ ID NO: 365 | RTLAMAIYR | TP53 R158L | SEQ ID NO: 469 | RVLAMAIYK | V2T | K9R | Individual TP53_R158L Vaccine (8-peptide, MHCflurry, Set 1); Individual TP53_R158L Vaccine (7-peptide, MHCflurry, Set 2) |
| SEQ ID NO: 366 | RYLAMAIYY | TP53 R158L | SEQ ID NO: 469 | RVLAMAIYK | V2Y | K9Y | Individual TP53_R158L Vaccine (8-peptide, MHCflurry, Set 1) |
| SEQ ID NO: 367 | THVLAMAA | TP53 R158L | SEQ ID NO: 19404 | TRVLAMAI | R2H | I8A | Individual TP53_R158L Vaccine (8-peptide, MHCflurry, Set 1); Individual TP53_R158L Vaccine (7-peptide, MHCflurry, Set 2) |
| SEQ ID NO: 368 | TPPPGTRVLL | TP53 R158L | SEQ ID NO: 470 | TPPPGTRVLA | — | A10L | Individual TP53_R158L Vaccine (8-peptide, MHCflurry, Set 1); Individual TP53_R158L Vaccine (7-peptide, MHCflurry, Set 2) |
| SEQ ID NO: 369 | TQVLAMAIY | TP53 R158L | SEQ ID NO: 19400 | TRVLAMAIY | R2Q | — | Individual TP53_R158L Vaccine (8-peptide, MHCflurry, Set 1); Individual TP53_R158L Vaccine (7-peptide, MHCflurry, Set 2) |
| SEQ ID NO: 370 | TVPPGTRVLAM | TP53 R158L | SEQ ID NO: 19399 | TPPPGTRVLAM | P2V | — | Individual TP53_R158L Vaccine (8-peptide, MHCflurry, Set 1) |
| SEQ ID NO: 371 | GMRVLAMAIY | TP53 R158L | SEQ ID NO: 19394 | GTRVLAMAIY | T2M | — | Individual TP53_R158L Vaccine (5-peptide, NetMHCpan, Set 2) |
| SEQ ID NO: 372 | TQVLAMAIF | TP53 R158L | SEQ ID NO: 19400 | TRVLAMAIY | R2Q | Y9F | Individual TP53_R158L Vaccine (5-peptide, NetMHCpan, Set 2) |
| SEQ ID NO: 373 | RTLAMAIYY | TP53 R158L | SEQ ID NO: 469 | RVLAMAIYK | V2T | K9Y | Individual TP53_R158L Vaccine (7-peptide, MHCflurry, Set 2) |
| SEQ ID NO: 374 | TAPPGTRVLAL | TP53 R158L | SEQ ID NO: 19399 | TPPPGTRVLAM | P2A | M11L | Individual TP53_R158L Vaccine (7-peptide, MHCflurry, Set 2) |
| SEQ ID NO: 375 | ETVRHCPHH | TP53 R175H | SEQ ID NO: 471 | EVRHCPHHER | V2T | — | Individual TP53_R175H Vaccine (5-peptide, NetMHCpan, Set 1); Brain Cancer Vaccine (25-peptide) |
| SEQ ID NO: 376 | VMRHCPHHER | TP53 R175H | SEQ ID NO: 472 | VVRHCPHHER | V2M | — | Individual TP53_R175H Vaccine (5-peptide, NetMHCpan, Set 1); Individual TP53_R175H Vaccine (2-peptide, NetMHCpan, Set 2) |

TABLE 1-continued

Example Vaccine Peptides (MHC class I)

| SEQ ID NO | Sequence corresponding to SEQ ID | Target | Seed SEQ ID NO | Seed | Heteroclitic Modification p2 | Heteroclitic Modification C-term | Note |
|---|---|---|---|---|---|---|---|
| SEQ ID NO: 377 | VTRHCPHHER | TP53 R175H | SEQ ID NO: 472 | VVRHCPHHER | V2T | — | Individual TP53_R175H Vaccine (5-peptide, NetMHCpan, Set 1) |
| SEQ ID NO: 378 | EVVRHCPHR | TP53 R175H | SEQ ID NO: 19748 | EVVRHCPHH | — | H9R | Individual TP53_R175H Vaccine (8-peptide, MHCflurry, Set 1); Individual TP53_R175H Vaccine (5-peptide, MHCflurry, Set 2) |
| SEQ ID NO: 379 | HQTEVVRHL | TP53 R175H | SEQ ID NO: 19749 | HMTEVVRHC | M2Q | C9L | Individual TP53_R175H Vaccine (8-peptide, MHCflurry, Set 1) |
| SEQ ID NO: 380 | HQTEVVRHV | TP53 R175H | SEQ ID NO: 19749 | HMTEVVRHC | M2Q | C9V | Individual TP53_R175H Vaccine (8-peptide, MHCflurry, Set 1); Individual TP53_R175H Vaccine (5-peptide, MHCflurry, Set 2) |
| SEQ ID NO: 381 | QHMTEVVRHL | TP53 R175H | SEQ ID NO: 19750 | QHMTEVVRHC | — | C10L | Individual TP53_R175H Vaccine (8-peptide, MHCflurry, Set 1); Individual TP53_R175H Vaccine (5-peptide, MHCflurry, Set 2) |
| SEQ ID NO: 382 | VRHCPHHEM | TP53 R175H | SEQ ID NO: 19747 | VRHCPHHER | — | R9M | Individual TP53_R175H Vaccine (8-peptide, MHCflurry, Set 1) |
| SEQ ID NO: 383 | VRHCPHHEY | TP53 R175H | SEQ ID NO: 19747 | VRHCPHHER | — | R9Y | Individual TP53_R175H Vaccine (8-peptide, MHCflurry, Set 1) |
| SEQ ID NO: 384 | VTHCPHHER | TP53 R175H | SEQ ID NO: 19747 | VRHCPHHER | R2T | — | Individual TP53_R175H Vaccine (8-peptide, MHCflurry, Set 1); Individual TP53_R175H Vaccine (5-peptide, MHCflurry, Set 2) |
| SEQ ID NO: 385 | VVHCPHHER | TP53 R175H | SEQ ID NO: 19747 | VRHCPHHER | R2V | — | Individual TP53_R175H Vaccine (8-peptide, MHCflurry, Set 1) |
| SEQ ID NO: 386 | VRHCPHHEF | TP53 R175H | SEQ ID NO: 19747 | VRHCPHHER | — | R9F | Individual TP53_R175H Vaccine (5-peptide, MHCflurry, Set 2) |
| SEQ ID NO: 387 | GMNQRPILTV | TP53 R248Q | SEQ ID NO: 20596 | GMNQRPILTI | — | I10V | Individual TP53_R248Q Vaccine (5-peptide, NetMHCpan, Set 1); Individual TP53_R248Q Vaccine (8-peptide, MHCflurry, Set 1); Individual TP53_R248Q Vaccine (4-peptide, NetMHCpan, Set 2) |
| SEQ ID NO: 388 | MLQRPILTIY | TP53 R248Q | SEQ ID NO: 20598 | MNQRPILTII | N2L | I10Y | Individual TP53_R248Q Vaccine (5-peptide, NetMHCpan, Set 1) |
| SEQ ID NO: 389 | STCMGGMNQK | TP53 R248Q | SEQ ID NO: 20602 | SSCMGGMNQR | S2T | R10K | Individual TP53_R248Q Vaccine (5-peptide, NetMHCpan, Set 1); Individual TP53_R248Q Vaccine (8-peptide, MHCflurry, Set 2) |
| SEQ ID NO: 390 | STMGGMNQR | TP53 R248Q | SEQ ID NO: 20601 | SCMGGMNQR | C2T | — | Individual TP53_R248Q Vaccine (5-peptide, NetMHCpan, Set 1); Individual TP53_R248Q Vaccine (4-peptide, NetMHCpan, Set 2); Individual TP53_R248Q Vaccine (8-peptide, MHCflurry, Set 2) |

TABLE 1-continued

Example Vaccine Peptides (MHC class I)

| SEQ ID NO | Sequence corresponding to SEQ ID | Target | Seed SEQ ID NO | Seed | Heteroclitic Modification p2 | Heteroclitic Modification C-term | Note |
|---|---|---|---|---|---|---|---|
| SEQ ID NO: 391 | SVCMGGMNQK | TP53 R248Q | SEQ ID NO: 20602 | SSCMGGMNQR | S2V | R10K | Individual TP53_R248Q Vaccine (5-peptide, NetMHCpan, Set 1); Individual TP53_R248Q Vaccine (8-peptide, MHCflurry, Set 1); Individual TP53_R248Q Vaccine (4-peptide, NetMHCpan, Set 2) |
| SEQ ID NO: 392 | MAQRPILTL | TP53 R248Q | SEQ ID NO: 20606 | MNQRPILTI | N2A | I9L | Individual TP53_R248Q Vaccine (8-peptide, MHCflurry, Set 1); Individual TP53_R248Q Vaccine (8-peptide, MHCflurry, Set 2) |
| SEQ ID NO: 393 | MQQRPILTV | TP53 R248Q | SEQ ID NO: 20606 | MNQRPILTI | N2Q | I9V | Individual TP53_R248Q Vaccine (8-peptide, MHCflurry, Set 1) |
| SEQ ID NO: 394 | MRQRPILTL | TP53 R248Q | SEQ ID NO: 20606 | MNQRPILTI | N2R | I9L | Individual TP53_R248Q Vaccine (8-peptide, MHCflurry, Set 1); Individual TP53_R248Q Vaccine (8-peptide, MHCflurry, Set 2) |
| SEQ ID NO: 395 | STCMGGMNQY | TP53 R248Q | SEQ ID NO: 20602 | SSCMGGMNQR | S2T | R10Y | Individual TP53_R248Q Vaccine (8-peptide, MHCflurry, Set 1); Individual TP53_R248Q Vaccine (8-peptide, MHCflurry, Set 2) |
| SEQ ID NO: 396 | SVMGGMNQM | TP53 R248Q | SEQ ID NO: 20601 | SCMGGMNQR | C2V | R9M | Individual TP53_R248Q Vaccine (8-peptide, MHCflurry, Set 1) |
| SEQ ID NO: 397 | SVMGGMNQR | TP53 R248Q | SEQ ID NO: 20601 | SCMGGMNQR | C2V | | Individual TP53_R248Q Vaccine (8-peptide, MHCflurry, Set 1) |
| SEQ ID NO: 398 | MMQRPILTIM | TP53 R248Q | SEQ ID NO: 20598 | MNQRPILTII | N2M | I10M | Individual TP53_R248Q Vaccine (4-peptide, MHCflurry, Set 2) |
| SEQ ID NO: 399 | GLNQRPILTV | TP53 R248Q | SEQ ID NO: 20596 | GMNQRPILTI | M2L | I10V | Individual TP53_R248Q Vaccine (8-peptide, MHCflurry, Set 2) |
| SEQ ID NO: 400 | MQQRPILTL | TP53 R248Q | SEQ ID NO: 20606 | MNQRPILTI | N2Q | I9L | Individual TP53_R248Q Vaccine (8-peptide, MHCflurry, Set 2) |
| SEQ ID NO: 401 | STMGGMNQM | TP53 R248Q | SEQ ID NO: 20601 | SCMGGMNQR | C2T | R9M | Individual TP53_R248Q Vaccine (8-peptide, MHCflurry, Set 2) |
| SEQ ID NO: 402 | GMNWRPILTV | TP53 R248W | SEQ ID NO: 21184 | GMNWRPILTI | — | I10V | Individual TP53_R248W Vaccine (5-peptide, NetMHCpan, Set 1); Individual TP53_R248W Qaccine (5-peptide, NetMHCpan, Set 2) |
| SEQ ID NO: 403 | MSWRPILTV | TP53 R248W | SEQ ID NO: 21186 | MNWRPILTY | N2S | I9V | Individual TP53_R248W Vaccine (5-peptide, NetMHCpan, Set 1) |
| SEQ ID NO: 404 | MVWRPILTY | TP53 R248W | SEQ ID NO: 21186 | MNWRPILTY | N2V | I9Y | Individual TP53_R248W Vaccine (5-peptide, NetMHCpan, Set 1) |
| SEQ ID NO: 405 | SAMGGMNWR | TP53 R248W | SEQ ID NO: 21188 | SCMGGMNWR | C2A | — | Individual TP53_R248W Vaccine (5-peptide, NetMHCpan, Set 1) |
| SEQ ID NO: 406 | SVCMGGMNWK | TP53 R248W | SEQ ID NO: 21189 | SSCMGGMNWR | S2V | R10K | Individual TP53_R248W Vaccine (5-peptide, NetMHCpan, Set 1) |
| SEQ ID NO: 407 | MAWRPILTL | TP53 R248W | SEQ ID NO: 21186 | MNWRPILTI | N2A | I9L | Individual TP53_R248W Vaccine (8-peptide, MHCflurry, Set 1) |

TABLE 1-continued

Example Vaccine Peptides (MHC class I)

| SEQ ID NO | Sequence corresponding to SEQ ID | Target | Seed SEQ ID NO | Seed | Heteroclitic Modification p2 | Heteroclitic Modification C-term | Note |
|---|---|---|---|---|---|---|---|
| SEQ ID NO: 408 | MQWRPILTL | TP53 R248W | SEQ ID NO: 21186 | MNWRPILTI | N2Q | I9L | Individual TP53_R248W Vaccine (8-peptide, MHCflurry, Set 1); Individual TP53_R248W Qaccine (8-peptide, MHCflurry, Set 2) |
| SEQ ID NO: 409 | MQWRPILTV | TP53 R248W | SEQ ID NO: 21186 | MNWRPILTI | N2Q | I9V | Individual TP53_R248W Vaccine (8-peptide, MHCflurry, Set 1) |
| SEQ ID NO: 410 | MRWRPILTM | TP53 R248W | SEQ ID NO: 21186 | MNWRPILTI | N2R | I9M | Individual TP53_R248W Vaccine (8-peptide, MHCflurry, Set 1) |
| SEQ ID NO: 411 | MSWRPILTL | TP53 R248W | SEQ ID NO: 21186 | MNWRPILTI | N2S | I9L | Individual TP53_R248W Vaccine (8-peptide, MHCflurry, Set 1); Individual TP53_R248W Vaccine (8-peptide, MHCflurry, Set 2) |
| SEQ ID NO: 412 | MTWRPILTL | TP53 R248W | SEQ ID NO: 21186 | MNWRPILTI | N2T | I9L | Individual TP53_R248W Vaccine (8-peptide, MHCflurry, Set 1); Individual TP53_R248W Vaccine (8-peptide, MHCflurry, Set 2) |
| SEQ ID NO: 413 | STMGGMNWR | TP53 R248W | SEQ ID NO: 21188 | SCMGGMNWR | C2T | — | Individual TP53_R248W Vaccine (8-peptide, MHCflurry, Set 1); Individual TP53_R248W Vaccine (5-peptide, NetMHCpan, Set 2); Individual TP53_R248W Vaccine (8-peptide, MHCflurry, Set 2) |
| SEQ ID NO: 414 | SVMGGMNWR | TP53 R248W | SEQ ID NO: 21188 | SCMGGMNWR | C2V | — | Individual TP53_R248W Vaccine (8-peptide, MHCflurry, Set 1) |
| SEQ ID NO: 415 | MSWRPILTF | TP53 R248W | SEQ ID NO: 21186 | MNWRPILTI | N2S | I9F | Individual TP53_R248W Vaccine (5-peptide, NetMHCpan, Set 2) |
| SEQ ID NO: 416 | MTWRPILTV | TP53 R248W | SEQ ID NO: 21186 | MNWRPILTI | N2T | I9V | Individual TP53_R248W Vaccine (5-peptide, NetMHCpan, Set 2) |
| SEQ ID NO: 417 | STCMGGMNWK | TP53 R248W | SEQ ID NO: 21189 | SSCMGGMNWR | S2T | R10K | Individual TP53_R248W Vaccine (8-peptide, MHCflurry, Set 2) |
| SEQ ID NO: 418 | MEWRPILTV | TP53 R248W | SEQ ID NO: 21186 | MNWRPILTI | N2E | I9V | Individual TP53_R248W Vaccine (8-peptide, MHCflurry, Set 2) |
| SEQ ID NO: 419 | MQWRPILTW | TP53 R248W | SEQ ID NO: 21186 | MNWRPILTI | N2Q | I9W | Individual TP53_R248W Vaccine (8-peptide, MHCflurry, Set 2) |
| SEQ ID NO: 420 | MRWRPILTY | TP53 R248W | SEQ ID NO: 21186 | MNWRPILTI | N2R | I9Y | Individual TP53_R248W Vaccine (8-peptide, MHCflurry, Set 2) |
| SEQ ID NO: 421 | SSMGGMNWR | TP53 R248W | SEQ ID NO: 21188 | SCMGGMNWR | C2S | — | Individual TP53_R248W Vaccine (8-peptide, MHCflurry, Set 2) |
| SEQ ID NO: 422 | ETCVCACPGR | TP53 R273C | SEQ ID NO: 473 | EVCVCACPGR | V2T | — | Individual TP53_R273C Vaccine (5-peptide, NetMHCpan, Set 2); Individual TP53_R273C Vaccine (3-peptide, NetMHCpan, Set 2); Individual TP53_R273C Vaccine (6-peptide, MHCflurry, Set 2) |

TABLE 1-continued

Example Vaccine Peptides (MHC class I)

| SEQ ID NO | Sequence corresponding to SEQ ID | Target | Seed SEQ ID NO | Seed | Heteroclitic Modification p2 | Heteroclitic Modification C-term | Note |
|---|---|---|---|---|---|---|---|
| SEQ ID NO: 423 | NVFEVCVCI | TP53 R273C | SEQ ID NO: 21456 | NSFEVCVCA | S2V | A9I | Individual TP53_R273C Vaccine (5-peptide, NetMHCpan, Set 1); Brain Cancer Vaccine (25-peptide); Individual TP53_R273C Vaccine (8-peptide, MHCflurry, Set 1) |
| SEQ ID NO: 424 | NVFEVCVCV | TP53 R273C | SEQ ID NO: 21456 | NSFEVCVCA | S2V | A9V | Individual TP53_R273C Vaccine (5-peptide, NetMHCpan, Set 1) |
| SEQ ID NO: 425 | SEEVCVCACA | TP53 R273C | SEQ ID NO: 21457 | SFEVCVCACP | F2E | P10A | Individual TP53_R273C Vaccine (5-peptide, NetMHCpan, Set 1); Brain Cancer Vaccine (25-peptide); Individual TP53_R273C Vaccine (3-peptide, NetMHCpan, Set 2) |
| SEQ ID NO: 426 | ETCVCACPGK | TP53 R273C | SEQ ID NO: 473 | EVCVCACPGR | V2T | R10K | Individual TP53_R273C Vaccine (8-peptide, MHCflurry, Set 1); Individual TP53_R273C Vaccine (6-peptide, MHCflurry, Set 2) |
| SEQ ID NO: 427 | EYCVCACPGR | TP53 R273C | SEQ ID NO: 473 | EVCVCACPGR | V2Y | — | Individual TP53_R273C Vaccine (8-peptide, MHCflurry, Set 1); Individual TP53_R273C Vaccine (6-peptide, MHCflurry, Set 2) |
| SEQ ID NO: 428 | GRNSFEVCL | TP53 R273C | SEQ ID NO: 21454 | GRNSFEVCV | — | V9L | Individual TP53_R273C Vaccine (8-peptide, MHCflurry, Set 1); Individual TP53_R273C Vaccine (6-peptide, MHCflurry, Set 2) |
| SEQ ID NO: 429 | GRNSFEVCM | TP53 R273C | SEQ ID NO: 21454 | GRNSFEVCV | — | V9M | Individual TP53_R273C Vaccine (8-peptide, MHCflurry, Set 1) |
| SEQ ID NO: 430 | NVFEVCVCL | TP53 R273C | SEQ ID NO: 21456 | NSFEVCVCA | S2V | A9L | Individual TP53_R273C Vaccine (8-peptide, MHCflurry, Set 1); Individual TP53_R273C Vaccine (6-peptide, MHCflurry, Set 2) |
| SEQ ID NO: 431 | SFEVCVCAL | TP53 R273C | SEQ ID NO: 21462 | SFEVCVCAC | — | C9L | Individual TP53_R273C Vaccine (8-peptide, MHCflurry, Set 1); Individual TP53_R273C Vaccine (6-peptide, MHCflurry, Set 2) |
| SEQ ID NO: 432 | NTFEVCVCV | TP53 R273C | SEQ ID NO: 21456 | NSFEVCVCA | S2T | A9V | Individual TP53_R273C Vaccine (3-peptide, MHCflurry, Set 2) |
| SEQ ID NO: 433 | EFHVCACPGR | TP53 R273H | SEQ ID NO: 474 | EVHVCACPGR | V2F | — | TP53_R273C Vaccine (6-peptide, MHCflurry, Set 2); Individual TP53_R273H Vaccine (5-peptide, NetMHCpan, Set 1); Individual TP53_R273H Vaccine (5-peptide, NetMHCpan, Set 2) |
| SEQ ID NO: 434 | LMGRNSFEVHV | TP53 R273H | SEQ ID NO: 21838 | LLGRNSFEVHV | L2M | — | Individual TP53_R273H Vaccine (5-peptide, NetMHCpan, Set 1); Individual TP53_R273H Vaccine (5-peptide, NetMHCpan, Set 2) |

TABLE 1-continued

Example Vaccine Peptides (MHC class I)

| SEQ ID NO | Sequence corresponding to SEQ ID | Target | Seed SEQ ID NO | Seed | Heteroclitic Modification p2 | Heteroclitic Modification C-term | Note |
|---|---|---|---|---|---|---|---|
| SEQ ID NO: 435 | NPFEVHVCV | TP53 R273H | SEQ ID NO: 21839 | NSFEVHVCA | 52P | A9V | Individual TP53_R273H Vaccine (5-peptide, NetMHCpan, Set 1); Individual TP53_R273H Vaccine (5-peptide, NetMHCpan, Set 2) |
| SEQ ID NO: 436 | NVFEVHVCV | TP53 R273H | SEQ ID NO: 21839 | NSFEVHVCA | 52V | A9V | Individual TP53_R273H Vaccine (5-peptide, NetMHCpan, Set 1); Individual TP53_R273H Vaccine (8-peptide, NetMHCpan, Set 1) |
| SEQ ID NO: 437 | EVHVCACPGK | TP53 R273H | SEQ ID NO: 474 | EVHVCACPGR | — | R10K | Individual TP53_R273H Vaccine (8-peptide, MHCflurry, Set 1) |
| SEQ ID NO: 438 | EYHVCACPGR | TP53 R273H | SEQ ID NO: 474 | EVHVCACPGR | V2Y | — | Individual TP53_R273H Vaccine (8-peptide, MHCflurry, Set 1); Individual TP53_R273H Vaccine (7-peptide, MHCflurry, Set 2) |
| SEQ ID NO: 439 | GRNSFEVHF | TP53 R273H | SEQ ID NO: 21836 | GRNSFEVHV | — | V9F | Individual TP53_R273H Vaccine (8-peptide, MHCflurry, Set 1); Individual TP53_R273H Vaccine (7-peptide, MHCflurry, Set 2) |
| SEQ ID NO: 440 | GRNSFEVHY | TP53 R273H | SEQ ID NO: 21836 | GRNSFEVHV | — | V9Y | Individual TP53_R273H Vaccine (8-peptide, MHCflurry, Set 1) |
| SEQ ID NO: 441 | NPFEVHVCA | TP53 R273H | SEQ ID NO: 21839 | NSFEVHVCA | 52P | — | Individual TP53_R273H Vaccine (8-peptide, MHCflurry, Set 1); Individual TP53_R273H Vaccine (7-peptide, MHCflurry, Set 2) |
| SEQ ID NO: 442 | SYEVHVCAL | TP53 R273H | SEQ ID NO: 21845 | SFEVHVCAC | F2Y | C9L | Individual TP53_R273H Vaccine (8-peptide, MHCflurry, Set 1); Individual TP53_R273H Vaccine (7-peptide, MHCflurry, Set 2) |
| SEQ ID NO: 443 | ETHVCACPGR | TP53 R273H | SEQ ID NO: 474 | EVHVCACPGR | V2T | — | Individual TP53_R273H Vaccine (5-peptide, NetMHCpan, Set 2); Individual TP53_R273H Vaccine (7-peptide, MHCflurry, Set 2) |
| SEQ ID NO: 444 | NTFEVHVCV | TP53 R273H | SEQ ID NO: 21839 | NSFEVHVCA | 52T | A9V | Individual TP53_R273H Vaccine (5-peptide, NetMHCpan, Set 2) |
| SEQ ID NO: 445 | ETHVCACPGK | TP53 R273H | SEQ ID NO: 474 | EVHVCACPGR | V2T | R10K | Individual TP53_R273H Vaccine (7-peptide, MHCflurry, Set 2) |
| SEQ ID NO: 446 | NAFEVHVCV | TP53 R273H | SEQ ID NO: 21839 | NSFEVHVCA | 52A | A9V | Individual TP53_R273H Vaccine (7-peptide, MHCflurry, Set 2) |
| SEQ ID NO: 447 | RMCACPGRDWR | TP53 R282W | SEQ ID NO: 21935 | RVCACPGRDWR | V2M | — | Individual TP53_R282W Vaccine (2-peptide, NetMHCpan, Set 1); Individual TP53_R282W Vaccine (1-peptide, NetMHCpan, Set 2) |
| SEQ ID NO: 448 | CTCPGRDWR | TP53 R282W | SEQ ID NO: 21934 | CACPGRDWR | A2T | — | Individual TP53_R282W Vaccine (2-peptide, NetMHCpan, Set 1) |

TABLE 1-continued

Example Vaccine Peptides (MHC class I)

| SEQ ID NO | Sequence corresponding to SEQ ID | Target | Seed SEQ ID NO | Seed | Heteroclitic Modification p2 | Heteroclitic Modification C-term | Note |
|---|---|---|---|---|---|---|---|
| SEQ ID NO: 449 | REWRTEEENL | TP53 R282W | SEQ ID NO: 21937 | RDWRTEEENL | D2E | — | Individual TP53_R282W Vaccine (1-peptide, MHCflurry, Set 1); Individual TP53_R282W Vaccine (1-peptide, MHCflurry, Set 2) |
| SEQ ID NO: 450 | VMPCEPPEV | TP53 Y220C | SEQ ID NO: 22379 | VVPCEPPEV | V2M | — | Individual TP53_Y220C Vaccine (1-peptide, NetMHCpan, Set 1); Individual TP53_Y220C Vaccine (8-peptide, MHCflurry, Set 1); Individual TP53_Y220C Vaccine (8-peptide, MHCflurry, Set 2) |
| SEQ ID NO: 451 | VAPCEPPEL | TP53 Y220C | SEQ ID NO: 22379 | VVPCEPPEV | V2A | V9L | Individual TP53_Y220C Vaccine (8-peptide, MHCflurry, Set 1); Individual TP53_Y220C Vaccine (8-peptide, MHCflurry, Set 2) |
| SEQ ID NO: 452 | VAPCEPPEM | TP53 Y220C | SEQ ID NO: 22379 | VVPCEPPEV | V2A | V9M | Individual TP53_Y220C Vaccine (8-peptide, MHCflurry, Set 1); Individual TP53_Y220C Vaccine (8-peptide, MHCflurry, Set 2) |
| SEQ ID NO: 453 | VFPCEPPEM | TP53 Y220C | SEQ ID NO: 22379 | VVPCEPPEV | V2F | V9M | Individual TP53_Y220C Vaccine (8-peptide, MHCflurry, Set 1); Individual TP53_Y220C Vaccine (8-peptide, MHCflurry, Set 2) |
| SEQ ID NO: 454 | VLPCEPPEV | TP53 Y220C | SEQ ID NO: 22379 | VVPCEPPEV | V2L | — | Individual TP53_Y220C Vaccine (8-peptide, MHCflurry, Set 1); Individual TP53_Y220C Vaccine (1-peptide, NetMHCpan, Set 2) |
| SEQ ID NO: 455 | VPCEPPEVA | TP53 Y220C | SEQ ID NO: 22384 | VPCEPPEVG | — | G9A | Individual TP53_Y220C Vaccine (8-peptide, MHCflurry, Set 1); Individual TP53_Y220C Vaccine (8-peptide, MHCflurry, Set 2) |
| SEQ ID NO: 456 | VPCEPPEVM | TP53 Y220C | SEQ ID NO: 22384 | VPCEPPEVG | — | G9M | Individual TP53_Y220C Vaccine (8-peptide, MHCflurry, Set 1); Individual TP53_Y220C Vaccine (8-peptide, MHCflurry, Set 2) |
| SEQ ID NO: 457 | VYPCEPPEL | TP53 Y220C | SEQ ID NO: 22379 | VVPCEPPEV | V2Y | V9L | Individual TP53_Y220C Vaccine (8-peptide, MHCflurry, Set 1); Individual TP53_Y220C Vaccine (8-peptide, MHCflurry, Set 2) |
| SEQ ID NO: 458 | VLPCEPPEL | TP53 Y220C | SEQ ID NO: 22379 | VVPCEPPEV | V2L | V9L | Individual TP53_Y220C Vaccine (8-peptide, MHCflurry, Set 2) |
| SEQ ID NO: 459 | KYIKTWRPRYF | AKT1 E17K | SEQ ID NO: 459 | KYIKTWRPRYF | — | — | Individual AKT1_E17K Vaccine (5-peptide, NetMHCpan, Set 1); Individual AKT1_E17K Vaccine (5-peptide, NetMHCpan, Set 2) |

TABLE 1-continued

Example Vaccine Peptides (MHC class I)

| SEQ ID NO | Sequence corresponding to SEQ ID | Target | Seed SEQ ID NO | Seed | Heteroclitic Modification p2 | Heteroclitic Modification C-term | Note |
|---|---|---|---|---|---|---|---|
| SEQ ID NO: 460 | KPIIIGCHA | IDH1 R132C | SEQ ID NO: 460 | KPIIIGCHA | — | — | Individual IDH1_R132C Vaccine (5-peptide, MHCflurry, Set 1) |
| SEQ ID NO: 461 | KPIIIGHHA | IDH1 R132H | SEQ ID NO: 461 | KPIIIGHHA | — | — | Individual IDH1_R132H Vaccine (8-peptide, MHCflurry, Set 1); Individual IDH1_R132H Vaccine (8-peptide, MHCflurry, Set 2) |
| SEQ ID NO: 462 | LVVVGAAGV | KRAS G12A | SEQ ID NO: 462 | LVVVGAAGV | — | — | Individual KRAS_G12A Vaccine (8-peptide, MHCflurry, Set 1) |
| SEQ ID NO: 463 | VVVGACGVGK | KRAS G12C K | SEQ ID NO: 463 | VVVGACGVG | — | — | Individual KRAS_G12C Vaccine (8-peptide, MHCflurry, Set 1) |
| SEQ ID NO: 464 | VVVGADGVGK | KRAS G12D K | SEQ ID NO: 464 | VVVGADGVG | — | — | Individual KRAS_G12D Vaccine (8-peptide, MHCflurry, Set 1) |
| SEQ ID NO: 465 | VVVGARGVGK | KRAS G12R K | SEQ ID NO: 465 | VVVGARGVG | — | — | Individual KRAS_G12R Vaccine (8-peptide, MHCflurry, Set 1) |
| SEQ ID NO: 466 | KLVVVGAGDV | KRAS G13D V | SEQ ID NO: 466 | KLVVVGAGD | — | — | Individual KRAS_G13D Vaccine (5-peptide, NetMHCpan, Set 1) |
| SEQ ID NO: 467 | ITKQEKDFLW | PIK3CA E545K | SEQ ID NO: 467 | ITKQEKDFLW | — | — | Individual PIK3CA_E545K Vaccine (4-peptide, NetMHCpan, Set 1); Bronchus Aand Lung Cancer Vaccine (30-peptide); Colorectal Cancer Vaccine (20-peptide); Individual PIK3CA_E545K Vaccine (8-peptide, MHCflurry, Set 1); Individual PIK3CA_E545K Vaccine (4-peptide, MHCflurry, Set 2) |
| SEQ ID NO: 468 | ETRQLCDLR | PIK3CA R88Q | SEQ ID NO: 468 | ETRQLCDLR | — | — | Individual PIK3CA_R88Q Vaccine (5-peptide, NetMHCpan, Set 1); Individual PIK3CA_R88Q Vaccine (8-peptide, MHCflurry, Set 1); Individual PIK3CA_R88Q Vaccine (5-peptide, NetMHCpan, Set 2); Individual PIK3CA_R88Q Vaccine (8-peptide, MHCflurry, Set 2) |
| SEQ ID NO: 469 | RVLAMAIYK | TP53 R158L | SEQ ID NO: 469 | RVLAMAIYK | — | — | Individual TP53_R158L Vaccine (8-peptide, MHCflurry, Set 1) |
| SEQ ID NO: 470 | TPPPGTRVLA | TP53 R158L | SEQ ID NO: 470 | TPPPGTRVLA | — | — | Individual TP53_R158L Vaccine (8-peptide, MHCflurry, Set 1); Individual TP53_R158L Vaccine (7-peptide, MHCflurry, Set 2) |
| SEQ ID NO: 471 | EVVRHCPHHER | TP53 R175H | SEQ ID NO: 471 | EVVRHCPHH ER | — | — | Individual TP53_R175H Vaccine (5-peptide, NetMHCpan, Set 1); Colorectal Cancer Vaccine (20-peptide); Brain Cancer Vaccine (25-peptide); Individual TP53_R175H Vaccine (2-peptide, NetMHCpan, Set 2) |

TABLE 1-continued

Example Vaccine Peptides (MHC class I)

| SEQ ID NO | Sequence corresponding to SEQ ID | Target | Seed SEQ ID NO | Seed | Heteroclitic Modification p2 | Heteroclitic Modification C-term | Note |
|---|---|---|---|---|---|---|---|
| SEQ ID NO: 472 | VVRHCPHHER | TP53 R175H | SEQ ID NO: 472 | VVRHCPHHER | — | — | Individual TP53_R175H Vaccine (5-peptide, NetMHCpan, Set 1); Colorectal Cancer Vaccine (20-peptide); Brain Cancer Vaccine (25-peptide) |
| SEQ ID NO: 473 | EVCVCACPGR | TP53 R273C | SEQ ID NO: 473 | EVCVCACPGR | — | — | Individual TP53_R273C Vaccine (5-peptide, NetMHCpan, Set 1); Brain Cancer Vaccine (25-peptide); Individual TP53_R273C Vaccine (8-peptide, MHCflurry, Set 1) |
| SEQ ID NO: 474 | EVHVCACPGR | TP53 R273H | SEQ ID NO: 474 | EVHVCACPGR | — | — | Individual TP53_R273H Vaccine (5-peptide, NetMHCpan, Set 1); Individual TP53_R273H Vaccine (8-peptide, MHCflurry, Set 1) |

TABLE 2

Example Vaccine Peptides (MHC class II)

| SEQ ID NO | Sequence corresponding to SEQ ID | Core | Target | Seed SEQ ID NO | Seed | Seed Core | Heteroclitic Modification P1 | Heteroclitic Modification P4 | Heteroclitic Modification P6 | Heteroclitic Modification P9 | Note |
|---|---|---|---|---|---|---|---|---|---|---|---|
| SEQ ID NO: 475 | AIVKEGFLHAR AKVKTWRPRY | FLH ARA FLL | AKT1 E17K KYV | SEQ ID NO: 22737 | AIVKE GWLH KRGKYI KTWRP RYFLL | WLH KRGK YI | W1F | K4A | G6A | I9V | Individual AKT1_E17K Vaccine 15-peptide |
| SEQ ID NO: 476 | AIVKEGFLHTRF KYIKTWRPRYFL | FLH TRF L | AKT1 E17K KYI | SEQ ID NO: 22737 | AIVKE GWLH KRGKYI KTWRP RYFLL | WLH KRGK YI | W1F | K4T | G6F | — | Individual AKT1_E17K Vaccine (5-peptide); Individual AKT1_E17K Vaccine (5-peptide, Set 2) |
| SEQ ID NO: 477 | DVAIVKEGFLH ERFKYMKTWR PRYF | FLH ERF KYM | AKT1 E17K | SEQ ID NO: 22744 | DVAIV KEG WL HKRGK YIKTW RPRYF | WLH KRGK YI | W1F | K4E | G6F | I9M | Individual AKT1_E17K Vaccine (5-peptide) |
| SEQ ID NO: 478 | DVAIVKEGLLH NRNKYIKTWRP RYF | LLH NRN KYI | AKT1 E17K | SEQ ID NO: 22744 | DVAIV KEG WL HKRGK YIKTW RPRYF | WLH KRGK YI | W1L | K4N | G6N | — | Individual AKT1_E17K Vaccine (5-peptide) |
| SEQ ID NO: 479 | VKEGFLHMRSK YIKTWRPRY | FLH MRS KYI | AKT1 E17K | SEQ ID NO: 22826 | VKEG WLHK RGKYIK TWRP RY | WLH KRGK YI | W1F | K4M | G6S | — | Individual AKT1_E17K Vaccine (5-peptide) |
| SEQ ID NO: 480 | AIVKEGILHARA KYIKTWRPRYFL | ILHA RAK YI | AKT1 E17K | SEQ ID NO: 22737 | AIVKE GWLH KRGKYI KTWRP RYFLL | WLH KRGK YI | W1I | K4A | G6A | — | Individual AKT1_E17K Vaccine (5-peptide, Set 2) |
| SEQ ID NO: 481 | DVAIVKEGFLH TRFKYLKTWRP RYF | FLH TRF KYL | AKT1 E17K | SEQ ID NO: 22744 | DVAIV KEG WL HKRGK YIKTW RPRYF | WLH KRGK YI | W1F | K4T | G6F | I9L | Individual AKT1_E17K Vaccine (5-peptide, Set 2) |

TABLE 2-continued

Example Vaccine Peptides (MHC class II)

| SEQ ID NO | Sequence corresponding to SEQ ID | Core | Target | Seed SEQ ID NO | Seed | Seed Core | Heteroclitic Modification P1 | Heteroclitic Modification P4 | Heteroclitic Modification P6 | Heteroclitic Modification P9 | Note |
|---|---|---|---|---|---|---|---|---|---|---|---|
| SEQ ID NO: 482 | DVAIVKEGILHN RFKYIKTWRPR YF | ILHN RFK YI | AKT1 E17K | SEQ ID NO: 22744 | DVAIV KEGWL HKRGK YIKTW RPRYF | WLH KRGK YI | W1I | K4N | G6F | — | Individual AKT1_E17K Vaccine (5-peptide, Set 2) |
| SEQ ID NO: 483 | VKEGFLHIRSKY VKTWRPRY | FLHI RSK YV | AKT1 E17K | SEQ ID NO: 22826 | VKEG WLHK RGKYIK TWRP RY | WLH KRGK YI | W1F | K4I | G6S | I9V | Individual AKT1_E17K Vaccine (5-peptide, Set 2) |
| SEQ ID NO: 484 | FGLLTEWSRWS RSHQ | LTE WSR WSR | BRAF V600E | SEQ ID NO: 22848 | FGLAT EKSRW SGSHQ | ATEK SRW SG | A1L | K4W | — | G9R | Individual BRAF_V600E Vaccine (5-peptide); Colorectal Cancer Vaccine (30-peptide); Skin Cancer Vaccine (20-peptide); Thyroid Cancer Vaccine (10-peptide) |
| SEQ ID NO: 485 | KIGLFGFAVEKA RWS | LFG FAV EKA | BRAF V600E | SEQ ID NO: 22861 | KIGDF GLATE KSRWS | DFGL ATEK S | D1L | L4F | T6V | S5A | Individual BRAF_V600E Vaccine (5-peptide); Colorectal Cancer Vaccine (30-peptide); Skin Cancer Vaccine (20-peptide); Thyroid Cancer Vaccine (10-peptide) |
| SEQ ID NO: 486 | KIGLFGWAVEK VRWS | LFG WA VEK | BRAF V600E | SEQ ID NO: 22861 | KIGDF GLATE KSRWS V | DFGL ATEK S | D1L | L4W | T6V | S9V | Individual BRAF_V600E Vaccine (5-peptide) |
| SEQ ID NO: 487 | VKIGLFGIAIEKL RW | LFGI AIEK | BRAF V600E | SEQ ID NO: | VKIGD FGLAT ATEK | DFGL ATEK | D1L | L4I | T6I | S9L | Individual BRAF_V600E |

TABLE 2-continued

Example Vaccine Peptides (MHC class II)

| SEQ ID NO | Sequence corresponding to SEQ ID | Core | Target | Seed SEQ ID NO | Seed | Seed Core | Heteroclitic Modification P1 | Heteroclitic Modification P4 | Heteroclitic Modification P6 | Heteroclitic Modification P9 | Note |
|---|---|---|---|---|---|---|---|---|---|---|---|
| | | L | | 22875 | EKSRW | S | | | | | Vaccine (5-peptide) |
| SEQ ID NO: 488 | VKIGYFGWAAEKARW | YFGWAAEKA | BRAF V600E | SEQ ID NO: 22875 | VKIGDFGLATEKSRW | DFGLATEKS | D1Y | L4W | T6A | S9A | Individual BRAF_V600E Vaccine (5-peptide); Colorectal Cancer Vaccine (30-peptide); Skin Cancer Vaccine (20-peptide); Thyroid Cancer Vaccine (10-peptide) |
| SEQ ID NO: 489 | VKIGLFGLAIEKMRW | LFGLAIEKM | BRAF V600E | SEQ ID NO: 22875 | VKIGDFGLATEKSRW | DFGLATEKS | D1L | — | T6I | S9M | Colorectal Cancer Vaccine (30-peptide); Skin Cancer Vaccine (20-peptide); Thyroid Cancer Vaccine (10-peptide) |
| SEQ ID NO: 490 | FGLITEMSRWSKSHQ | ITEMSRWSK | BRAF V600E | SEQ ID NO: 22848 | FGLATEKSRWSGSHQ | ATEKSRWSG | A1I | K4M | — | G9K | Individual BRAF_V600E Vaccine (5-peptide, Set 2) |
| SEQ ID NO: 491 | KIGFFGIAIEKARWS | FFGIAIEKA | BRAF V600E | SEQ ID NO: 22861 | KIGDFGLATEKSRWS | DFGLATEKS | D1F | L4I | T6I | S9A | Individual BRAF_V600E Vaccine (5-peptide, Set 2) |
| SEQ ID NO: 492 | KIGIFGYAIEKARWS | IFGYAIEKA | BRAF V600E | SEQ ID NO: 22861 | KIGDFGLATEKSRWS | DFGLATEKS | D1L | L4Y | T6I | S9A | Individual BRAF_V600E Vaccine (5-peptide, Set 2) |
| SEQ ID NO: 493 | VKIGFFGLASEKVRW | FFGLASEKV | BRAF V600E | SEQ ID NO: 22875 | VKIGDFGLATEKSRW | DFGLATEKS | D1F | — | T6S | S9V | Individual BRAF_V600E Vaccine (5-peptide, Set 2) |

TABLE 2-continued

Example Vaccine Peptides (MHC class II)

| SEQ ID NO | Sequence corresponding to SEQ ID | Core | Target | Seed SEQ ID NO | Seed | Seed Core | Heteroclitic Modification P1 | Heteroclitic Modification P4 | Heteroclitic Modification P6 | Heteroclitic Modification P9 | Note |
|---|---|---|---|---|---|---|---|---|---|---|---|
| SEQ ID NO: 494 | VKIGVFGLAGE KLRW | VFG LAG EKL | BRAF V600E | SEQ ID NO: 22875 | VKIGD FGLAT EKSRW | DFGL ATEK S | D1V | — | T6G | S9L | Individual BRAF_V600E Vaccine (5-peptide, Set 2) |
| SEQ ID NO: 495 | GLLTMHSRWS KSHQF | LTM HSR WSK | BRAF V600M | SEQ ID NO: 22922 | GLAT MKSR WSGS HQF | ATM KSR WSG | A1L | K4H | — | G9K | Individual BRAF_V600M Vaccine (5-peptide); Skin Cancer Vaccine (20-peptide) |
| SEQ ID NO: 496 | KIGPFGAAVMK ARWS | FFG AAV MKA | BRAF V600M | SEQ ID NO: 22941 | KIGDF GLAT MKSR WS | DFGL ATM KS | D1F | L4A | T6V | S9A | Individual BRAF_V600M Vaccine (5-peptide); Skin Cancer Vaccine (20-peptide) |
| SEQ ID NO: 497 | KIGIFGAASMK ARWS | IFGA ASM KA | BRAF V600M | SEQ ID NO: 22941 | KIGDF GLAT MKSR WS | DFGL ATM KS | D1L | L4A | T6S | S9A | Individual BRAF_V600M Vaccine (5-peptide); Skin Cancer Vaccine (20-peptide); Individual BRAF_V600M Vaccine (5-peptide, Set 2) |
| SEQ ID NO: 498 | KIGMFGIANM KDRWS | MFG IAN MK D | BRAF V600M | SEQ ID NO: 22941 | KIGDF GLAT MKSR WS | DFGL ATM KS WS | D1M | L4I | T6N | S9D | Individual BRAF_V600M Vaccine (5-peptide); Skin Cancer Vaccine (20-peptide) |
| SEQ ID NO: 499 | TVKIGIFGIATM KHRWS | IFGI ATM KH | BRAF V600M | SEQ ID NO: 22960 | TVKIG DFGLA TMKSR WS | DFGL ATM KS | D1L | L4I | — | S9H | Individual BRAF_V600M Vaccine (5-peptide, Set 2) |

TABLE 2-continued

Example Vaccine Peptides (MHC class II)

| SEQ ID NO | Sequence corresponding to SEQ ID | Core | Target | Seed SEQ ID NO | Seed | Seed Core | Heteroclitic Modification P1 | Heteroclitic Modification P4 | Heteroclitic Modification P6 | Heteroclitic Modification P9 | Note |
|---|---|---|---|---|---|---|---|---|---|---|---|
| SEQ ID NO: 500 | GLITMISRWSRSHQF | ITMISRWSR | BRAF V600M | SEQ ID NO: 22922 | GLATMKSRWSGSHQF | ATMKSRWSG | A1I | K4I | — | G9R | Individual BRAF_V600M Vaccine (5-peptide, Set 2) |
| SEQ ID NO: 501 | KIGFFGAAAMKARWS | FFGAAAMKA | BRAF V600M | SEQ ID NO: 22941 | KIGDFGLATMKSRWS | DFGLATMKS | D1F | L4A | T6A | S9A | Individual BRAF_V600M Vaccine (5-peptide, Set 2) |
| SEQ ID NO: 502 | KIGMFGIATMKDRWS | MFGIATMKD | BRAF V600M | SEQ ID NO: 22941 | KIGDFGLATMKSRWS | DFGLATMKS | D1M | L4I | — | S9D | Individual BRAF_V600M Vaccine (5-peptide, Set 2) |
| SEQ ID NO: 503 | PEGKWSFQVACVMKC | WSFQVACVM | EGFR A289V | SEQ ID NO: 22986 | PEGKYSFGVTCVKKC | YSFGVTCVK | Y1W | G4Q | T6A | K9M | Individual EGFR_A289V Vaccine (5-peptide) |
| SEQ ID NO: 504 | PEGKYSFLVGCVNKC | YSFLVGCVN | EGFR A289V | SEQ ID NO: 22986 | PEGKYSFGVTCVKKC | YSFGVTCVK | — | G4L | T6O | K9N | Individual EGFR_A289V Vaccine (5-peptide) |
| SEQ ID NO: 505 | PEGKYSFLVPCVMKC | YSFLVPCVM | EGFR A289V | SEQ ID NO: 22986 | PEGKYSFGVTCVKKC | YSFGVTCVK | — | G4L | T6P | K9M | Individual EGFR_A289V Vaccine (5-peptide) |
| SEQ ID NO: 506 | PEGKYSFMVSCVRKC | YSFMVSCVR | EGFR A289V | SEQ ID NO: 22986 | PEGKYSFGVTCVKKC | YSFGVTCVK | — | G4M | T6S | K9R | Individual EGFR_A289V Vaccine (5-peptide) |
| SEQ ID NO: 507 | PEGKYSYGVMCVKKLPRNYV | YGVMCVKKL | EGFR A289V | SEQ ID NO: 22988 | PEGKYSFGVTCVKKCPRNYV | FGVTCVKKC | F1Y | T4M | — | C9L | Individual EGFR_A289V Vaccine (5-peptide) |
| SEQ ID NO: 508 | PEGKYSYGVMCVKKVPRNYV | YGVMCVKKV | EGFR A289V | SEQ ID NO: 22988 | PEGKYSFGVTCVKKCPRNYV | FGVTCVKKC | F1Y | T4M | — | C9V | Brain Cancer Vaccine (20-peptide) |

TABLE 2-continued

Example Vaccine Peptides (MHC class II)

| SEQ ID NO | Sequence corresponding to SEQ ID | Core | Target | Seed SEQ ID NO | Seed | Seed Core | Heteroclitic Modification P1 | Heteroclitic Modification P4 | Heteroclitic Modification P6 | Heteroclitic Modification P9 | Note |
|---|---|---|---|---|---|---|---|---|---|---|---|
| SEQ ID NO: 509 | PEGKFSFMVPC VAKC | FSF MVP CVA | EGFR A289V | SEQ ID NO: 22986 | PEGKY SFGVT CVKKC | YSFG VTCV K | Y1F | G4M | T6P | K9A | Individual EGFR_A289V Vaccine (1-peptide, Set 2) |
| SEQ ID NO: 510 | GPHCYKTLPAV VAGE | YKTL PAV VA | EGFR G598V | SEQ ID NO: 23030 | GPHCV KTCPA VVMG | VKTC PAVV M | V1Y | C4L | — | M9A | Individual EGFR_G598V Vaccine (5-peptide); Brain Cancer Vaccine (20-peptide) |
| SEQ ID NO: 511 | PHCFKTSPAVV VGENNTLVW | FKTS PAV VV | EG FR G598V | SEQ ID NO: 23073 | PHCVK TCPAV VMGE NNTLV W | VKTC PAVV M | V1F | C4S | — | M9V | Individual EGFR_0598V Vaccine (5-peptide) |
| SEQ ID NO: 512 | PHCYKTSPAVVI GENNTLVW | YKTS PAV VI | EG FR G598V | SEQ ID NO: 23073 | PHCVK TCPAV VMGE NNTLV W | VKTC PAVV M | V1Y | C4S | — | M9I | Individual EGFR_0598V Vaccine (5-peptide); Brain Cancer Vaccine (20-peptide) |
| SEQ ID NO: 513 | YIDGPHCIKTNP VVLGENNTLV | IKTN PVV VL | EGFR G598V | SEQ ID NO: 23087 | YIDGP HCVKT CPAVV MGEN NTLV | VKTC PAVV M | V1I | C4N | A6V | M9L | Individual EGFR_G598V Vaccine (5-peptide) |
| SEQ ID NO: 514 | YIDGPHCVKTN PSVVIGENNTL V | VKT NPS VVI | EGFR G598V | SEQ ID NO: 23087 | YIDGP HCVKT CPAVV MGEN NTLV | VKTC PAVV M | — | C4N | A6S | M9I | Individual EGFR_0598V Vaccine (5-peptide); Brain Cancer Vaccine (20-peptide) |
| SEQ ID NO: 515 | GPHCFKTMPA VVAGE | FKT MPA VVA | EGFR G598V | SEQ ID NO: 23030 | GPHCV KTCPA VVMG E | VKTC PAVV M | V1F | C4M | — | M9A | Individual EGFR_G598V Vaccine (5-peptide, Set 2) |
| SEQ ID NO: 516 | GPHCMKTLPSV VAGE | MKT LPSV VA | EGFR G598V | SEQ ID NO: 23030 | GPHCV KTCPA VVMG E | VKTC PAVV M | V1M | C4L | A6S | M9A | Individual EGFR_G598V Vaccine (5-peptide, Set 2) |

TABLE 2-continued

Example Vaccine Peptides (MHC class II)

| SEQ ID NO | Sequence corresponding to SEQ ID | Core | Target | Seed SEQ ID NO | Seed | Seed Core | Heteroclitic Modification P1 | Heteroclitic Modification P4 | Heteroclitic Modification P6 | Heteroclitic Modification P9 | Note |
|---|---|---|---|---|---|---|---|---|---|---|---|
| SEQ ID NO: 517 | GPHFVKTCSAV IMGE | FVK TCS AVI | EGFR G598V | SEQ ID NO: 23030 | GPHCV KTCPA VVMG E | CVKT CPAV V | C1F | — | P6S | V9I | Individual EGFR_G598V Vaccine (5-peptide, Set 2) |
| SEQ ID NO: 518 | PHCFKTAPAVV IGENNTLVW | FKT APA VVI | EGFR G598V | SEQ ID NO: 23073 | PHCVK TCPAV VMGE NNTLIV W | VKTC PAVV M | V1F | C4A | — | M9I | Individual EGFR_G598V Vaccine (5-peptide, Set 2) |
| SEQ ID NO: 519 | YIDGPHCFKTN PAVVIGENNTL V | FKT NPA VVI | EGFR G598V | SEQ ID NO: 23087 | YIDGP HCVKT CPAVV MGEN NTLV | VKTC PAVV M | V1F | C4N | — | M9I | Individual EGFR_G598V Vaccine (5-peptide, Set 2) |
| SEQ ID NO: 520 | KTPQHFKITDF GRVKLLGAE | FKIT DFG RV | EGFR L858R | SEQ ID NO: 23150 | KTPQH VKITDF GRAKL LGAE | VKIT DFGR A | V1F | — | — | A9V | Individual EGFR_L858R Vaccine (5-peptide); Bronchus And Lung Cancer Vaccine (30-peptide) |
| SEQ ID NO: 521 | KTPQHYKIADS GRIKLLGAE | YKIA DSG RI | EGFR L858R | SEQ ID NO: 23150 | KTPQH VKITDF GRAKL LGAE | VKIT DFGR A | V1Y | T4A | F6S | A9I | Individual EGFR_L858R Vaccine (5-peptide); Bronchus And Lung Cancer Vaccine (30-peptide) |
| SEQ ID NO: 522 | QHVKITDYGRIK RLGIEEKE | YGRI KRL GI | EGFR L858R | SEQ ID NO: 23195 | QHVKI TDFGR AKLLG AEEKE | FGRA KLLG A | F1Y | A4I | L6R | A9I | Individual EGFR_L858R Vaccine (5-peptide) |

TABLE 2-continued

Example Vaccine Peptides (MHC class II)

| SEQ ID NO | Sequence corresponding to SEQ ID | Core | Target | Seed SEQ ID NO | Seed | Seed Core | Heteroclitic Modification P1 | Heteroclitic Modification P4 | Heteroclitic Modification P6 | Heteroclitic Modification P9 | Note |
|---|---|---|---|---|---|---|---|---|---|---|---|
| SEQ ID NO: 523 | VKIMDFMRGK LSGAE | MDF MR GKL S | EGFR L858R | SEQ ID NO: 23234 | VKITDF GRAKL LGAE | TDFG RAKL L | T1M | G4M | A6G | L9S | Individual EGFR_L858R Vaccine (5-peptide); Bronchus And Lung Cancer Vaccine (30-peptide) |
| SEQ ID NO: 524 | VKITDFGRAKA LGVE | FGR AKA LGV | EGFR L858R | SEQ ID NO: 23234 | VKITDF GRAKL LGAE | FGRA KLLG A | — | — | L6A | A9V | Individual EGFR_L858R Vaccine (5-peptide); Bronchus And Lung Cancer Vaccine (30-peptide) |
| SEQ ID NO: 525 | KTPQHFKITDIG RLKLLGAE | FKIT DIG RL | EGFR L858R | SEQ ID NO: 23150 | KTPQH VKITDF GRAKL LGAE | VKIT DFGR A | V1F | — | F6I | A9L | Individual EGFR_L858R Vaccine (5-peptide, Set 2) |
| SEQ ID NO: 526 | QHVKITDFGRIK RLGVEEKE | FGRI KRL GV | EGFR L858R | SEQ ID NO: 23195 | QHVKI TDFGR AKLLG AEEKE | FGRA KLLG A | — | A4I | L6R | A9V | Individual EGFR_L858R Vaccine (5-peptide, Set 2) |
| SEQ ID NO: 527 | VKIIDFMRAKLL GAE | IDF MR AKLL | EGFR L858R | SEQ ID NO: 23234 | VKITDF GRAKL LGAE | TDFG RAKL L | T1I | G4M | — | — | Individual EGFR_L858R Vaccine (5-peptide, Set 2) |
| SEQ ID NO: 528 | LERFLHMKSRIV FVI | FLH MKS RIV | GTF2I L424H | SEQ ID NO: 23315 | LERILH AKERIR FVI | ILHA KERI R | I1F | A4M | E6S | R9V | Individual GTF2I_L424H Vaccine (5-peptide); Individual GTF2I_L424H Vaccine (5-peptide, Set 2) |

TABLE 2-continued

Example Vaccine Peptides (MHC class II)

| SEQ ID NO | Sequence corresponding to SEQ ID | Core | Target | Seed SEQ ID NO | Seed | Seed Core | Heteroclitic Modification P1 | Heteroclitic Modification P4 | Heteroclitic Modification P6 | Heteroclitic Modification P9 | Note |
|---|---|---|---|---|---|---|---|---|---|---|---|
| SEQ ID NO: 529 | LERPLHTKFRILF VI | FLH TKF RIL | GTF2I L424H | SEQ ID NO: 23315 | LERILH AKERIR FVI | ILHA KERI R | I1F | A4T | E6F | R9L | Individual GTF2I_L424H Vaccine (5-peptide); Individual GTF2I_L424H Vaccine (5-peptide, Set 2) |
| SEQ ID NO: 530 | LERIIHASERIRV | IHAS ERIR V | GTF2I L424H | SEQ ID NO: 23315 | LERILH AKERIR FVI | LHAK ERIRF | L1I | K4S | — | F9V | Individual GTF2I_L424H Vaccine (5-peptide) |
| SEQ ID NO: 531 | PRLERIFHANEF IRVVIKKH | FHA NEFI RV | GTF2I L424H | SEQ ID NO: 23335 | PRLERI LHAKE RIRFVI KKH | LHAK ERIRF | L1F | K4N | R6F | F9V | Individual GTF2I_L424H Vaccine (5-peptide) |
| SEQ ID NO: 532 | YGIFRLVRLLHT | FRL VRLL HT | GTF2I L424H | SEQ ID NO: 23405 | YGIPRL ERILHA KER | PRLE RILH A | P1F | E4V | I6L | A9T | Individual GTF2I_L424H Vaccine (5-peptide); Individual GTF2I_L424H Vaccine (5-peptide, Set 2) |
| SEQ ID NO: 533 | LERIIHASERIRL VI | IHAS ERIR L | GTF2I L424H | SEQ ID NO: 23315 | LERILH AKERIR FVI | LHAK ERIRF | L1I | K4S | — | F9L | Individual GTF2I_L424H Vaccine (5-peptide, Set 2) |
| SEQ ID NO: 534 | PRLERILHAAEFI RVVIKKH | LHA AEFI RV | GTF2I L424H | SEQ ID NO: 23335 | PRLERI LHAKE RIRFVI KKH | LHAK ERIRF | — | K4A | R6F | F9V | Individual GTF2I_L424H Vaccine (5-peptide, Set 2) |
| SEQ ID NO: 535 | GWVKPLIIMCN AYRD | LIIM CNA YR | IDH1 R132C | SEQ ID NO: 23418 | GWVK PIIIGC HAYGD | IIIGC HAY G | I1L | G4M | H6N | G9R | Individual IDH1_R132C Vaccine (5-peptide); Brain Cancer Vaccine (20-peptide); Individual IDH1_R132C Vaccine (5-peptide, Set 2) |

TABLE 2-continued

Example Vaccine Peptides (MHC class II)

| SEQ ID NO | Sequence corresponding to SEQ ID | Core | Target | Seed SEQ ID NO | Seed | Seed Core | Heteroclitic Modification P1 | Heteroclitic Modification P4 | Heteroclitic Modification P6 | Heteroclitic Modification P9 | Note |
|---|---|---|---|---|---|---|---|---|---|---|---|
| SEQ ID NO: 536 | GWVKPMIILCRAYHD | MIILCRAYH | IDH1 R132C | SEQ ID NO: 23418 | GWVKPIIIGCHAYGD | IIIGCHAYG | I1M | G4L | H6R | G9H | Individual IDH1_R132C Vaccine (5-peptide); Brain Cancer Vaccine (20-peptide) |
| SEQ ID NO: 537 | PRLVSGWVKPVIINCPAYID | VIINCPAYI | IDH1 R132C | SEQ ID NO: 23456 | PRLVSGWVKPIIIGCHAYGD | IIIGCHAYG | I1V | G4N | H6P | O9I | Individual IDH1_R132C Vaccine (5-peptide); Brain Cancer Vaccine (20-peptide) |
| SEQ ID NO: 538 | VKPFIIMCKAYHDQY | FIIMCKAYH | IDH1 R132C | SEQ ID NO: 23482 | VKPIIIGCHAYGDQY | IIIGCHAYG | I1F | G4M | H6K | G9H | Individual IDH1_R132C Vaccine (5-peptide); Individual IDH1_R132C Vaccine (5-peptide, Set 2) |
| SEQ ID NO: 539 | VKPVIILCRAYHDQY | VIILCRAYH | IDH1 R132C | SEQ ID NO: 23482 | VKPIIIGCHAYGDQY | IIIGCHAYG | I1V | G4L | H6R | G9H | Individual IDH1_R132C Vaccine (5-peptide); Brain Cancer Vaccine (20-peptide) |
| SEQ ID NO: 540 | GWVKPIIACRAYHD | MACRAYH | IDH1 R132C | SEQ ID NO: 23418 | GWVKPIIIGCHAYGD | IIIGCHAYG | — | G4A | H6R | G9H | Individual IDH1_R132C Vaccine (5-peptide, Set 2) |
| SEQ ID NO: 541 | PRLVSGWVKPIIINCSAYID | IIINCSAYI | IDH1 R132C | SEQ ID NO: 23456 | PRLVSGWVKPIIIGCHAYGD | IIIGCHAYG | — | G4N | H6S | G9I | Individual IDH1_R132C Vaccine (5-peptide, Set 2) |
| SEQ ID NO: 542 | VKPIIIACRAYHDQY | MACRAYH | IDH1 R132C | SEQ ID NO: 23482 | VKPIIIGCHAYGDQY | IIIGCHAYG | — | G4A | H6R | G9H | Individual IDH1_R132C Vaccine (5-peptide, Set 2) |

TABLE 2-continued

Example Vaccine Peptides (MHC class II)

| SEQ ID NO | Sequence corresponding to SEQ ID | Core | Target | Seed SEQ ID NO | Seed | Seed Core | Heteroclitic Modification P1 | Heteroclitic Modification P4 | Heteroclitic Modification P6 | Heteroclitic Modification P9 | Note |
|---|---|---|---|---|---|---|---|---|---|---|---|
| SEQ ID NO: 543 | GWVKPFIIAHRAYSD | FHAHRAYS | IDH1 R132H | SEQ ID NO: 23514 | GWVKPIIIGHHAYGD | HIGHHAYG | I1F | G4A | H6R | Q9S | Individual IDH1_R132H Vaccine (5-peptide); Brain Cancer Vaccine (20-peptide); Individual IDH1_R132H Vaccine (5-peptide, Set 2) |
| SEQ ID NO: 544 | GWVKPFIIMHTAYRD | FIIMHTAYR | IDH1 R132H | SEQ ID NO: 23514 | GWVKPIIIGHHAYGD | HIGHHAYG | I1F | G4M | H6T | G9R | Individual IDH1_R132H Vaccine (5-peptide); Brain Cancer Vaccine (20-peptide); Individual IDH1_R132H Vaccine (5-peptide, Set 2) |
| SEQ ID NO: 545 | PRLVSGWVKPFIINHSAYID | FIINHSAYI | IDH1 R132H | SEQ ID NO: 23574 | PRLVSGWVKPIIIGHHAYGD | HIGHHAYG | I1F | G4N | H6S | G9I | Individual IDH1_R132H Vaccine (5-peptide); Brain Cancer Vaccine (20-peptide) |
| SEQ ID NO: 546 | RLVSGWVKPFIIAHPAYNDQ | FHAHFAYN | IDH1 R132H | SEQ ID NO: 23584 | RLVSGWVKPIIIGHHAYGDQ | HIGHHAYG | I1F | G4A | H6F | G9N | Individual IDH1_R132H Vaccine (5-peptide); Brain Cancer Vaccine (20-peptide) |
| SEQ ID NO: 547 | RLVSGWVKPFIIAHPAYVDQ | FHAHPAYV | IDH1 R132H | SEQ ID NO: 23584 | RLVSGWVKPIIIGHHAYGDQ | HIGHHAYG | I1F | G4A | H6P | G9V | Individual IDH1_R132H Vaccine (5-peptide); Brain Cancer Vaccine (5-peptide, Set 2) |

TABLE 2-continued

Example Vaccine Peptides (MHC class II)

| SEQ ID NO | Sequence corresponding to SEQ ID | Core | Target | Seed SEQ ID NO | Seed | Seed Core | Heteroclitic Modification P1 | Heteroclitic Modification P4 | Heteroclitic Modification P6 | Heteroclitic Modification P9 | Note |
|---|---|---|---|---|---|---|---|---|---|---|---|
| SEQ ID NO: 548 | GWVKPIIMHS AYRD | IIIM HSA YR | IDH1 R132H | SEQ ID NO: 23514 | GWVK PIIIGH HAYGD | HIGH HAY G | — | G4M | H6S | G9R | Brain Cancer Vaccine (20-peptide) |
| SEQ ID NO: 549 | PRLVSGWIKPAI VGHAAYGD | IKPA IVG HA | IDH1 R132H | SEQ ID NO: 23574 | PRLVS GWVK PIIIGH HAYGD | VKPII IGHH | V1I | I4A | I6V | H9A | Brain Cancer Vaccine (20-peptide) |
| SEQ ID NO: 550 | PRLVSGWVKPF IINHFAYYD | FIIN HFA YY | IDH1 R132H | SEQ ID NO: 23574 | PRLVS GWVK PIIIGH HAYGD | HIGH HAY G | I1F | G4N | H6F | G9Y | Brain Cancer Vaccine (20-peptide) |
| SEQ ID NO: 551 | RLVSGWVKPFII AHPAYADQ | FHA HPA YA | IDH1 R132H | SEQ ID NO: 23584 | RLVSG WVKPI IGHH AYGD Q | HIGH HAY G | I1F | G4A | H6P | G9A | Brain Cancer Vaccine (20-peptide) |
| SEQ ID NO: 552 | PRLVSGWVKPF IINHAAYID | FIIN HAA YI | IDH1 R132H | SEQ ID NO: 23574 | PRLVS GWVK PIIIGH HAYGD | HIGH HAY G | I1F | G4N | H6A | G9I | Individual IDH1_R132H Vaccine (5-peptide, Set 2) |
| SEQ ID NO: 553 | RLVSGWVKPFII NHFAYVDQ | FIIN HFA YV | IDH1 R132H | SEQ ID NO: 23584 | RLVSG WVKPI IGHH AYGD Q | HIGH HAY G | I1F | G4N | H6F | G9V | Individual IDH1_R132H Vaccine (5-peptide, Set 2) |
| SEQ ID NO: 554 | EYKFVVIGNAG AGKSA | FVVI GNA GA | KRAS G12A | SEQ ID NO: 23635 | EYKLV VVGAA GVGKS A | LVVV GAA GV | L1F | V4I | A6N | V9A | Individual KRAS_G12A Vaccine (5-peptide); Bronchus And Lung Cancer Vaccine (30-peptide); Individual KRAS_G12A Vaccine (5-peptide, Set 2) |
| SEQ ID NO: 555 | TEYKFVVIG NA GVGK | FVVI GNA GV | KRAS G12A | SEQ ID NO: 23675 | TEYKL VVVGA AGVGK | LVVV GAA GV | L1F | V4I | A6N | — | Individual KRAS_G12A Vaccine (5- |

TABLE 2-continued

Example Vaccine Peptides (MHC class II)

| SEQ ID NO | Sequence corresponding to SEQ ID | Core | Target | Seed SEQ ID NO | Seed | Seed Core | Heteroclitic Modification P1 | Heteroclitic Modification P4 | Heteroclitic Modification P6 | Heteroclitic Modification P9 | Note |
|---|---|---|---|---|---|---|---|---|---|---|---|
| | | | | | | | | | | | peptide); Bronchus And Lung Cancer Vaccine (30-peptide); Individual KRAS_G12A Vaccine (5-peptide, Set 2) |
| SEQ ID NO: 556 | TEYKIVVIGRAG HGK | IVVI GRA GH | KRAS G12A | SEQ ID NO: 23675 | TEYKL VVVGA AGVGK | LVVV GAA GV | L1I | V4I | A6R | V9H | Individual KRAS_G12A Vaccine (5-peptide); Bronchus And Lung Cancer Vaccine (30-peptide); Individual KRAS_G12A Vaccine (5-peptide, Set 2) |
| SEQ ID NO: 557 | TEYKLVVLGNA GYGK | LVV LGN AGY | KRAS G12A | SEQ ID NO: 23675 | TEYKL VVVGA AGVGK | LVVV GAA GV | — | V4L | A6N | V9Y | Individual KRAS_G12A Vaccine (5-peptide) |
| SEQ ID NO: 558 | TEYKMVVYGN AGLGK | MV VYG NAG L | KRAS G12A | SEQ ID NO: 23675 | TEYKL VVVGA AGVGK | LVVV GAA GV | L1M | V4Y | A6N | V9L | Bronchus And Lung Cancer Vaccine (30-peptide) |
| SEQ ID NO: 559 | TEYKIVVLGNA GYGK | IVVL GNA GY | KRAS G12A | SEQ ID NO: 23675 | TEYKL VVVGA AGVGK | LVVV GAA GV | L1I | V4L | A6N | V9Y | Individual KRAS_G12A Vaccine (5-peptide, Set 2) |
| SEQ ID NO: S6G | TEYKIVVWGNA GVGK | IVV WG NAG V | KRAS G12A | SEQ ID NO: 23675 | TEYKL VVVGA AGVGK | LVVV GAA GV | L1I | V4W | A6N | — | Individual KRAS_G12A Vaccine (5-peptide, Set 2) |

TABLE 2-continued

Example Vaccine Peptides (MHC class II)

| SEQ ID NO | Sequence corresponding to SEQ ID | Core | Target | Seed SEQ ID NO | Seed | Seed Core |

TABLE 2-continued

Example Vaccine Peptides (MHC class II)

| SEQ ID NO | Sequence corresponding to SEQ ID | Core | Target | Seed SEQ ID NO | Seed | Seed Core | Heteroclitic Modification P1 | Heteroclitic Modification P4 | Heteroclitic Modification P6 | Heteroclitic Modification P9 | Note |
|---|---|---|---|---|---|---|---|---|---|---|---|
| SEQ ID NO: 567 | EYKLVVLGSCG AGKS | LVV LOS CGA | KRAS G12C | SEQ ID NO: 23702 | EYKLV VVGAC GVGKS | LVVV GAC GV | — | V4L | A6S | V9A | Individual KRAS_G12C Vaccine (5-peptide, Set 2) |
| SEQ ID NO: 568 | KLIVIGICRVGH SAL | IVGI CRV OH | KRAS G12C | SEQ ID NO: 23713 | KLVVV GACGV GKSAL | VVG ACGV GK | V1I | A4I | G6R | K9H | Individual KRAS_G12C Vaccine (5-peptide, Set 2) |
| SEQ ID NO: 569 | EYKFVVFGSDG AGKS | FVV FGS DGA KS | KRAS G12D | SEQ ID NO: 23752 | EYKLV VVGA DGVG | LVVV GAD GV | L1F | V4F | A6S | V9A | Individual KRAS_G12D Vaccine (5-peptide); Pancreatic Cancer Vaccine (20-peptide); Bronchus And Lung Cancer Vaccine (30-peptide); Colorectal Cancer Vaccine (30-peptide); Individual KRAS_G12D Vaccine (5-peptide, Set 2) |
| SEQ ID NO: 570 | EYKFVVIGNDG AGKSALITIQLIQ N | FVVI GND GA | KRAS G12D | SEQ ID NO: 23761 | EYKLV VVGA DGVG KSALTI QLIQN | LVVV GAD GV | L1F | V4I | A6N | V9A | Individual KRAS_G12D Vaccine (5-peptide); Pancreatic Cancer Vaccine (20-peptide); Bronchus And Lung Cancer Vaccine (30-peptide); Colorectal Cancer Vaccine (30-peptide); Individual KRAS_G12D Vaccine (5-peptide, Set 2) |

TABLE 2-continued

Example Vaccine Peptides (MHC class II)

| SEQ ID NO | Sequence corresponding to SEQ ID | Core | Target | Seed SEQ ID NO | Seed | Seed Core | Heteroclitic Modification P1 | Heteroclitic Modification P4 | Heteroclitic Modification P6 | Heteroclitic Modification P9 | Note |
|---|---|---|---|---|---|---|---|---|---|---|---|
| SEQ ID NO: 571 | EYKFVVLGADGAGKS | FVV LGA DGA | KRAS G12D | SEQ ID NO: 23752 | EYKLV VVGA DGVG KS | LVVV GAD GV | L1F | V4L | — | V9A | Individual KRAS_G12D Vaccine (5-peptide); Pancreatic Cancer Vaccine (20-peptide); Bronchus And Lung Cancer Vaccine (30-peptide); Colorectal Cancer Vaccine (30-peptide) |
| SEQ ID NO: 572 | MTEYKFVVSGADGIGKSALT | FVV SGA DGI | KRAS G12D | SEQ ID NO: 23780 | MTEYK LVVVG ADGV GKSAL T | LVVV GAD GV | L1F | V4S | — | V9I | Individual KRAS_G12D Vaccine (5-peptide); Pancreatic Cancer Vaccine (20-peptide); Bronchus And Lung Cancer Vaccine (30-peptide); Colorectal Cancer Vaccine (30-peptide) |
| SEQ ID NO: 573 | MTEYKFVVYGSDGIGKSALT | FVV YGS DGI | KRAS G12D | SEQ ID NO: 23780 | MTEYK LVVVG ADGV GKSAL T | LVVV GAD GV | L1F | V4Y | A6S | V9I | Individual KRAS_G12D Vaccine (5-peptide, Set 2); Pancreatic Cancer Vaccine (20-peptide); Bronchus And Lung Cancer Vaccine (30-peptide); Colorectal |

TABLE 2-continued

Example Vaccine Peptides (MHC class II)

| SEQ ID NO | Sequence corresponding to SEQ ID | Core | Target | Seed SEQ ID NO | Seed | Seed Core | Heteroclitic Modification P1 | Heteroclitic Modification P4 | Heteroclitic Modification P6 | Heteroclitic Modification P9 | Note |
|---|---|---|---|---|---|---|---|---|---|---|---|
| | | | | | | | | | | | Cancer Vaccine (30-peptide) |
| SEQ ID NO: 574 | MTEYKIVVMGI DGAGKSALT | IVV MGI DGA | KRAS G12D | SEQ ID NO: 23780 | MTEYK LVVVG ADGV GKSAL T | LVVV GAD GV | L1I | V4M | A6I | V9A | Pancreatic Cancer Vaccine (20-peptide); Colorectal Cancer Vaccine (30-peptide) |
| SEQ ID NO: 575 | EYKFVVSGADG IGKS | FVV SGA DGI | KRAS G12D | SEQ ID NO: 23752 | EYKLV VVGA DGVG KS | LVVV GAD GV | L1F | V4S | — | V9I | Colorectal Cancer Vaccine (30-peptide) |
| SEQ ID NO: 576 | EYKIVVMGAD GLGKS | IVV MG ADG L | KRAS G12D | SEQ ID NO: 23752 | EYKLV VVGA DGVG KS | LVVV GAD GV | L1I | V4M | — | V9L | Individual KRAS_G12D Vaccine (5-peptide, Set 2) |
| SEQ ID NO: 577 | MTEYKFVVYG NDGVGKSALT | FVV YGN DGV | KRAS G12D | SEQ ID NO: 23780 | MTEYK LVVVG ADGV GKSAL T | LVVV GAD GV | L1F | V4Y | A6N | — | Individual KRAS_G12D Vaccine (5-peptide, Set 2) |
| SEQ ID NO: 578 | TEYKFVVIGNR GLGK | FVVI GNR GL | KRAS G12R | SEQ ID NO: 23858 | TEYKL VVVGA RGVGK | LVVV GAR GV | L1F | V4I | A6N | V9L | Individual KRAS_G12R Vaccine (5-peptide); Pancreatic Cancer Vaccine (20-peptide); Individual KRAS_G12R Vaccine (5-peptide, Set 2) |
| SEQ ID NO: 579 | TEYKFVVTGFR GLGKSALTI | FVV TGF RGL | KRAS G12R | SEQ ID NO: 23863 | TEYKL VVVGA RGVGK SALTI | LVVV GAR GV | L1F | V4T | A6F | V9L | Individual KRAS_G12R Vaccine (5-peptide); Pancreatic Cancer Vaccine (20-peptide); Individual KRAS_G12R |

TABLE 2-continued

Example Vaccine Peptides (MHC class II)

| SEQ ID NO | Sequence corresponding to SEQ ID | Core | Target | Seed SEQ ID NO | Seed | Seed Core | Heteroclitic Modification P1 | Heteroclitic Modification P4 | Heteroclitic Modification P6 | Heteroclitic Modification P9 | Note |
|---|---|---|---|---|---|---|---|---|---|---|---|
| SEQ ID NO: 580 | TEYKIVVAGAR GSGK | IVV AGA RGS | KRAS G12R | SEQ ID NO: 23858 | TEYKL VVVGA RGVGK | LVVV GAR GV | L1I | V4A | — | V9S | Vaccine (5-peptide, Set 2) |
| SEQ ID NO: 581 | TEYKLVVIGTRG AGKSALTI | LVVI GTR GA | KRAS G12R | SEQ ID NO: 23863 | TEYKL VVVGA RGVGK SALTI | LVVV GAR GV | — | V4I | A6T | V9A | Individual KRAS_G12R Vaccine (5-peptide); Pancreatic Cancer Vaccine (20-peptide) |
| SEQ ID NO: 582 | TEYRLVSVFARS VGKSALTI | RLV SVF ARS | KRAS G12R | SEQ ID NO: 23863 | TEYKL VVVGA RGVGK SALTI | KLVV VGA RG | K1R | V4S | G6F | G9S | Individual KRAS_G12R Vaccine (5-peptide); Pancreatic Cancer Vaccine (20-peptide) |
| SEQ ID NO: 583 | TEYKFVVIGRR GSGK | FVVI GRR GS | KRAS G12R | SEQ ID NO: 23858 | TEYKL VVVGA RGVGK | LVVV GAR GV | L1F | V4I | A6R | V9S | Pancreatic Cancer Vaccine (20-peptide) |
| SEQ ID NO: 584 | TEYKLVVLGMR GYGK | LVV LGM ROY | KRAS G12R | SEQ ID NO: 23858 | TEYKL VVVGA RGVGK | LVVV GAR GV | — | V4L | A6M | V9Y | Pancreatic Cancer Vaccine (20-peptide) |
| SEQ ID NO: 585 | TEYKFVVIGTRG AGKSALTI | FVVI GTR GA | KRAS G12R | SEQ ID NO: 23863 | TEYKL VVVGA RGVGK SALTI | LVVV GAR GV | L1F | V4I | A6T | V9A | Pancreatic Cancer Vaccine (20-peptide) |
| SEQ ID NO: 586 | TEYKIVVAGAR GAGK | IVV AGA RGA | KRAS G12R | SEQ ID NO: 23858 | TEYKL VVVGA RGVGK | LVVV GAR GV | L1I | V4A | — | V9A | Individual KRAS_G12R Vaccine (5-peptide, Set 2) |
| SEQ ID NO: 587 | TEYRLVSVLARE VGKSALTI | RLV SVL | KRAS G12R | SEQ ID NO: | TEYKL VVVGA | KLVV VGA | K1R | V4S | G6L | G9E | Individual KRAS_G12R |

TABLE 2-continued

Example Vaccine Peptides (MHC class II)

| SEQ ID NO | Sequence corresponding to SEQ ID | Core | Target | Seed SEQ ID NO | Seed | Seed Core | Heteroclitic Modification P1 | Heteroclitic Modification P4 | Heteroclitic Modification P6 | Heteroclitic Modification P9 | Note |
|---|---|---|---|---|---|---|---|---|---|---|---|
| | | ARE | | 23863 | RGVGK SALTI | RG | | | | | Vaccine (5-peptide, TABLE 2-continued Example Vaccine Peptides (MHC class II)

| SEQ ID NO | Sequence corresponding to SEQ ID | Core | Target | Seed SEQ ID NO | Seed | Seed Core | Heteroclitic Modification P1 | Heteroclitic Modification P4 | Heteroclitic Modification P6 | Heteroclitic Modification P9 | Note |
|---|---|---|---|---|---|---|---|---|---|---|---|
| SEQ ID NO: 595 | YKIVVLGASGF | IVVL GAS GF | KRAS G12S | SEQ ID NO: 23947 | YKLVV VGASG VGKSA | LVVV GASG V | L1I | V4L | — | V9F | Individual KRAS_G12S Vaccine (5-peptide, Set 2) |
| SEQ ID NO: 596 | EYKFVVIGRVG | FVVI GRV GH | KRAS G12V | SEQ ID NO: 23960 | EYKLV VVGAV GVGKS | LVVV GAV GV | L1F | V4I | A6R | V9H | Individual KRAS_G12V Vaccine (5-peptide); Pancreatic Cancer Vaccine (20-peptide); Bronchus And Lung Cancer Vaccine (30-peptide); Colorectal Cancer Vaccine (30-peptide); Individual KRAS_G12V Vaccine (5-peptide, Set 2) |
| SEQ ID NO: 597 | EYKFVVLGTVG | FVV LGT VGH | KRAS G12V | SEQ ID NO: 23960 | EYKLV VVGAV GVGKS | LVVV GAV GV | L1F | V4L | A6T | V9H | Individual KRAS_G12V Vaccine (5-peptide); Pancreatic Cancer Vaccine (20-peptide); Bronchus And Lung Cancer Vaccine (30-peptide); Colorectal Cancer Vaccine (30-peptide); Individual KRAS_G12V Vaccine (5-peptide, Set 2) |
| SEQ ID NO: 598 | EYKFVVYGNVG VGKS | FVV YGN VGV | KRAS G12V | SEQ ID NO: 23960 | EYKLV VVGAV GVGKS | LVVV GAV GV | L1F | V4Y | A6N | — | Individual KRAS_G12V Vaccine (5-peptide); |

TABLE 2-continued

Example Vaccine Peptides (MHC class II)

| SEQ ID NO | Sequence corresponding to SEQ ID | Core | Target | Seed SEQ ID NO | Seed | Seed Core | Heteroclitic Modification P1 | Heteroclitic Modification P4 | Heteroclitic Modification P6 | Heteroclitic Modification P9 | Note |
|---|---|---|---|---|---|---|---|---|---|---|---|
| | | | | | | | | | | | Pancreatic Cancer Vaccine (20-peptide); Bronchus And Lung Cancer Vaccine (30-peptide); Colorectal Cancer Vaccine (30-peptide) |
| SEQ ID NO: 599 | EYKIVVAGNVG IGKS | IVV AGN VGI | KRAS G12V | SEQ ID NO: 23960 | EYKLV VVGAV GVGKS | LVVV GAV GV | L1I | V4A | A6N | V9I | Individual KRAS_G12V Vaccine (5-peptide); Pancreatic Cancer Vaccine (20-peptide); Bronchus And Lung Cancer Vaccine (30-peptide); Colorectal Cancer Vaccine (30-peptide); Individual KRAS_G12V Vaccine (5-peptide, Set 2) |
| SEQ ID NO: 600 | TEYKIVVMGNV GYGK | IVV MG NVG Y | KRAS G12V | SEQ ID NO: 24001 | TEYKL VVVGA VGVGK | LVVV GAV GV | L1I | V4M | A6N | V9Y | Individual KRAS_012V Vaccine (5-peptide); Bronchus And Lung Cancer Vaccine (30-peptide); Individual KRAS_G12V Vaccine (5-peptide, Set 2) |
| SEQ ID NO: 601 | EYKFVVNGAVG VGKS | FVV NGA VGV | KRAS G12V | SEQ ID NO: 23960 | EYKLV VVGAV GVGKS | LVVV GAV GV | L1F | V4N | — | — | Pancreatic Cancer Vaccine (20-peptide); Colorectal |

TABLE 2-continued

Example Vaccine Peptides (MHC class II)

| SEQ ID NO | Sequence corresponding to SEQ ID | Core | Target | Seed SEQ ID NO | Seed | Seed Core | Heteroclitic Modification P1 | Heteroclitic Modification P4 | Heteroclitic Modification P6 | Heteroclitic Modification P9 | Note |
|---|---|---|---|---|---|---|---|---|---|---|---|
| | | | | | | | | | | | Cancer Vaccine (30-peptide) |
| SEQ ID NO: 602 | EYKIVVMGNV GYGKS | IVV MG NVG Y | KRAS G12V | SEQ ID NO: 23960 | EYKLV VVGAV GVGKS | LVVV GAV GV | L1I | V4M | A6N | V9Y | Pancreatic Cancer Vaccine (20-peptide); Colorectal Cancer Vaccine (30-peptide) |
| SEQ ID NO: 603 | EYKLVLGRVG HGKS | LVV LGR VG H | KRAS G12V | SEQ ID NO: 23960 | EYKLV VVGAV GVGKS | LVVV GAV GV | — | V4L | A6R | V9H | Pancreatic Cancer Vaccine (20-peptide); Colorectal Cancer Vaccine (30-peptide) |
| SEQ ID NO: 604 | EYKFVVIGSVG AGKS | FVVI GSV GA | KRAS G12V | SEQ ID NO: 23960 | EYKLV VVGAV GVGKS | LVVV GAV GV | L1F | V4I | A6S | V9A | Colorectal Cancer Vaccine (30-peptide) |
| SEQ ID NO: 605 | EYKFVVWGNV G LGKS | FVV WG NVG L | KRAS G12V | SEQ ID NO: 23960 | EYKLV VVGAV GVGKS | LVVV GAV GV | L1F | V4W | A6N | V9L | Individual KRAS_G12V Vaccine (5-peptide, Set 2) |
| SEQ ID NO: 606 | EYKFVVMGNG DSGKS | FVV MG NGD S | KRAS G13D | SEQ ID NO: 24028 | EYKLV VVGA GDVG KS | LVVV GAG DV | L1F | V4M | A6N | V9S | Individual KRAS_G 13D Vaccine (5-peptide); Colorectal Cancer Vaccine (30-peptide); Individual KRAS_G 13D Vaccine (5-peptide, Set 2) |
| SEQ ID NO: 607 | EYKFVVSGSGD VGKS | FVV SGS GDV | KRAS G13D | SEQ ID NO: 24028 | EYKLV VVGA GDVG KS | LVVV GAG DV | L1F | V4S | A6S | — | Individual KRAS_G 13D Vaccine (5-peptide); Colorectal Cancer Vaccine (30-peptide) |

TABLE 2-continued

Example Vaccine Peptides (MHC class II)

| SEQ ID NO | Sequence corresponding to SEQ ID | Core | Target | Seed SEQ ID NO | Seed | Seed Core | Heteroclitic Modification P1 | Heteroclitic Modification P4 | Heteroclitic Modification P6 | Heteroclitic Modification P9 | Note |
|---|---|---|---|---|---|---|---|---|---|---|---|
| SEQ ID NO: 608 | EYKFVVYGSGD LGKS | FVV YGS GDL | KRAS G13D | SEQ ID NO: 24028 | EYKLV VVGA GDVG KS | LVVV GAG DV | L1F | V4Y | A6S | V9L | Individual KRAS_G 13D Vaccine (5-peptide); Colorectal Cancer Vaccine (30-peptide) |
| SEQ ID NO: 609 | EYKIVVMGRGD MGKS | IVV MG RGD M | KRAS G13D | SEQ ID NO: 24028 | EYKLV VVGA GDVG KS | LVVV GAG DV | L1I | V4M | A6R | V9M | Individual KRAS_G 13D Vaccine (5-peptide); Colorectal Cancer Vaccine (30-peptide) |
| SEQ ID NO: 610 | EYKLIVVSANDV AKS | IVVS AND VA | KRAS G13D | SEQ ID NO: 24028 | EYKLV VVGA GDVG KS | VVV GAG DVG | V1I | G4S | G6N | G9A | Colorectal Cancer Vaccine (30-peptide) |
| SEQ ID NO: 611 | EYKLVVLGAGD AGKS | LVV LGA GDA | KRAS G13D | SEQ ID NO: 24028 | EYKLV VVGA GDVG KS | LVVV GAG DV | — | V4L | — | V9A | Colorectal Cancer Vaccine (30-peptide) |
| SEQ ID NO: 612 | TEYKFVVVGFG DLGKSALTIQLI QN | FVV VGF GDL | KRAS G13D | SEQ ID NO: 24088 | TEYKL VVVGA GDVG KSALTI QLIQN | LVVV GAG DV | L1F | — | A6F | V9L | Colorectal Cancer Vaccine (30-peptide) |
| SEQ ID NO: 613 | EYKFVVAGNG DIGKS | FVV AGN GDI | KRAS G13D | SEQ ID NO: 24028 | EYKLV VVGA GDVG KS | LVVV GAG DV | L1F | V4A | A6N | V9I | Individual KRAS_G 13D Vaccine (5-peptide, Set 2) |
| SEQ ID NO: 614 | EYKFVVFGNGD VGKS | FVV FGN GDV | KRAS G13D | SEQ ID NO: 24028 | EYKLV VVGA GDVG KS | LVVV GAG DV | L1F | V4F | A6N | — | Individual KRAS_G 13D Vaccine (5-peptide, Set 2) |
| SEQ ID NO: 615 | EYKIVVIGRGD MGKS | IVVI GRG DM | KRAS G13D | SEQ ID NO: 24028 | EYKLV VVGA GDVG KS | LVVV GAG DV | L1I | V4I | A6R | V9M | Individual KRAS_G 13D Vaccine (5-peptide, Set 2) |

TABLE 2-continued

Example Vaccine Peptides (MHC class II)

| SEQ ID NO | Sequence corresponding to SEQ ID | Core | Target | Seed SEQ ID NO | Seed | Seed Core | Heteroclitic Modification P1 | Heteroclitic Modification P4 | Heteroclitic Modification P6 | Heteroclitic Modification P9 | Note |
|---|---|---|---|---|---|---|---|---|---|---|---|
| SEQ ID NO: 616 | LDILNTAGKVEY AAMRDQYM | NTA GKV EYA | NRAS Q61K | SEQ ID NO: 24166 | LDILDT AGKEE YSAMR DQYM | DTAG KEEY S | D1N | — | E6V | S9A | Individual NRAS_Q61K Vaccine (5-peptide); Skin Cancer Vaccine (20-peptide); Thyroid Cancer Vaccine (10-peptide) |
| SEQ ID NO: 617 | LDILNTASKIEY AAMRDQYM | NTA SKIE YA | NRAS Q61K | SEQ ID NO: 24166 | LDILDT AGKEE YSAMR DQYM | DTAG KEEY S | D1N | G4S | E6I | S9A | Individual NRAS_Q61K Vaccine (5-peptide) |
| SEQ ID NO: 618 | LLDFLDIAGKEV YSA | FLDI AGK EV | NRAS Q61K | SEQ ID NO: 24167 | LLDILD TAGKE EYSA | ILDT AGKE E | I1F | T4I | — | E9V | Individual NRAS_Q61K Vaccine (5-peptide) |
| SEQ ID NO: 619 | LLDYLDMATKE LYSA | YLD MAT KEL | NRAS Q61K | SEQ ID NO: 24167 | LLDILD TAGKE EYSA | ILDT AGKE E | I1Y | T4M | G6T | E9L | Individual NRAS_Q61K Vaccine (5-peptide); Skin Cancer Vaccine (20-peptide); Thyroid Cancer Vaccine (10-peptide) |
| SEQ ID NO: 620 | QVVIDGETCLL DFLDTAFKELYS AM | FLD TAF KEL | NRAS Q61K | SEQ ID NO: 24174 | QVVID GETCL LDILDT AGKEE YSAM | ILDT AGKE E | I1F | — | G6F | E9L | Individual NRAS_Q61K Vaccine (5-peptide); Skin Cancer Vaccine (20-peptide); Thyroid Cancer Vaccine (10-peptide); Individual NRAS_Q61K Vaccine (5-peptide, Set 2) |

TABLE 2-continued

Example Vaccine Peptides (MHC class II)

| SEQ ID NO | Sequence corresponding to SEQ ID | Core | Target | Seed SEQ ID NO | Seed | Seed Core | Heteroclitic Modification P1 | Heteroclitic Modification P4 | Heteroclitic Modification P6 | Heteroclitic Modification P9 | Note |
|---|---|---|---|---|---|---|---|---|---|---|---|
| SEQ ID NO: 621 | LDILNTAAKIEY AAMRDQYM | NTA AKIE YA | NRAS Q61K | SEQ ID NO: 24166 | LDILDT AGKEE YSAMR DQYM | DTAG KEEY S | D1N | G4A | E6I | S9A | Individual NRAS_Q61K Vaccine (5-peptide, Set 2) |
| SEQ ID NO: 622 | LLDFLDAAAKEL YSA | FLD AAA KEL | NRAS Q61K | SEQ ID NO: 24167 | LLDILD TAGKE EYSA | ILDT AGKE E | I1F | T4A | G6A | E9L | Individual NRAS_Q61K Vaccine (5-peptide, Set 2) |
| SEQ ID NO: 623 | QVVIDGETCLL DFLDSAFKELYS AM | FLDS AFK EL | NRAS Q61K | SEQ ID NO: 24174 | QVVID GETCL LDILDT AGKEE YSAM | ILDT AGKE E | I1F | T4S | G6F | E9L | Individual NRAS_Q61K Vaccine (5-peptide, Set 2) |
| SEQ ID NO: 624 | QVVIDGETCLL DFLDTAFKEIYS AM | FLD TAF KEI | NRAS Q61K | SEQ ID NO: 24174 | QVVID GETCL LDILDT AGKEE YSAM | ILDT AGKE E | I1F | — | G6F | E9I | Individual NRAS_Q61K Vaccine (5-peptide, Set 2) |
| SEQ ID NO: 625 | GETCLLDFLDTA FLEY | FLD TAFL EY | NRAS Q61L | SEQ ID NO: 24224 | GETCL LDILDT AGLEE | ILDT AGLE E | I1F | — | G6F | E9Y | Individual NRAS_Q61L Vaccine (5-peptide); Skin Cancer Vaccine (20-peptide) |
| SEQ ID NO: 626 | LLDFLDVATLED YSA | FLD VAT LED | NRAS Q61L | SEQ ID NO: 24251 | LLDILD TAGLE EYSA | ILDT AGLE E | I1F | T4V | G6T | E9D | Individual NRAS_Q61L Vaccine (5-peptide); Skin Cancer Vaccine (20-peptide) |
| SEQ ID NO: 627 | LLDLLDMANLE AYSA | LLD MA NLE A | NRAS Q61L | SEQ ID NO: 24251 | LLDILD TAGLE EYSA | ILDT AGLE E | I1L | T4M | G6N | E9A | Individual NRAS_Q61L Vaccine (5-peptide); Skin Cancer Vaccine (20-peptide) |
| SEQ ID NO: 628 | TCLLDILNTAAL AEYAAMRD | NTA ALA EYA | NRAS Q61L | SEQ ID NO: 24264 | TCLLDI LDTAG LEEYSA MRD | DTAG LEEY S | D1N | G4A | E6A | S9A | Individual NRAS_Q61L Vaccine (5-peptide; Skin |

TABLE 2-continued

Example Vaccine Peptides (MHC class II)

| SEQ ID NO | Sequence corresponding to SEQ ID | Core | Target | Seed SEQ ID NO | Seed | Seed Core | Heteroclitic Modification P1 | Heteroclitic Modification P4 | Heteroclitic Modification P6 | Heteroclitic Modification P9 | Note |
|---|---|---|---|---|---|---|---|---|---|---|---|
| SEQ ID NO: 629 | TCLLDILNTAAL AEYSAMRD | NTA ALA EYS | NRAS Q61L | SEQ ID NO: 24264 | TCLLDI LDTAG LEEYSA MRD | DTAG LEEY S | D1N | G4A | E6A | — | Cancer Vaccine (20-peptide); Individual NRAS_Q61L Vaccine (5-peptide, Set 2) |
| SEQ ID NO: 630 | GETCLLDFLDH AFLEL | FLD HAF LEL | NRAS Q61L | SEQ ID NO: 24224 | GETCL LDILDT AGLEE | ILDT AGLE E | I1F | T4H | G6F | E9L | Individual NRAS_Q61L Vaccine (5-peptide, set 2) |
| SEQ ID NO: 631 | LLDFLDIANLED YSA | FLDI ANL ED | NRAS Q61L | SEQ ID NO: 24251 | LLDILD TAGLE EYSA | ILDT AGLE E | I1F | T4I | G6N | E9D | Individual NRAS_Q61L Vaccine (5-peptide, Set 2) |
| SEQ ID NO: 632 | LLDILDIANLESY SA | ILDI ANL ES | NRAS Q61L | SEQ ID NO: 24251 | LLDILD TAGLE EYSA | ILDT AGLE E | — | T4I | G6N | E9S | Individual NRAS_Q61L Vaccine (5-peptide, Set 2) |
| SEQ ID NO: 633 | TCLLDILNTAAL VEYAAMRD | NTA ALV EYA | NRAS Q61L | SEQ ID NO: 24264 | TCLLDI LDTAG LEEYSA MRD | DTAG LEEY S | D1N | G4A | E6V | S9A | Individual NRAS_Q61L Vaccine (5-peptide, Set 2) |
| SEQ ID NO: 634 | LDILVTAARIEY AAMRDQYM | VTA ARIE YA | NRAS Q61R | SEQ ID NO: 24317 | LDILDT AGREE YSAMR DQYM | DTAG REEY S | D1V | G4A | E6I | S9A | Individual NRAS_Q61R Vaccine (5-peptide); Skin Cancer Vaccine (20-peptide); Thyroid Cancer Vaccine (10-peptide) |
| SEQ ID NO: 635 | LDILVTASRIEYA AMRDQYM | VTA SRIE YA | NRAS Q61R | SEQ ID NO: 24317 | LDILDT AGREE YSAMR DQYM | DTAG REEY S | D1V | G4S | E6I | S9A | Individual NRAS_Q61R Vaccine (5-peptide) |

TABLE 2-continued

Example Vaccine Peptides (MHC class II)

| SEQ ID NO | Sequence corresponding to SEQ ID | Core | Target | Seed SEQ ID NO | Seed | Seed Core | Heteroclitic Modification P1 | Heteroclitic Modification P4 | Heteroclitic Modification P6 | Heteroclitic Modification P9 | Note |
|---|---|---|---|---|---|---|---|---|---|---|---|
| SEQ ID NO: 636 | LLDFLDAAVRE VYSA | FLD AAV REV | NRAS Q61R | SEQ ID NO: 24319 | LLDILD TAGRE EYSA | ILDT AGRE E | I1F | T4A | G6V | E9V | Individual NRAS_Q61R Vaccine (5-peptide) |
| SEQ ID NO: 637 | LLDFLDFAAREV YSA | FLDF AAR EV | NRAS Q61R | SEQ ID NO: 24319 | LLDILD TAGRE EYSA | ILDT AGRE E | I1F | T4F | G6A | E9V | Individual NRAS_Q61R Vaccine (5-peptide); Skin Cancer Vaccine (20-peptide); Thyroid Cancer Vaccine (10-peptide) |
| SEQ ID NO: 638 | TCLLDFLDEAFR EIYSAMRD | FLD EAF REI | NRAS Q61R | SEQ ID NO: 24332 | TCLLDI LDTAG REEYS AMRD | ILDT AGRE E | I1F | T4E | G6F | E9I | Individual NRAS_Q61R Vaccine (5-peptide) |
| SEQ ID NO: 639 | LLDFLDFAAREI YSA | FLDF AAR EI | NRAS Q61R | SEQ ID NO: 24319 | LLDILD TAGRE EYSA | ILDT AGRE E | I1F | T4F | G6A | E9I | Skin Cancer Vaccine (20-peptide) |
| SEQ ID NO: 640 | TCLLDFLDTAFR EVYSAMRD | FLD TAF REV | NRAS Q61R | SEQ ID NO: 24332 | TCLLDI LDTAG REEYS AMRD | ILDT AGRE E | I1F | — | G6F | E9V | Skin Cancer Vaccine (20-peptide); Thyroid Cancer Vaccine (10-peptide) |
| SEQ ID NO: 641 | LDILNTAARIEY AAMRDQYM | NTA ARIE YA | NRAS Q61R | SEQ ID NO: 24317 | LDILDT AGREE YSAMR DQYM | DTAG REEY S | D1N | G4A | E6I | S9A | Individual NRAS_Q61R Vaccine (5-peptide, Set 2) |
| SEQ ID NO: 642 | LLDFLDAAIREIY SA | FLD AAIR EI | NRAS Q61R | SEQ ID NO: 24319 | LLDILD TAGRE EYSA | ILDT AGRE E | I1F | T4A | G6I | E9I | Individual NRAS_Q61R Vaccine (5-peptide, Set 2) |
| SEQ ID NO: 643 | LLDFLDFAAREL YSA | FLDF AAR EL | NRAS Q61R | SEQ ID NO: 24319 | LLDILD TAGRE EYSA | ILDT AGRE E | I1F | T4F | G6A | E9L | Individual NRAS_Q61R Vaccine (5-peptide, Set 2) |

TABLE 2-continued

Example Vaccine Peptides (MHC class II)

| SEQ ID NO | Sequence corresponding to SEQ ID | Core | Target | Seed SEQ ID NO | Seed | Seed Core | Heteroclitic Modification P1 | Heteroclitic Modification P4 | Heteroclitic Modification P6 | Heteroclitic Modification P9 | Note |
|---|---|---|---|---|---|---|---|---|---|---|---|
| SEQ ID NO: 644 | LLDYLDAAGRE LYSA | YLD AAG REL | NRAS Q61R | SEQ ID NO: 24319 | LLDILD TAGRE EYSA | ILDT AGRE E | I1Y | T4A | — | E9L | Individual NRAS_Q61R Vaccine (5-peptide, Set 2) |
| SEQ ID NO: 645 | TCLLDFLDTAFR ELYSAM RD | FLD TAF REL | NRAS Q61R | SEQ ID NO: 24332 | TCLLDI LDTAG REEYS AMRD | ILDT AGRE E | I1F | — | G6F | E9L | Individual NRAS_Q61R Vaccine (5-peptide, Set 2) |
| SEQ ID NO: 646 | RDPPSKTFQE VDFLWSHRHY CVTI | FSKS TFQ EV | PIK3CA E542K | SEQ ID NO: 24362 | RDPLS KITEQE KDFLW SHRHY CVTI | LSKIT EQEK | L1F | I4S | E6F | K9V | Individual PIK3CA_E542K Vaccine (5-peptide) |
| SEQ ID NO: 647 | RDPPSKTFQEI DFLWSHRHYC VTI | FSKT TFQ EI | PIK3CA E542K | SEQ ID NO: 24362 | RDPLS KITEQE KDFLW SHRHY CVTI | LSKIT EQEK | L1F | I4T | E6F | K9I | Individual PIK3CA_E542K Vaccine (5-peptide); Individual PIK3CA_E542K Vaccine (1-peptide, Set 2) |
| SEQ ID NO: 648 | RDPPSKTFQEL DFLWSHRHYC VTI | FSKT TFQ EL | PIK3CA E542K | SEQ ID NO: 24362 | RDPLS KITEQE KDFLW SHRHY CVTI | LSKIT EQEK | L1F | I4T | E6F | K9L | Individual PIK3CA_E542K Vaccine (5-peptide) |
| SEQ ID NO: 649 | RDPPSKTFQE TDFLWSHRHYC VTI | FSKT TFQ ET | PIK3CA E542K | SEQ ID NO: 24362 | RDPLS KITEQE KDFLW SHRHY CVTI | LSKIT EQEK | L1F | I4T | E6F | K9T | Individual PIK3CA_E542K Vaccine (5-peptide) |
| SEQ ID NO: 650 | RDPPSKTFQE VDFLWSHRHY CVTI | FSKT TFQ EV | PIK3CA E542K | SEQ ID NO: 24362 | RDPLS KITEQE KDFLW SHRHY CVTI | LSKIT EQEK | L1F | I4T | E6F | K9V | Individual PIK3CA_E542K Vaccine (5-peptide); Bronchus And Lung Cancer Vaccine (30-peptide) |

TABLE 2-continued

Example Vaccine Peptides (MHC class II)

| SEQ ID NO | Sequence corresponding to SEQ ID | Core | Target | Seed SEQ ID NO | Seed | Seed Core | Heteroclitic Modification P1 | Heteroclitic Modification P4 | Heteroclitic Modification P6 | Heteroclitic Modification P9 | Note |
|---|---|---|---|---|---|---|---|---|---|---|---|
| SEQ ID NO: 651 | LSEIIKQWKAFL VSHRHYCV | IKQ WK AFL V | PIK3CA E545K | SEQ ID NO: 24370 | LSEITK QEKDF LWSHR HYCV | TKQE KDFL W | T1I | E4W | D6A | W9V | Individual PIK3CA_E545K Vaccine (5-peptide) |
| SEQ ID NO: 652 | LSEIIKQYKIFLA SRHHYCV | IKQY KIFL A | PIK3CA E545K | SEQ ID NO: 24370 | LSEITK QEKDF LWSHR HYCV | TKQE KDFL W | T1I | E4Y | D6I | W9A | Individual PIK3CA_E545K Vaccine (5-peptide) |
| SEQ ID NO: 653 | LSEILKQMKAFL ISHRHYCV | LKQ MKA FLI | PIK3CA E545K | SEQ ID NO: 24370 | LSEITK QEKDF LWSHR HYCV | TKQE KDFL W | T1L | E4M | D6A | W9I | Individual PIK3CA_E545K Vaccine (5-peptide) |
| SEQ ID NO: 654 | LSEIVKQFKDFL ASHRHYCV | VKQ FKD FLA | PIK3CA E545K | SEQ ID NO: 24370 | LSEITK QEKDF LWSHR HYCV | TKQE KDFL W | T1V | E4F | — | W9A | Individual PIK3CA_E545K Vaccine (5-peptide) |
| SEQ ID NO: 655 | LSEIVKQFKDFL LSHRHYCV | VKQ FKD FLL | PIK3CA E545K | SEQ ID NO: 24370 | LSEITK QEKDF LWSHR HYCV | TKQE KDFL W | T1V | E4F | — | W9L | Individual PIK3CA_E545K Vaccine (5-peptide) |
| SEQ ID NO: 656 | LSEIVKQMKAF LISHRHYCV | VKQ MKA FLI | PIK3CA E545K | SEQ ID NO: 24370 | LSEITK QEKDF LWSHR HYCV | TKQE KDFL W | T1V | E4M | D6A | W9I | Bronchus And Lung Cancer Vaccine (30-peptide); Colorectal Cancer Vaccine (30-peptide) |
| SEQ ID NO: 657 | LSEIIKQFKDFLI SRHHYCV | IKQF KDF LI | PIK3CA E545K | SEQ ID NO: 24370 | LSEITK QEKDF LWSHR HYCV | TKQE KDFL W | T1I | E4F | — | W9I | Individual PIK3CA_E545K Vaccine (1-peptide, Set 2) |
| SEQ ID NO: 658 | ALEYFFKQMNT ARAG | FKQ MN TAR A | PIK3CA H1047 R | SEQ ID NO: 24393 | ALEYF MKQM NDAR HG | MKQ MND ARH | M1F | — | D6T | H9A | Individual PIK3CA_H1047R Vaccine (5-peptide) |

TABLE 2-continued

Example Vaccine Peptides (MHC class II)

| SEQ ID NO | Sequence corresponding to SEQ ID | Core | Target | Seed SEQ ID NO | Seed | Seed Core | Heteroclitic Modification P1 | Heteroclitic Modification P4 | Heteroclitic Modification P6 | Heteroclitic Modification P9 | Note |
|---|---|---|---|---|---|---|---|---|---|---|---|
| SEQ ID NO: 659 | ALEYFIKQMNR ARLGGWTTK | IKQ MN RAR L | PIK3CA H1047R | SEQ ID NO: 24397 | ALEYF MKQM NDAR HGGW TTK | MKQ MND ARH | M1F | — | D6R | H9L | Individual PIK3CA_H1047R Vaccine (5-peptide) |
| SEQ ID NO: 660 | ALEYFLKQANR ARSG | LKQ ANR ARS | PIK3CA H1047R | SEQ ID NO: 24393 | ALEYF MKQM NDAR HG | MKQ MND ARH | M1L | M4A | D6R | H9S | Individual PIK3CA_H1047R Vaccine (5-peptide) |
| SEQ ID NO: 661 | ALEYFLKQMNI ARVGGWTTK | LKQ MNI ARV | PIK3CA H1047R | SEQ ID NO: 24397 | ALEYF MKQM NDAR HGGW TTK | MKQ MND ARH | M1L | — | D6I | H9V | Individual PIK3CA_H1047R Vaccine (5-peptide) |
| SEQ ID NO: 662 | YFFKQMNNAR DGGWT | FKQ MN NAR D | PIK3CA H1047R | SEQ ID NO: 24471 | YFMK QMND ARHG GWT | MKQ MND ARH | M1F | — | D6N | H9D | Individual PIK3CA_H1047R Vaccine (5-peptide) |
| SEQ ID NO: 663 | ALEYFFKQINTA RAG | FKQI NTA RA | PIK3CA H1047R | SEQ ID NO: 24393 | ALEYF MKQM NDAR HG | MKQ MND ARH | M1F | M4I | D6T | H9A | Individual PIK3CA_H1047R Vaccine (5-peptide, Set 2) |
| SEQ ID NO: 664 | ALEYFIKQANR ARHG | IKQ ANR ARH | PIK3CA H1047R | SEQ ID NO: 24393 | ALEYF MKQM NDAR HG | MKQ MND ARH | M1I | M4A | D6R | — | Individual PIK3CA_H1047R Vaccine (5-peptide, Set 2) |
| SEQ ID NO: 665 | ALEYFIKQINRA RVGGWTTK | IKQI NRA RV | PIK3CA H1047R | SEQ ID NO: 24397 | ALEYF MKQM NDAR HGGW TTK | MKQ MND ARH | M1I | M4I | D6R | H9V | Individual PIK3CA_H1047R Vaccine (5-peptide, Set 2) |
| SEQ ID NO: 666 | ALEYFIKQMNA ARVGGWTTK | IKQ MN AAR V | PIK3CA H1047R | SEQ ID NO: 24397 | ALEYF MKQM NDAR HGGW TTK | MKQ MND ARH | M1I | — | D6A | H9V | Individual PIK3CA_H1047R Vaccine (5-peptide, Set 2) |

TABLE 2-continued

Example Vaccine Peptides (MHC class II)

| SEQ ID NO | Sequence corresponding to SEQ ID | Core | Target | Seed SEQ ID NO | Seed | Seed Core | Heteroclitic Modification P1 | Heteroclitic Modification P4 | Heteroclitic Modification P6 | Heteroclitic Modification P9 | Note |
|---|---|---|---|---|---|---|---|---|---|---|---|
| SEQ ID NO: 667 | YFFFKQMNSARDGGWT | FKQMNSARD | PIK3CA H1047R | SEQ ID NO: 24471 | YFMKQMNDARHGGWT | MKQMNDARH | M1F | — | D6S | H9D | Individual PIK3CA_H1047R Vaccine (5-peptide, Set 2) |
| SEQ ID NO: 668 | AERREFFDHTFQLVDLRLFQPFLKV | FFDHTFQLV | PIK3CA R88Q | SEQ ID NO: 24480 | AERREFFDETFRQLCDLRLFQPFLKV | FFDETRQLC | E4H | — | R6F | C9V | Individual PIK3CA_R88Q Vaccine (5-peptide) |
| SEQ ID NO: 669 | AERREYFDLTPQLIDLRLFQPFLKV | YFDLTPQLI | PIK3CA R88Q | SEQ ID NO: 24480 | AERREFFDETFRQLCDLRLFQPFLKV | FFDETRQLC | F1Y | E4L | R6P | C9I | Individual PIK3CA_R88Q Vaccine (5-peptide) |
| SEQ ID NO: 670 | EFFDEFRQFCALRIFQPFLK | FRQFCALRI | PIK3CA R88Q | SEQ ID NO: 24507 | EFFDETRQLCDLRLFQPPLK | TRQLCDLRL | T1F | L4F | D6A | L9I | Individual PIK3CA_R88Q Vaccine (5-peptide); Individual PIK3CA_R88Q Vaccine (5-peptide, Set 2) |
| SEQ ID NO: 671 | EFFDETFQLTDFRLVQPFLK | FQLTDFRLV | PIK3CA R88Q | SEQ ID NO: 24507 | EFFDETRQLCDLRLFQPPLK | RQLCDLRLF | R1F | C4T | L6F | F9V | Individual PIK3CA_R88Q Vaccine (5-peptide) |
| SEQ ID NO: 672 | FFDETFQLTDFRLLQPFLKV | FQLTDFRLL | PIK3CA R88Q | SEQ ID NO: 24538 | FFDETRQLCDLRLFQPFLKV | RQLCDLRLF | R1F | C4T | L6F | F9L | Individual PIK3CA_R88Q Vaccine (5-peptide) |
| SEQ ID NO: 673 | AERREFFDLTPQLIDLRLFQPFLKV | FFDLTPQLI | PIK3CA R88Q | SEQ ID NO: 24480 | AERREFFDETFRQLCDLRLFQPFLKV | FFDETRQLC | — | E4L | R6P | C9I | Individual PIK3CA_R88Q Vaccine (5-peptide, Set 2) |

TABLE 2-continued

Example Vaccine Peptides (MHC class II)

| SEQ ID NO | Sequence corresponding to SEQ ID | Core | Target | Seed SEQ ID NO | Seed | Seed Core | Heteroclitic Modification P1 | Heteroclitic Modification P4 | Heteroclitic Modification P6 | Heteroclitic Modification P9 | Note |
|---|---|---|---|---|---|---|---|---|---|---|---|
| SEQ ID NO: 674 | AEREEFFDSTF QLVDLRLFQPF LKV | FFD STF QLV | PIK3CA R88Q | SEQ ID NO: 24480 | AEREE FFDET RQLCD LRLFQ PFLKV | FFDE TRQL C | — | E4S | R6F | C9V | Individual PIK3CA_R88Q Vaccine (5-peptide, Set 2) |
| SEQ ID NO: 675 | FFDETFQLTDFR LVQPFLKV | FQL TDF RLV | PIK3CA R88Q | SEQ ID NO: 24538 | FFDET RQLCD LRLFQ PFLKV | RQLC DLRL F | R1F | C4T | L6F | F9V | Individual PIK3CA_R88Q Vaccine (5-peptide, Set 2) |
| SEQ ID NO: 676 | KAGIGGAGAMI AAYL | IGG AGA MIA | PTEN R130G | SEQ ID NO: 24640 | KAGKG GTGV MICAY L | KGGT GVMI C | KII | T4A | V6A | C9A | Individual PTEN_R130G Vaccine (5-peptide); Individual PTEN_R130G Vaccine (1-peptide, Set 2) |
| SEQ ID NO: 677 | KAGIGGAGAMI SAYL | IGG AGA MIS | PTEN R130G | SEQ ID NO: 24640 | KAGKG GTGV MICAY L | KGGT GVMI C | KII | T4A | V6A | C9S | Individual PTEN_R130G Vaccine (5-peptide) |
| SEQ ID NO: 678 | KAGMGGAGA MIAAYL | MG GAG AMI A | PTEN R130G | SEQ ID NO: 24640 | KAGKG GTGV MICAY L | KGGT GVMI C | K1M | T4A | V6A | C9A | Individual PTEN_R130G Vaccine (5-peptide) |
| SEQ ID NO: 679 | KAGMGGAGA MISAYL | MG GAG AMI S | PTEN R130G | SEQ ID NO: 24640 | KAGKG GTGV MICAY L | KGGT GVMI C | K1M | T4A | V6A | C9S | Individual PTEN_R130G Vaccine (5-peptide) |
| SEQ ID NO: 680 | KAGVGGAGA MIAAYL | VGG AGA MIA | PTEN R130G | SEQ ID NO: 24640 | KAGKG GTGV MICAY L | KGGT GVMI C | K1V | T4A | V6A | C9A | Individual PTEN_R130G Vaccine (5-peptide) |
| SEQ ID NO: 681 | AAIHWKAAKP QTAVMICAYLL HR | WK AAK PQT A | PTEN R130Q | SEQ ID NO: 24666 | AAIHC KAGKG QTGV MICAY LLHR | CKAG KGQT G | C1W | G4A | G6P | G9A | Individual PTEN_R130Q Vaccine (5-peptide) |

TABLE 2-continued

Example Vaccine Peptides (MHC class II)

| SEQ ID NO | Sequence corresponding to SEQ ID | Core | Target | Seed SEQ ID NO | Seed | Seed Core | Heteroclitic Modification P1 | Heteroclitic Modification P4 | Heteroclitic Modification P6 | Heteroclitic Modification P9 | Note |
|---|---|---|---|---|---|---|---|---|---|---|---|
| SEQ ID NO: 682 | AAIHYKAGKAQT TIVMICAYLLHR | YKA GKA QTI | PTEN R130Q | SEQ ID NO: 24666 | AAIHC KAGKG QTGV MICAY LLHR | CKAG KGQT G | C1Y | — | G6A | G9I | Individual PTEN_R130Q Vaccine (5-peptide) |
| SEQ ID NO: 683 | AIHLKAAKPQT AVMICAYLL | LKA AKP QTA | PTEN R130Q | SEQ ID NO: 24676 | AIHCK AGKG QTGV MICAY LL | CKAG KGQT G | C1L | G4A | G6P | G9A | Individual PTEN_R130Q Vaccine (5-peptide) |
| SEQ ID NO: 684 | AIHVKAAKAQT AVMICAYLL | VKA AKA QTA | PTEN R130Q | SEQ ID NO: 24676 | AIHCK AGKG QTGV MICAY LL | CKAG KGQT G | C1V | G4A | G6A | G9A | Individual PTEN_R130Q Vaccine (5-peptide) |
| SEQ ID NO: 685 | AIHVKAAKPQT AVMICAYLL | VKA AKP QTA | PTEN R130Q | SEQ ID NO: 24676 | AIHCK AGKG QTGV MICAY LL | CKAG KGQT G | C1V | G4A | G6P | G9A | Individual PTEN_R130Q Vaccine (5-peptide) |
| SEQ ID NO: 686 | AAIHIKAAKAQ TAVMICAYLLH R | IKAA KAQ TA | PTEN R130Q | SEQ ID NO: 24666 | AAIHC KAGKG QTGV MICAY LLHR | CKAG KGQT G | C1I | G4A | G6A | G9A | Individual PTEN_R130Q Vaccine (5-peptide, Set 2) |
| SEQ ID NO: 687 | AAIHIKAAKPQT AVMICAYLLHR | IKAA KAQ TA | PTEN R130Q | SEQ ID NO: 24666 | AAIHC KAGKG QTGV MICAY LLHR | CKAG KGQT G | C1I | G4A | G6P | G9A | Individual PTEN_R130Q Vaccine (5-peptide, Set 2) |
| SEQ ID NO: 688 | AAIHNKAAKIQ TVMICAYLLH R | NKA AKI QTV | PTEN R130Q | SEQ ID NO: 24666 | AAIHC KAGKG QTGV MICAY LLHR | CKAG KGQT G | C1N | G4A | G6I | G9V | Individual PTEN_R130Q Vaccine (5-peptide, Set 2) |
| SEQ ID NO: 689 | AIHIKAAKAQT AVMI | IKAA KAQ TA | PTEN R130Q | SEQ ID NO: 24671 | AIHCK AGKG QTGV MI | CKAG KGQT G | Ci1 | G4A | G6A | G9A | Individual PTEN_R130Q Vaccine (5-peptide, Set 2) |

TABLE 2-continued

Example Vaccine Peptides (MHC class II)

| SEQ ID NO | Sequence corresponding to SEQ ID | Core | Target | Seed SEQ ID NO | Seed | Seed Core | Heteroclitic Modification P1 | Heteroclitic Modification P4 | Heteroclitic Modification P6 | Heteroclitic Modification P9 | Note |
|---|---|---|---|---|---|---|---|---|---|---|---|
| SEQ ID NO: 690 | AIHIKAAKAQT AVMICAYLL | IKAA KAQ TA | PTEN R130Q | SEQ ID NO: 24676 | AIHCK AGKG QTGV MICAY LL | CKAG KGQT G | C1I | G4A | G6A | G9A | Individual PTEN_R130Q Vaccine (5-peptide, Set 2) |
| SEQ ID NO: 691 | KQSQHMTEVIR RIPRRERCS | IRRI PRR ER | TP53 H179R | SEQ ID NO: 24741 | KQSQH MTEV VRRCP HRERC S | VRRC PHRE R | V1I | C4I | H6R | — | Individual TP53_H179R Vaccine (5-peptide) |
| SEQ ID NO: 692 | KQSQHMTEVIR RMPRRERCS | IRR MPR RER | TP53 H179R | SEQ ID NO: 24741 | KQSQH MTEV VRRCP HRERC S | VRRC PHRE R | V1I | C4M | H6R | — | Individual TP53_H179R Vaccine (5-peptide); Individual TP53_H179R Vaccine (5-peptide, Set 2) |
| SEQ ID NO: 693 | MAIYKQSQHM TEVIRRMPRRE VCSD | IRR MPR REV | TP53 H179R | SEQ ID NO: 24750 | MAIYK QSQH MTEV VRRCP HRERC SD | VRRC PHRE R | V1I | C4M | H6R | R9V | Individual TP53_H179R Vaccine (5-peptide) |
| SEQ ID NO: 694 | QHMTELVRICK HRAR | LVRI CKH RA | TP53 H179R | SEQ ID NO: 24752 | QHMT EVVRR CPHRE R | VVRR CPHR E | V1L | R4I | P6K | E9A | Individual TP53_H179R Vaccine (5-peptide) |
| SEQ ID NO: 695 | QHMTEMVRLC RHRAR | MV RLC RHR A | TP53 H179R | SEQ ID NO: 24752 | QHMT EVVRR CPHRE R | VVRR CPHR E | V1M | R4L | P6R | E9A | Individual TP53_H179R Vaccine (5-peptide) |
| SEQ ID NO: 696 | KQSQHMTEVIR RFPRREICS | IRRF PRR EI | TP53 H179R | SEQ ID NO: 24741 | KQSQH MTEV VRRCP HRERC S | VRRC PHRE R | V1I | C4F | H6R | R9I | Individual TP53_H179R Vaccine (5-peptide, Set 2) |

TABLE 2-continued

Example Vaccine Peptides (MHC class II)

| SEQ ID NO | Sequence corresponding to SEQ ID | Core | Target | Seed SEQ ID NO | Seed | Seed Core | Heteroclitic Modification P1 | Heteroclitic Modification P4 | Heteroclitic Modification P6 | Heteroclitic Modification P9 | Note |
|---|---|---|---|---|---|---|---|---|---|---|---|
| SEQ ID NO: 697 | KQSQHMTEVIR RMPRREVCS | IRRMPRREV | TP53 H179R | SEQ ID NO: 24741 | KQSQHMTEVVRRCPHRERCS | VRRCPHRER | V1I | C4M | H6R | R9V | Individual TP53_H179R Vaccine (5-peptide, Set 2) |
| SEQ ID NO: 698 | QHMTEIVRICR HRAR | IVRICRHRA | TP53 H179R | SEQ ID NO: 24752 | QHMTEVVRRCPHRE | VVRRCPHRE | V1I | R4I | P6R | E9A | Individual TP53_H179R Vaccine (5-peptide, Set 2) |
| SEQ ID NO: 699 | QHMTELVRLCS HRSR | LVRLCSHRS | TP53 H179R | SEQ ID NO: 24752 | QHMTEVVRRCPHRE | VVRRCPHRE | V1L | R4L | P6S | E9S | Individual TP53_H179R Vaccine (5-peptide, Set 2) |
| SEQ ID NO: 700 | PGTFVLSMSIYE QSQ | FVLSMSIYE | TP53 R158L | SEQ ID NO: 24818 | PGTRVLAMAIYKQSQ | RVLAMAIYK | R1F | A4S | A6S | K9E | Individual TP53_R158L Vaccine (5-peptide); Bronchus And Lung Cancer Vaccine (30-peptide) |
| SEQ ID NO: 701 | PGTRFLAIASYK VSQ | FLAIASYKV | TP53 R158L | SEQ ID NO: 24818 | PGTRVLAMAIYKQSQ | VLAMAIYKQ | V1F | M4I | I6S | Q9V | Individual TP53_R158L Vaccine (5-peptide); Bronchus And Lung Cancer Vaccine (30-peptide); Individual TP53_R158L Vaccine (5-peptide, Set 2) |
| SEQ ID NO: 702 | PGTRFLATAFYK LSQH | FLATAFYKL | TP53 R158L | SEQ ID NO: 24819 | PGTRVLAMAIYKQSQH | VLAMAIYKQ | V1F | M4T | I6F | Q9L | Individual TP53_R158L Vaccine (5-peptide); Bronchus And Lung Cancer Vaccine (30-peptide); Individual |

TABLE 2-continued

Example Vaccine Peptides (MHC class II)

| SEQ ID NO | Sequence corresponding to SEQ ID | Core | Target | Seed SEQ ID NO | Seed | Seed Core | Heteroclitic Modification P1 | Heteroclitic Modification P4 | Heteroclitic Modification P6 | Heteroclitic Modification P9 | Note |
|---|---|---|---|---|---|---|---|---|---|---|---|
| | | | | | | | | | | | TP53_R158L Vaccine (5-peptide, Set 2) |
| SEQ ID NO: 703 | PGTRILALAKYK FSQ | ILAL AKY KF | TP53 R158L | SEQ ID NO: 24818 | PGTRV LAMAI YKQSQ | VLA MAIY KQ | V1I | M4L | I6K | Q9F | Individual TP53_R158L Vaccine (5-peptide); Bronchus And Lung Cancer Vaccine (30-peptide); Individual TP53_R158L Vaccine (5-peptide, Set 2) |
| SEQ ID NO: 704 | PGTRILATAFYK LS | ILAT AFY KL | TP53 R158L | SEQ ID NO: 24817 | PGTRV LAMAI YKQS | VLA MAIY KQ | V1I | M4T | I6F | Q9L | Individual TP53_R158L Vaccine (5-peptide); Bronchus And Lung Cancer Vaccine (30-peptide) |
| SEQ ID NO: 705 | PGTRILAAATYK ASQ | ILAA ATY KA | TP53 R158L | SEQ ID NO: 24818 | PGTRV LAMAI YKQSQ | VLA MAIY KQ | V1I | M4A | I6T | Q9A | Bronchus And Lung Cancer Vaccine (30-peptide) |
| SEQ ID NO: 706 | PGTRFVLAMPIY NQSQ | FVL AMP IYN | TP53 R158L | SEQ ID NO: 24818 | PGTRV LAMAI YKQSQ | RVLA MAIY K | R1F | — | A6P | K9N | Individual TP53_R158L Vaccine (5-peptide, Set 2) |
| SEQ ID NO: 707 | PGTRFLAAAFY KFS | FLA AAF YKF | TP53 R158L | SEQ ID NO: 24817 | PGTRV LAMAI YKQS | VLA MAIY KQ | V1F | M4A | I6F | Q9F | Individual TP53_R158L Vaccine (5-peptide, Set 2) |
| SEQ ID NO: 708 | AIYKQSQYMTL VVRHVPHHE | YMT LVV RHV | TP53 R175H | SEQ ID NO: 24928 | AIYKQ SQHM TEVVR HCPHH E | HMT EVVR HC | H1Y | E4L | — | C9V | Individual TP53_R175H Vaccine (5-peptide); Colorectal Cancer Vaccine |

TABLE 2-continued

Example Vaccine Peptides (MHC class II)

| SEQ ID NO | Sequence corresponding to SEQ ID | Core | Target | Seed SEQ ID NO | Seed | Seed Core | Heteroclitic Modification P1 | Heteroclitic Modification P4 | Heteroclitic Modification P6 | Heteroclitic Modification P9 | Note |
|---|---|---|---|---|---|---|---|---|---|---|---|
| | | | | | | | | | | | (30-peptide); Brain Cancer Vaccine (20-peptide) |
| SEQ ID NO: 709 | AIYKQSQYMTV VLRHAPHHE | YMT VVL RHA | TP53 R175H | SEQ ID NO: 24928 | AIYKQ SQHM TEVVR HCPHH E | HMT EVVR HC | H1Y | E4V | V6L | C9A | Individual TP53_R175H Vaccine (5-peptide) |
| SEQ ID NO: 710 | MAIYKQSQFM TAVMRHIPHH | FMT AV MR HI | TP53 R175H | SEQ ID NO: 24941 | MAIYK QSQH MTEV VRHCP HH | HMT EVVR HC | H1F | E4A | V6M | C9I | Individual TP53_R175H Vaccine (5-peptide) |
| SEQ ID NO: 711 | MAIYKQSQFM TTVVRHVPHH | FMT TVV RHV | TP53 R175H | SEQ ID NO: 24941 | MAIYK QSQH MTEV VRHCP HH | HMT EVVR HC | H1F | E4T | — | C9V | Individual TP53_R175H Vaccine (5-peptide) |
| SEQ ID NO: 712 | MAIYKQSQYM TLVMRHVPHH | YMT LVM RHV | TP53 R175H | SEQ ID NO: 24941 | MAIYK QSQH MTEV VRHCP HH | HMT EVVR HC | H1Y | E4L | V6M | C9V | Individual TP53_R175H Vaccine (5-peptide); Colorectal Cancer Vaccine (30-peptide); Brain Cancer Vaccine (20-peptide) |
| SEQ ID NO: 713 | AIYKQSQFMTL VARHAPHHE | FMT LVA RHA | TP53 R175H | SEQ ID NO: 24928 | AIYKQ SQHM TEVVR HCPHH E | HMT EVVR HC | H1F | E4L | V6A | C9A | Individual TP53_R175H Vaccine (5-peptide, Set 2) |
| SEQ ID NO: 714 | AIYKQSQFMT MVARHNPHHE | FMT MV ARH N | TP53 R175H | SEQ ID NO: 24928 | AIYKQ SQHM TEVVR HCPHH E | HMT EVVR HC | H1F | E4M | V6A | C9N | Individual TP53_R175H Vaccine (5-peptide, Set 2) |

TABLE 2-continued

Example Vaccine Peptides (MHC class II)

| SEQ ID NO | Sequence corresponding to SEQ ID | Core | Target | Seed SEQ ID NO | Seed | Seed Core | Heteroclitic Modification P1 | Heteroclitic Modification P4 | Heteroclitic Modification P6 | Heteroclitic Modification P9 | Note |
|---|---|---|---|---|---|---|---|---|---|---|---|
| SEQ ID NO: 715 | MAIYKQSQFM TIVARHVPHH | FMT IVAR HV | TP53 R175H | SEQ ID NO: 24941 | MAIYK QSQH MTEV VRHCP HH | HMT EVVR HC | H1F | E4I | V6A | C9V | Individual TP53_R175H Vaccine (5-peptide, Set 2) |
| SEQ ID NO: 716 | MAIYKQSQFM TLVARHVPHH | FMT LVA RHV | TP53 R175H | SEQ ID NO: 24941 | MAIYK QSQH MTEV VRHCP HH | HMT EVVR HC | H1F | E4L | V6A | C9V | Individual TP53_R175H peptide, Set 2) |
| SEQ ID NO: 717 | MAIYKQSQFM TMVIRHLPHH | FMT MVI RHL | TP53 R175H | SEQ ID NO: 24941 | MAIYK QSQH MTEV VRHCP HH | HMT EVVR HC | H1F | E4M | V6I | C9L | Individual TP53_R175H Vaccine (5-peptide, set 2) |
| SEQ ID NO: 718 | MGGINQFPDL TIITL | INQ FPD LTI | TP53 R248Q | SEQ ID NO: 24977 | MGG MNQR PILTIIT L | MNQ RPILT I | M1I | R4F | I6D | — | Individual TP53_R248Q Vaccine (5-peptide, Set 2) |
| SEQ ID NO: 719 | MGGINQIPALT RITL | INQI PAL TR | TP53 R248Q | SEQ ID NO: 24977 | MGG MNQR PILTIIT L | MNQ RPILT I | M1I | R4I | I6A | I9R | Individual TP53_R248Q Vaccine (5-peptide); Individual TP53_R248Q Vaccine (5-peptide, Set 2) |
| SEQ ID NO: 720 | MGGINQLPRLT SITL | INQ LPRL TS | TP53 R248Q | SEQ ID NO: 24977 | MGG MNQR PILTIIT L | MNQ RPILT I | M1I | R4L | I6R | I9S | Individual TP53_R248Q Vaccine (5-peptide); Individual TP53_R248Q Vaccine (5-peptide, Set 2) |

TABLE 2-continued

Example Vaccine Peptides (MHC class II)

| SEQ ID NO | Sequence corresponding to SEQ ID | Core | Target | Seed SEQ ID NO | Seed | Seed Core | Heteroclitic Modification P1 | Heteroclitic Modification P4 | Heteroclitic Modification P6 | Heteroclitic Modification P9 | Note |
|---|---|---|---|---|---|---|---|---|---|---|---|
| SEQ ID NO: 721 | YMCNSSCMGG FNQTPFLTVITL EDS | FNQ TPFL TV | TP53 R248Q | SEQ ID NO: 25006 | YMCN SSCMG GMNQ RPILTII TLEDS | MNQ RPILT I | M1F | R4T | I6F | I9V | Individual TP53_R248Q Vaccine (5-peptide); Individual TP53_R248Q Vaccine (5-peptide, Set 2) |
| SEQ ID NO: 722 | YMCNSSNMGS MAQRSILTII | NM GSM AQR S | TP53 R248Q | SEQ ID NO: 25003 | YMCN SSCMG GMNQ RPILTII | CMG GMN QRP | C1N | G45 | N6A | P9S | Individual TP53_R248Q Vaccine (5-peptide) |
| SEQ ID NO: 723 | YMCNSSNMGA MVQRAILTII | NM GA MV QRA | TP53 R248Q | SEQ ID NO: 25003 | YMCN SSCMG GMNQ RPILTII | CMG GMN QRP | C1N | G4A | N6V | P9A | Individual TP53_R248Q Vaccine (5-peptide, Set 2) |
| SEQ ID NO: 724 | CMGGFNWTPF LTVIT | FN WTP FLTV | TP53 R248W | SEQ ID NO: 25012 | CMGG MNWR PILTIIT L | MN WRPI LTI | M1F | R4T | I6F | I9V | Individual TP53_R248W Vaccine (5-peptide); Individual TP53_R248W Vaccine (5-peptide, Set 2) |
| SEQ ID NO: 725 | MGGINWHPSL TIITL | INW HPS LTI | TP53 R248W | SEQ ID NO: 25051 | MGG MNWR PILTIIT L | MN WRPI LTI | M1I | R4H | I6S | — | Individual TP53_R248W Vaccine (5-peptide) |
| SEQ ID NO: 726 | MGGINWVPKL TVITL | INW VPK LTV | TP53 R248W | SEQ ID NO: 25051 | MGG MNWR PILTIIT L | MN WRPI LTI | Mu | R4V | I6K | I9V | Individual TP53_R248W Vaccine (5-peptide) |
| SEQ ID NO: 727 | MGGLNWFPAL TRITL | LNW FPA LTR | TP53 R248W | SEQ ID NO: 25051 | MGG MNWR PILTIIT L | MN WRPI LTI | M1L | R4F | I6A | I9R | Individual TP53_R248W Vaccine (5-peptide) |
| SEQ ID NO: 728 | SCMGGFNWM PALTII | FN WM PAL TI | TP53 R248W | SEQ ID NO: 25074 | SCMG GMN WRPIL TII | MN WRPI LTI | M1F | R4M | I6A | — | Individual TP53_R248W Vaccine (5-peptide) |

TABLE 2-continued

Example Vaccine Peptides (MHC class II)

| SEQ ID NO | Sequence corresponding to SEQ ID | Core | Target | Seed SEQ ID NO | Seed | Seed Core | Heteroclitic Modification P1 | Heteroclitic Modification P4 | Heteroclitic Modification P6 | Heteroclitic Modification P9 | Note |
|---|---|---|---|---|---|---|---|---|---|---|---|
| SEQ ID NO: 729 | MGGINWFPAL TRITL LTR | INW FPA | TP53 R248W | SEQ ID NO: 25051 | MGG MNWR PILTIIT L | MN WRPI LTI | Mu | R4F | I6A | I9R | Individual TP53_R248W Vaccine (5-peptide, Set 2) |
| SEQ ID NO: 730 | MGGINWHPAL TLITL | INW HPA LTL | TP53 R248W | SEQ ID NO: 25051 | MGG MNWR PILTIIT L | MN WRPI LTI | Mu | R4H | I6A | I9L | Individual TP53_R248W Vaccine (5-peptide, Set 2) |
| SEQ ID NO: 731 | MGGINWIPKLT LITL | INW IPKL TL | TP53 R248W | SEQ ID NO: 25051 | MGG MNWR PILTIIT L | MN WRPI LTI | M1I | R4I | I6K | I9L | Individual TP53_R248W Vaccine (5-peptide, Set 2) |
| SEQ ID NO: 732 | SCMGGINWLP ALTII | INW LPAL TI | TP53 R248W | SEQ ID NO: 25074 | SCMG GMN WRPIL TII | MN WRPI LTI | M1I | R4L | I6A | — | Individual TP53_R248W Vaccine (5-peptide, Set 2) |
| SEQ ID NO: 733 | SFFVCVCACPT RDRR | FVC VCA CPT | TP53 R273C | SEQ ID NO: 25114 | SFEVC VCACP GRDRR | EVCV CACP G | E1F | — | — | G9T | Individual TP53_R273C Vaccine (5-peptide) |
| SEQ ID NO: 734 | SFFVCVCSCPLR DRR | FVC VCS CPL | TP53 R273C | SEQ ID NO: 25114 | SFEVC VCACP GRDRR | EVCV CACP G | E1F | — | A6S | G9L | Individual TP53_R273C Vaccine (5-peptide) |
| SEQ ID NO: 735 | SFFVCFCACPM RDRR | YVC FCA CPM | TP53 R273C | SEQ ID NO: 25114 | SFEVC VCACP GRDRR | EVCV CACP G | E1Y | V4F | — | G9M | Individual TP53_R273C Vaccine (5-peptide) |
| SEQ ID NO: 736 | SFFVCICTCPVR DRR | YVCI CTC PV | TP53 R273C | SEQ ID NO: 25114 | SFEVC VCACP GRDRR | EVCV CACP G | E1Y | V4I | A6T | G9V | Individual TP53_R273C Vaccine (5-peptide) |
| SEQ ID NO: 737 | SFFVCVCTCPA RDRR | YVC VCT CPA | TP53 R273C | SEQ ID NO: 25114 | SFEVC VCACP GRDRR | EVCV CACP G | E1Y | — | A6T | G9A | Individual TP53_R273C Vaccine (5-peptide) |

TABLE 2-continued

Example Vaccine Peptides (MHC class II)

| SEQ ID NO | Sequence corresponding to SEQ ID | Core | Target | Seed SEQ ID NO | Seed | Seed Core | Heteroclitic Modification P1 | Heteroclitic Modification P4 | Heteroclitic Modification P6 | Heteroclitic Modification P9 | Note |
|---|---|---|---|---|---|---|---|---|---|---|---|
| SEQ ID NO: 738 | SFYVCVCTCPLR DRR | YVC VCT CPL | TP53 R273C | SEQ ID NO: 25114 | SFEVC VCACP GRDRR | EVCV CACP G | E1Y | | A6T | G9L | Brain Cancer Vaccine (20-peptide) |
| SEQ ID NO: 739 | SFFVCLCACPA RDRR | FVC LCA CPA | TP53 R273C | SEQ ID NO: 25114 | SFEVC VCACP GRDRR | EVCV CACP G | E1F | V4L | — | G9A | Individual TP53_R273C Vaccine (1-peptide, Set 2) |
| SEQ ID NO: 740 | LLGFNSLEIHVL ACP | FNS LEIH VL | TP53 R273H | SEQ ID NO: 25163 | LLGRN SFEVH VCACP | RNSF EVHV C | R1F | F4L | V6I | C9L | Individual TP53_R273H Vaccine (5-peptide) |
| SEQ ID NO: 741 | LLGINSFEDHVA ACP | INSF EDH VA | TP53 R273H | SEQ ID NO: 25163 | LLGRN SFEVH VCACP | RNSF EVHV C | R1I | — | V6D | C9A | Individual TP53_R273H Vaccine (5-peptide) |
| SEQ ID NO: 742 | SGNLLGFNSLEF HVVACPGR | FNS LEF HVV | TP53 R273H | SEQ ID NO: 25188 | SGNLL GRNSF EVHVC ACPGR | RNSF EVHV C | R1F | F4L | V6F | C9V | Individual TP53_R273H Vaccine (5-peptide); Individual TP53_R273H Vaccine (5-peptide, Set 2) |
| SEQ ID NO: 743 | SGNLLGRNSFY VHLCPCPARDR RTE | YVH LCP CPA | TP53 R273H | SEQ ID NO: 25193 | SGNLL GRNSF EVHVC ACPGR DRRTE | EVHV CACP G | E1Y | V4L | A6P | G9A | Individual TP53_R273H Vaccine (5-peptide) |
| SEQ ID NO: 744 | SGNLLGRNSFY VHVCTCPVRDR RTE | YVH VCT CPV | TP53 R273H | SEQ ID NO: 25193 | SGNLL GRNSF EVHVC ACPGR DRRTE | EVHV CACP G | E1Y | — | A6T | G9V | Individual TP53_R273H Vaccine (5-peptide) |
| SEQ ID NO: 745 | LLGFNSFEAHV LACP | FNS FEA HVL | TP53 R273H | SEQ ID NO: 25163 | LLGRN SFEVH VCACP | RNSF EVHV C | R1F | — | V6A | C9L | Individual TP53_R273H Vaccine (5-peptide, Set 2) |

TABLE 2-continued

Example Vaccine Peptides (MHC class II)

| SEQ ID NO | Sequence corresponding to SEQ ID | Core | Target | Seed SEQ ID NO | Seed | Seed Core | Heteroclitic Modification P1 | Heteroclitic Modification P4 | Heteroclitic Modification P6 | Heteroclitic Modification P9 | Note |
|---|---|---|---|---|---|---|---|---|---|---|---|
| SEQ ID NO: 746 | LLGFNSLEIHVI ACP | FNSLEIHVI | TP53 R273H | SEQ ID NO: 25163 | LLGRNSFEVHVCACP | RNSFEVHVC | R1F | F4L | V6I | C9I | Individual TP53_R273H Vaccine (5-peptide, Set 2) |
| SEQ ID NO: 747 | LLGINSFEAHVL ACP | INSFEAHVL | TP53 R273H | SEQ ID NO: 25163 | LLGRNSFEVHVCACP | RNSFEVHVC | R1I | — | V6A | C9L | Individual TP53_R273H Vaccine (5-peptide, Set 2) |
| SEQ ID NO: 748 | SGNLLGRNSFF VHMCACPVRD RRTE | FVHMCACPV | TP53 R273H | SEQ ID NO: 25193 | SGNLLGRNSFEVHVCACPGRDRRTE | EVHVCACPG | E1F | V4M | — | C9V | Individual TP53_R273H Vaccine (5-peptide, Set 2) |
| SEQ ID NO: 749 | FEVRVCICPARI WRAEE | ICPARIWRA | TP53 R282W | SEQ ID NO: 25209 | FEVRVCACPGRDWRTEE | ACPGRDWRT | A1I | G4A | D6I | T9A | Individual TP53_R282W Vaccine (2-peptide); Individual TP53_R282W Vaccine (1-peptide, Set 2) |
| SEQ ID NO: 750 | FEVRVCICPARV WRAEE | ICPARVWRA | TP53 R282W | SEQ ID NO: 25209 | FEVRVCACPGRDWRTEE | ACPGRDWRT | A1I | G4A | D6V | T9A | Individual TP53_R282W Vaccine (2-peptide) |
| SEQ ID NO: 751 | RNTFFHSLVFPP CLPPE | FHSLVFPCL | TP53 Y220C | SEQ ID NO: 25271 | RNTFRHSVVVPCEPPE | RHSVVVPCE | R1F | V4L | V6F | E9L | Individual TP53_Y220C Vaccine (5-peptide); Individual TP53_Y220C Vaccine (5-peptide, Set 2) |
| SEQ ID NO: 752 | RNTFRHSIVAP CAPPE | RHSIVAPCA | TP53 Y220C | SEQ ID NO: 25271 | RNTFRHSVVVPCEPPE | RHSVVVPCE | — | V4I | V6A | E9A | Individual TP53_Y220C Vaccine (5-peptide) |

TABLE 2-continued

Example Vaccine Peptides (MHC class II)

| SEQ ID NO | Sequence corresponding to SEQ ID | Core | Target | Seed SEQ ID NO | Seed | Seed Core | Heteroclitic Modification P1 | Heteroclitic Modification P4 | Heteroclitic Modification P6 | Heteroclitic Modification P9 | Note |
|---|---|---|---|---|---|---|---|---|---|---|---|
| SEQ ID NO: 753 | RNTFRHSIVAP CVPPE | RHSI VAP CV | TP53 Y220C | SEQ ID NO: 25271 | RNTFR HSVVV PCEPP E | RHSV VVPC E | — | V4I | V6A | E9V | Individual TP53_Y220C Vaccine (5-peptide); Individual TP53_Y220C Vaccine (5-peptide, Set 2) |
| SEQ ID NO: 754 | TFFHSSVFPCIP PEVG | FHS SVF PCI | TP53 Y220C | SEQ ID NO: 25285 | TFRHS VVVPC EPPEV G | RHSV VVPC E | R1F | V4S | V6F | E9I | Individual TP53_Y220C Vaccine (5-peptide) |
| SEQ ID NO: 755 | TFFHSTVFPCIP PEVG | FHS TVF PCI | TP53 Y220C | SEQ ID NO: 25285 | TFRHS VVVPC EPPEV G | RHSV VVPC E | R1F | V4T | V6F | E9I | Individual TP53_Y220C Vaccine (5-peptide) |
| SEQ ID NO: 756 | RNTFRHSLVAP CVPPE | RHS LVA PCV | TP53 Y220C | SEQ ID NO: 25271 | RNTFR HSVVV PCEPP E | RHSV VVPC E | — | V4L | V6A | E9V | Individual TP53_Y220C Vaccine (5-peptide, Set 2) |
| SEQ ID NO: 757 | TFFHSLVFPCLP PEVG | FHSL VFP CL | TP53 Y220C | SEQ ID NO: 25285 | TFRHS VVVPC EPPEV G | RHSV VVPC E | R1F | V4L | V6F | E9L | Individual TP53_Y220C Vaccine (5-peptide, Set 2) |
| SEQ ID NO: 758 | TFFHSTVFPCLP PEVG | FHS TVF PCL | TP53 Y220C | SEQ ID NO: 25285 | TFRHS VVVPC EPPEV G | RHSV VVPC E | R1F | V4T | V6F | E9L | Individual TP53_Y220C Vaccine (5-peptide, Set 2) |
| SEQ ID NO: 759 | YKLVVVGAGDV GKSA | — | KRAS G13D | SEQ ID NO: 759 | — | — | — | — | — | — | Individual KRAS_G 13D Vaccine (5-peptide); Colorectal Cancer Vaccine (30-peptide); Individual KRAS_G 13D Vaccine (5-peptide, Set 2) | mRNA and DNA Vaccines

In some embodiments, vaccine peptides are encoded as mRNA or DNA molecules and are administered for expression in vivo as is known in the art. One example of the delivery of vaccines by mRNA is found in Kranz et al., (2016), incorporated herein by reference. In some embodiments, vaccine peptides are encoded in more than one mRNA or DNA molecule as is found in Sahin et. al. (2017), incorporated in its entirety herein. In one embodiment, a construct comprises 30 peptides, including a ten-peptide MHC class I combined pancreatic cancer vaccine (targets: KRAS G12D, KRAS G12V, KRAS G12R) and a twenty-peptide MHC class II combined pancreatic cancer vaccine (targets: KRAS G12D, KRAS G12V, KRAS G12R), as optimized by the procedure described herein. Peptides are prepended with a secretion signal sequence at the N-terminus and followed by an MHC class I trafficking signal (MITD) (Kreiter et al., 2008; Sahin et al., 2017). The MITD has been shown to route antigens to pathways for HLA class I and class II presentation (Kreiter et al., 2008). Here we combine all peptides of each MHC class into a single construct using non-immunogenic glycine/serine linkers from Sahin et al., (2017), though it is also plausible to construct individual constructs containing single peptides with the same secretion and MITD signals as demonstrated by Kreiter et al., (2008).

In some embodiments, the amino acid sequence encoded by the mRNA vaccine comprises SEQ ID NO: 410310. Underlined amino acids correspond to the signal peptide (or leader) sequence. Bolded amino acids correspond to MHC class I (8-11 amino acids in length; 10 peptides) and MHC class II (13-25 amino acids in length; 20 peptides) peptide sequences. Italicized amino acids correspond to the trafficking signal.

(SEQ ID NO: 410310)
MRVTAPRTLILLLSGALALTETWAGSGGSGGGGSGGLMVVGADGVGGSG

GGGSGGLTVVGADGVGGSGGGGSGGVVVGADGVGRGGSGGGGSGGGPRG

VGKSAVGGSGGGGSGGLLVVGARGVGGSGGGGSGGVMGARGVGKGGSGG

GGSGGVVVGARGVGRGGSGGGGSGGLMVVGAVGVGGSGGGGSGGLTVVG

AVGVGGSGGGGSGGVTVGAVGVGKGGSGGGGSGGEYKFVVFGSDGAGKS

GGSGGGGSGGEYKFVVIGNDGAGKSALTIQLIQNGGSGGGGSGGEYKFV

VLGADGAGKSGGSGGGGSGGMTEYKFVVSGADGIGKSALTGGSGGGGSG

GMTEYKFVVYGSDGIGKSALTGGSGGGGSGGMTEYKIVVMGIDGAGKSA

LTGGSGGGGSGGTEYKFVVIGNRGLGKGGSGGGGSGGTEYKFVVTGFRG

LGKSALTIGGSGGGGSGGTEYKIVVAGARGSGKGGSGGGGSGGTEYKLV

VIGTRGAGKSALTIGGSGGGGSGGTEYRLVSVFARSVGKSALTIGGSGG

GGSGGTEYKFVVIGRRGSGKGGSGGGGSGGTEYKLVVLGMRGYGKGGSG

GGGSGGEYKFVVIGRVGHGKGGSGGGGSGGEYKFVVLGTVGHGKSGGS

GGGGSGGEYKFVVYGNVGVGKSGGSGGGGSGGEYKIVVAGNVGIGKSGG

SGGGGSGGEYKFVVNGAVGVGKSGGSGGGGSGGEYKIVVMGNVGYGKSG

GSGGGGSGGEYKLVVLGRVGHGKSGGSLGGGGSG*IVGIVAGLAVLAVVV*

*IGAVVATVMCRRKSSGGKGGSYSQAASSDSAQGSDVSLTA*

In some embodiments, the vaccine is an mRNA vaccine comprising a nucleic acids sequence encoding the amino acid sequence consisting of SEQ ID NO: 410310. In some embodiments, the nucleic acid sequence of the mRNA vaccine encodes for an amino acid sequence 80, 81, 82, 83, 84, 85, 86, 87, 88, 89, 90, 91, 92, 93, 94, 95, 96, 97, 98 or 99% identical to SEQ ID NO: 410310.

In some embodiments, the vaccine is a DNA vaccine comprising a nucleic acids sequence encoding the amino acid sequence consisting of SEQ ID NO: 410310. In some embodiments, the nucleic acid sequence of the DNA vaccine encodes for an amino acid sequence 80, 81, 82, 83, 84, 85, 86, 87, 88, 89, 90, 91, 92, 93, 94, 95, 96, 97, 98 or 99% identical to SEQ ID NO: 410310.

In some embodiments, one or more MHC class I and/or MHC class II peptides disclosed herein (SEQ ID NO: 1 to 410310) can be encoded in one or more mRNA or DNA molecules and administered for expression in vivo. In some embodiments, between about 2 and about 40 peptide sequences are encoded in one or more mRNA constructs. In some embodiments, between about 2 and about 40 peptide sequences are encoded in one or more DNA constructs (i.e., nucleic acids encoding the amino acids sequences comprising on or more of SEQ ID NOs: 1 to 410310). In some embodiments, the amino acid sequence of the mRNA vaccine or the nucleic acid sequence of the DNA vaccine encodes for an amino acid sequence 80, 81, 82, 83, 84, 85, 86, 87, 88, 89, 90, 91, 92, 93, 94, 95, 96, 97, 98 or 99% identical to any of SEQ ID NOs: 1 to 410310.

Non-Limiting Embodiments of the Subject Matter

In one aspect, the invention provides for nucleic acid sequences encoding one or more amino acid sequences selected from the group consisting of SEQ ID NOs: 1 to 474.

In some embodiments, the nucleic acid sequences encode two or more amino acid sequences selected from the group consisting of SEQ ID NOs: 1 to 474.

In another aspect, the invention provides for an immunogenic composition comprising nucleic acid sequences encoding one or more amino acid sequences selected from the group consisting of SEQ ID NOs: 1 to 474.

In some embodiments, the immunogenic composition is administered to a subject. In some embodiments, the immunogenic composition comprises nucleic acid sequences encoding two or more amino acid sequences selected from the group consisting of SEQ ID NOs: 1 to 474. In some embodiments, the nucleic acid sequences are administered in a construct for expression in vivo. In some embodiments, the in vivo administration of the nucleic acid sequences is configured to produce one or more peptides that is displayed by an HLA class I molecule. In some embodiments, the one or more peptides is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, the one or more peptides is a modified or unmodified fragment of a protein, wherein the protein comprises a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the immunogenic composition is administered in an effective amount to a subject to prevent cancer. In some embodiments, the immunogenic composition is administered in an effective amount to a subject to treat cancer. In some embodiments, the cancer is selected from the group consisting of pancreatic cancer, skin cancer, thyroid cancer, brain cancer, colorectal cancer, bronchus and lung cancer, breast cancer, and ovarian cancer. In some embodiments, the immunogenic composition comprises nucleic acid sequences encoding at least three amino acid sequences selected from the group consisting of SEQ ID NOs: 1 to 474.

In another aspect, the invention provides for an immunogenic peptide composition comprising one or more peptides selected from the group consisting of SEQ ID NOs: 1 to 474.

In some embodiments, the immunogenic peptide composition comprises two or more peptides selected from the group consisting of SEQ ID NOs: 1 to 474.

In another aspect, the invention provides for an immunogenic composition comprising nucleic acid sequences encoding one or more amino acid sequences selected from the group consisting of SEQ ID NOs: 1 to 18.

In some embodiments, the immunogenic composition comprises nucleic acid sequences encoding one or more amino acid sequences derived from a AKT1 protein mutation. In some embodiments, the immunogenic composition comprises nucleic acid sequences encoding two or more amino acid sequences selected from the group consisting of SEQ ID NOs: 1 to 18.

In another aspect, the invention provides for an immunogenic peptide composition comprising one or more peptides selected from the group consisting of SEQ ID NOs: 1 to 18.

In some embodiments, the immunogenic peptide composition comprises two or more peptides selected from the group consisting of SEQ ID NOs: 1 to 18. In some embodiments, the one or more peptides is a modified or unmodified fragment of a mutated AKT1 protein.

In another aspect, the invention provides for an immunogenic composition comprising nucleic acid sequences encoding one or more amino acid sequences selected from the group consisting of SEQ ID NOs: 19 to 50.

In some embodiments, the immunogenic composition comprises nucleic acid sequences encoding one or more amino acid sequences derived from a BRAF protein mutation. In some embodiments, the immunogenic composition comprises nucleic acid sequences encoding two or more amino acid sequences selected from the group consisting of SEQ ID NOs: 19 to 50.

In another aspect, the invention provides for an immunogenic peptide composition comprising one or more peptides selected from the group consisting of SEQ ID NOs: 19 to 50.

In some embodiments, the immunogenic peptide composition comprises two or more peptides selected from the group consisting of SEQ ID NOs: 19 to 50. In some embodiments, the one or more peptides is a modified or unmodified fragment of a mutated BRAF protein.

In another aspect, the invention provides for an immunogenic composition comprising nucleic acid sequences encoding one or more amino acid sequences selected from the group consisting of SEQ ID NOs: 51 to 98.

In some embodiments, the immunogenic composition comprises nucleic acid sequences encoding one or more amino acid sequences derived from a EGFR protein mutation. In some embodiments, the immunogenic composition comprises nucleic acid sequences encoding two or more amino acid sequences selected from the group consisting of SEQ ID NOs: 51 to 98.

In another aspect, the invention provides for an immunogenic peptide composition comprising one or more peptides selected from the group consisting of SEQ ID NOs: 51 to 98.

In some embodiments, the immunogenic peptide composition comprises two or more peptides selected from the group consisting of SEQ ID NOs: 51 to 98. In some embodiments, the one or more peptides is a modified or unmodified fragment of a mutated EGFR protein.

In another aspect, the invention provides for an immunogenic composition comprising nucleic acid sequences encoding one or more amino acid sequences selected from the group consisting of SEQ ID NOs: 99 to 118.

In some embodiments, the immunogenic composition comprises nucleic acid sequences encoding one or more amino acid sequences derived from a GTF2I protein mutation. In some embodiments, the immunogenic composition comprises nucleic acid sequences encoding two or more amino acid sequences selected from the group consisting of SEQ ID NOs: 99 to 118.

In another aspect, the invention provides for an immunogenic peptide composition comprising one or more peptides selected from the group consisting of SEQ ID NOs: 99 to 118.

In some embodiments, the immunogenic peptide composition comprises two or more peptides selected from the group consisting of SEQ ID NOs: 99 to 118. In some embodiments, the one or more peptides is a modified or unmodified fragment of a mutated GTF2I protein.

In another aspect, the invention provides for an immunogenic composition comprising nucleic acid sequences encoding one or more amino acid sequences selected from the group consisting of SEQ ID NOs: 119 to 140.

In some embodiments, the immunogenic composition comprises nucleic acid sequences encoding one or more amino acid sequences derived from a IDH1 protein mutation. In some embodiments, the immunogenic composition comprises nucleic acid sequences encoding two or more amino acid sequences selected from the group consisting of SEQ ID NOs: 119 to 140.

In another aspect, the invention provides for an immunogenic peptide composition comprising one or more peptides selected from the group consisting of SEQ ID NOs: 119 to 140.

In some embodiments, the immunogenic peptide composition comprises two or more peptides selected from the group consisting of SEQ ID NOs: 119 to 140. In some embodiments, the one or more peptides is a modified or unmodified fragment of a mutated IDH1 protein.

In another aspect, the invention provides for an immunogenic composition comprising nucleic acid sequences encoding one or more amino acid sequences selected from the group consisting of SEQ ID NOs: 141 to 229.

In some embodiments, the immunogenic composition comprises nucleic acid sequences encoding one or more amino acid sequences derived from a KRAS protein mutation. In some embodiments, the immunogenic composition comprises nucleic acid sequences encoding two or more amino acid sequences selected from the group consisting of SEQ ID NOs: 141 to 229.

In another aspect, the invention provides for an immunogenic peptide composition comprising one or more peptides selected from the group consisting of SEQ ID NOs: 141 to 229.

In some embodiments, the immunogenic peptide composition comprises two or more peptides selected from the group consisting of SEQ ID NOs: 141 to 229. In some embodiments, the one or more peptides is a modified or unmodified fragment of a mutated KRAS protein.

In another aspect, the invention provides for an immunogenic composition comprising nucleic acid sequences encoding one or more amino acid sequences selected from the group consisting of SEQ ID NOs: 230 to 272.

In some embodiments, the immunogenic composition comprises nucleic acid sequences encoding one or more amino acid sequences derived from a NRAS protein mutation. In some embodiments, the immunogenic composition comprises nucleic acid sequences encoding two or more amino acid sequences selected from the group consisting of SEQ ID NOs: 230 to 272.

In another aspect, the invention provides for an immunogenic peptide composition comprising one or more peptides selected from the group consisting of SEQ ID NOs: 230 to 272.

In some embodiments, the immunogenic peptide composition comprises two or more peptides selected from the group consisting of SEQ ID NOs: 230 to 272. In some embodiments, the one or more peptides is a modified or unmodified fragment of a mutated NRAS protein.

In another aspect, the invention provides for an immunogenic composition comprising nucleic acid sequences encoding one or more amino acid sequences selected from the group consisting of SEQ ID NOs: 273 to 322.

In some embodiments, the immunogenic composition comprises nucleic acid sequences encoding one or more amino acid sequences derived from a PIK3CA protein mutation. In some embodiments, the immunogenic composition comprises nucleic acid sequences encoding two or more amino acid sequences selected from the group consisting of SEQ ID NOs: 273 to 322.

In another aspect, the invention provides for an immunogenic peptide composition comprising one or more peptides selected from the group consisting of SEQ ID NOs: 273 to 322.

In some embodiments, the immunogenic peptide composition comprises two or more peptides selected from the group consisting of SEQ ID NOs: 273 to 322. In some embodiments, the one or more peptides is a modified or unmodified fragment of a mutated PIK3CA protein.

In another aspect, the invention provides for an immunogenic composition comprising nucleic acid sequences encoding one or more amino acid sequences selected from the group consisting of SEQ ID NOs: 323 to 353.

In some embodiments, the immunogenic composition comprises nucleic acid sequences encoding one or more amino acid sequences derived from a PTEN protein mutation. In some embodiments, the immunogenic composition comprises nucleic acid sequences encoding two or more amino acid sequences selected from the group consisting of SEQ ID NOs: 323 to 353.

In another aspect, the invention provides for an immunogenic peptide composition comprising one or more peptides selected from the group consisting of SEQ ID NOs: 323 to 353.

In some embodiments, the immunogenic peptide composition comprises two or more peptides selected from the group consisting of SEQ ID NOs: 323 to 353. In some embodiments, the one or more peptides is a modified or unmodified fragment of a mutated PTEN protein.

In another aspect, the invention provides for an immunogenic composition comprising nucleic acid sequences encoding one or more amino acid sequences selected from the group consisting of SEQ ID NOs: 354 to 458.

In some embodiments, the immunogenic composition comprises nucleic acid sequences encoding one or more amino acid sequences derived from a TP53 protein mutation. In some embodiments, the immunogenic composition comprises nucleic acid sequences encoding two or more amino acid sequences selected from the group consisting of SEQ ID NOs: 354 to 458.

In another aspect, the invention provides for an immunogenic peptide composition comprising one or more peptides selected from the group consisting of SEQ ID NOs: 354 to 458.

In some embodiments, the immunogenic peptide composition comprises two or more peptides selected from the group consisting of SEQ ID NOs: 354 to 458. In some embodiments, the one or more peptides is a modified or unmodified fragment of a mutated TP53 protein.

In another aspect, the invention provides for an immunogenic composition comprising nucleic acid sequences encoding one or more amino acid sequences selected from the group consisting of SEQ ID NOs: 141 to 272.

In some embodiments, the immunogenic composition comprises nucleic acid sequences encoding one or more amino acid sequences derived from a RAS protein mutation. In some embodiments, the immunogenic composition comprises nucleic acid sequences encoding two or more amino acid sequences selected from the group consisting of SEQ ID NOs: 141 to 272.

In another aspect, the invention provides for an immunogenic peptide composition comprising one or more peptides selected from the group consisting of SEQ ID NOs: 141 to 272.

In some embodiments, the immunogenic peptide composition comprises two or more peptides selected from the group consisting of SEQ ID NOs: 141 to 272. In some embodiments, the one or more peptides is a modified or unmodified fragment of a mutated RAS protein.

In another aspect, the invention provides for an immunogenic composition comprising nucleic acid sequences encoding one or more amino acid sequences selected from the group consisting of SEQ ID NOs: 19 to 33.

In some embodiments, the immunogenic composition comprises nucleic acid sequences encoding one or more amino acid sequences derived from a BRAF V600E protein mutation. In some embodiments, the immunogenic composition comprises nucleic acid sequences encoding two or more amino acid sequences selected from the group consisting of SEQ ID NOs: 19 to 33.

In another aspect, the invention provides for an immunogenic peptide composition comprising one or more peptides selected from the group consisting of SEQ ID NOs: 19 to 33.

In some embodiments, the immunogenic peptide composition comprises two or more peptides selected from the group consisting of SEQ ID NOs: 19 to 33. In some embodiments, the immunogenic peptide composition comprises a peptide derived from a BRAF V600E protein mutation.

In another aspect, the invention provides for an immunogenic composition comprising nucleic acid sequences encoding one or more amino acid sequences selected from the group consisting of SEQ ID NOs: 34 to 50.

In some embodiments, the immunogenic composition comprises nucleic acid sequences encoding one or more amino acid sequences derived from a BRAF V600M protein mutation. In some embodiments, the immunogenic composition comprises nucleic acid sequences encoding two or more amino acid sequences selected from the group consisting of SEQ ID NOs: 34 to 50.

In another aspect, the invention provides for an immunogenic peptide composition comprising one or more peptides selected from the group consisting of SEQ ID NOs: 34 to 50.

In some embodiments, the immunogenic peptide composition comprises two or more peptides selected from the group consisting of SEQ ID NOs: 34 to 50. In some embodiments, the immunogenic peptide composition comprises a peptide derived from a BRAF V600M protein mutation.

In another aspect, the invention provides for an immunogenic composition comprising nucleic acid sequences encoding one or more amino acid sequences selected from the group consisting of SEQ ID NOs: 51 to 66.

In some embodiments, the immunogenic composition comprises nucleic acid sequences encoding one or more amino acid sequences derived from a EGFR A289V protein mutation. In some embodiments, the immunogenic composition comprises nucleic acid sequences encoding two or more amino acid sequences selected from the group consisting of SEQ ID NOs: 51 to 66.

In another aspect, the invention provides for an immunogenic peptide composition comprising one or more peptides selected from the group consisting of SEQ ID NOs: 51 to 66.

In some embodiments, the immunogenic peptide composition comprises two or more peptides selected from the group consisting of SEQ ID NOs: 51 to 66. In some embodiments, the immunogenic peptide composition comprises a peptide derived from a EGFR A289V protein mutation.

In another aspect, the invention provides for an immunogenic composition comprising nucleic acid sequences encoding one or more amino acid sequences selected from the group consisting of SEQ ID NOs: 67 to 81.

In some embodiments, the immunogenic composition comprises nucleic acid sequences encoding one or more amino acid sequences derived from a EGFR G598V protein mutation. In some embodiments, the immunogenic composition comprises nucleic acid sequences encoding two or more amino acid sequences selected from the group consisting of SEQ ID NOs: 67 to 81.

In another aspect, the invention provides for an immunogenic peptide composition comprising one or more peptides selected from the group consisting of SEQ ID NOs: 67 to 81.

In some embodiments, the immunogenic peptide composition comprises two or more peptides selected from the group consisting of SEQ ID NOs: 67 to 81. In some embodiments, the immunogenic peptide composition comprises a peptide derived from a EGFR G598V protein mutation.

In another aspect, the invention provides for an immunogenic composition comprising nucleic acid sequences encoding one or more amino acid sequences selected from the group consisting of SEQ ID NOs: 82 to 98.

In some embodiments, the immunogenic composition comprises nucleic acid sequences encoding one or more amino acid sequences derived from a EGFR L858R protein mutation. In some embodiments, the immunogenic composition comprises nucleic acid sequences encoding two or more amino acid sequences selected from the group consisting of SEQ ID NOs: 82 to 98.

In another aspect, the invention provides for an immunogenic peptide composition comprising one or more peptides selected from the group consisting of SEQ ID NOs: 82 to 98.

In some embodiments, the immunogenic peptide composition comprises two or more peptides selected from the group consisting of SEQ ID NOs: 82 to 98. In some embodiments, the immunogenic peptide composition comprises a peptide derived from a EGFR L858R protein mutation.

In another aspect, the invention provides for an immunogenic composition comprising nucleic acid sequences encoding one or more amino acid sequences selected from the group consisting of SEQ ID NOs: 125 to 140.

In some embodiments, the immunogenic composition comprises nucleic acid sequences encoding one or more amino acid sequences derived from a IDH1 R132H protein mutation. In some embodiments, the immunogenic composition comprises nucleic acid sequences encoding two or more amino acid sequences selected from the group consisting of SEQ ID NOs: 125 to 140.

In another aspect, the invention provides for an immunogenic peptide composition comprising one or more peptides selected from the group consisting of SEQ ID NOs: 125 to 140.

In some embodiments, the immunogenic peptide composition comprises two or more peptides selected from the group consisting of SEQ ID NOs: 125 to 140. In some embodiments, the immunogenic peptide composition comprises a peptide derived from a IDH1 R132H protein mutation.

In another aspect, the invention provides for an immunogenic composition comprising nucleic acid sequences encoding one or more amino acid sequences selected from the group consisting of SEQ ID NOs: 119 to 124.

In some embodiments, the immunogenic composition comprises nucleic acid sequences encoding one or more amino acid sequences derived from a IDH1 R132C protein mutation. In some embodiments, the immunogenic composition comprises nucleic acid sequences encoding two or more amino acid sequences selected from the group consisting of SEQ ID NOs: 119 to 124.

In another aspect, the invention provides for an immunogenic peptide composition comprising one or more peptides selected from the group consisting of SEQ ID NOs: 119 to 124.

In some embodiments, the immunogenic peptide composition comprises two or more peptides selected from the group consisting of SEQ ID NOs: 119 to 124. In some embodiments, the immunogenic peptide composition comprises a peptide derived from a IDH1 R132C protein mutation.

In another aspect, the invention provides for an immunogenic composition comprising nucleic acid sequences encoding one or more amino acid sequences selected from the group consisting of SEQ ID NOs: 167 to 178.

In some embodiments, the immunogenic composition comprises nucleic acid sequences encoding one or more amino acid sequences derived from a KRAS G12D protein mutation. In some embodiments, the immunogenic composition comprises nucleic acid sequences encoding two or more amino acid sequences selected from the group consisting of SEQ ID NOs: 167 to 178.

In another aspect, the invention provides for an immunogenic peptide composition comprising one or more peptides selected from the group consisting of SEQ ID NOs: 167 to 178.

In some embodiments, the immunogenic peptide composition comprises two or more peptides selected from the group consisting of SEQ ID NOs: 167 to 178. In some embodiments, the immunogenic peptide composition comprises a peptide derived from a KRAS G12D protein mutation.

In another aspect, the invention provides for an immunogenic composition comprising nucleic acid sequences encoding one or more amino acid sequences selected from the group consisting of SEQ ID NOs: 203 to 213.

In some embodiments, the immunogenic composition comprises nucleic acid sequences encoding one or more amino acid sequences derived from a KRAS G12V protein mutation. In some embodiments, the immunogenic composition comprises nucleic acid sequences encoding two or more amino acid sequences selected from the group consisting of SEQ ID NOs: 203 to 213.

In another aspect, the invention provides for an immunogenic peptide composition comprising one or more peptides selected from the group consisting of SEQ ID NOs: 203 to 213.

In some embodiments, the immunogenic peptide composition comprises two or more peptides selected from the group consisting of SEQ ID NOs: 203 to 213. In some embodiments, the immunogenic peptide composition comprises a peptide derived from a KRAS G12V protein mutation.

In another aspect, the invention provides for an immunogenic composition comprising nucleic acid sequences encoding one or more amino acid sequences selected from the group consisting of SEQ ID NOs: 179 to 191.

In some embodiments, the immunogenic composition comprises nucleic acid sequences encoding one or more amino acid sequences derived from a KRAS G12R protein mutation. In some embodiments, the immunogenic composition comprises nucleic acid sequences encoding two or more amino acid sequences selected from the group consisting of SEQ ID NOs: 179 to 191.

In another aspect, the invention provides for an immunogenic peptide composition comprising one or more peptides selected from the group consisting of SEQ ID NOs: 179 to 191.

In some embodiments, the immunogenic peptide composition comprises two or more peptides selected from the group consisting of SEQ ID NOs: 179 to 191. In some embodiments, the immunogenic peptide composition comprises a peptide derived from a KRAS G12R protein mutation.

In another aspect, the invention provides for an immunogenic composition comprising nucleic acid sequences encoding one or more amino acid sequences selected from the group consisting of SEQ ID NOs: 154 to 166.

In some embodiments, the immunogenic composition comprises nucleic acid sequences encoding one or more amino acid sequences derived from a KRAS G12C protein mutation. In some embodiments, the immunogenic composition comprises nucleic acid sequences encoding two or more amino acid sequences selected from the group consisting of SEQ ID NOs: 154 to 166.

In another aspect, the invention provides for an immunogenic peptide composition comprising one or more peptides selected from the group consisting of SEQ ID NOs: 154 to 166.

In some embodiments, the immunogenic peptide composition comprises two or more peptides selected from the group consisting of SEQ ID NOs: 154 to 166. In some embodiments, the immunogenic peptide composition comprises a peptide derived from a KRAS G12C protein mutation.

In another aspect, the invention provides for an immunogenic composition comprising nucleic acid sequences encoding one or more amino acid sequences selected from the group consisting of SEQ ID NOs: 214 to 229.

In some embodiments, the immunogenic composition comprises nucleic acid sequences encoding one or more amino acid sequences derived from a KRAS G13D protein mutation. In some embodiments, the immunogenic composition comprises nucleic acid sequences encoding two or more amino acid sequences selected from the group consisting of SEQ ID NOs: 214 to 229.

In another aspect, the invention provides for an immunogenic peptide composition comprising one or more peptides selected from the group consisting of SEQ ID NOs: 214 to 229.

In some embodiments, the immunogenic peptide composition comprises two or more peptides selected from the group consisting of SEQ ID NOs: 214 to 229. In some embodiments, the immunogenic peptide composition comprises a peptide derived from a KRAS G13D protein mutation.

In another aspect, the invention provides for an immunogenic composition comprising nucleic acid sequences encoding one or more amino acid sequences selected from the group consisting of SEQ ID NOs: 141 to 153.

In some embodiments, the immunogenic composition comprises nucleic acid sequences encoding one or more amino acid sequences derived from a KRAS G12A protein mutation. In some embodiments, the immunogenic composition comprises nucleic acid sequences encoding two or more amino acid sequences selected from the group consisting of SEQ ID NOs: 141 to 153.

In another aspect, the invention provides for an immunogenic peptide composition comprising one or more peptides selected from the group consisting of SEQ ID NOs: 141 to 153.

In some embodiments, the immunogenic peptide composition comprises two or more peptides selected from the group consisting of SEQ ID NOs: 141 to 153. In some embodiments, the immunogenic peptide composition comprises a peptide derived from a KRAS G12A protein mutation.

In another aspect, the invention provides for an immunogenic composition comprising nucleic acid sequences encoding one or more amino acid sequences selected from the group consisting of SEQ ID NOs: 192 to 202.

In some embodiments, the immunogenic composition comprises nucleic acid sequences encoding one or more amino acid sequences derived from a KRAS G12S protein mutation. In some embodiments, the immunogenic composition comprises nucleic acid sequences encoding two or more amino acid sequences selected from the group consisting of SEQ ID NOs: 192 to 202.

In another aspect, the invention provides for an immunogenic peptide composition comprising one or more peptides selected from the group consisting of SEQ ID NOs: 192 to 202.

In some embodiments, the immunogenic peptide composition comprises two or more peptides selected from the group consisting of SEQ ID NOs: 192 to 202. In some embodiments, the immunogenic peptide composition comprises a peptide derived from a KRAS G12S protein mutation.

In another aspect, the invention provides for an immunogenic composition comprising nucleic acid sequences encoding one or more amino acid sequences selected from the group consisting of SEQ ID NOs: 256 to 272.

In some embodiments, the immunogenic composition comprises nucleic acid sequences encoding one or more amino acid sequences derived from a NRAS Q61R protein mutation. In some embodiments, the immunogenic composition comprises nucleic acid sequences encoding two or more amino acid sequences selected from the group consisting of SEQ ID NOs: 256 to 272.

In another aspect, the invention provides for an immunogenic peptide composition comprising one or more peptides selected from the group consisting of SEQ ID NOs: 256 to 272.

In some embodiments, the immunogenic peptide composition comprises two or more peptides selected from the group consisting of SEQ ID NOs: 256 to 272. In some embodiments, the immunogenic peptide composition comprises a peptide derived from a NRAS Q61R protein mutation.

In another aspect, the invention provides for an immunogenic composition comprising nucleic acid sequences encoding one or more amino acid sequences selected from the group consisting of SEQ ID NOs: 230 to 238.

In some embodiments, the immunogenic composition comprises nucleic acid sequences encoding one or more amino acid sequences derived from a NRAS Q61K protein mutation. In some embodiments, the immunogenic composition comprises nucleic acid sequences encoding two or more amino acid sequences selected from the group consisting of SEQ ID NOs: 230 to 238.

In another aspect, the invention provides for an immunogenic peptide composition comprising one or more peptides selected from the group consisting of SEQ ID NOs: 230 to 238.

In some embodiments, the immunogenic peptide composition comprises two or more peptides selected from the group consisting of SEQ ID NOs: 230 to 238. In some embodiments, the immunogenic peptide composition comprises a peptide derived from a NRAS Q61K protein mutation.

In another aspect, the invention provides for an immunogenic composition comprising nucleic acid sequences encoding one or more amino acid sequences selected from the group consisting of SEQ ID NOs: 239 to 255.

In some embodiments, the immunogenic composition comprises nucleic acid sequences encoding one or more amino acid sequences derived from a NRAS Q61L protein mutation. In some embodiments, the immunogenic composition comprises nucleic acid sequences encoding two or more amino acid sequences selected from the group consisting of SEQ ID NOs: 239 to 255.

In another aspect, the invention provides for an immunogenic peptide composition comprising one or more peptides selected from the group consisting of SEQ ID NOs: 239 to 255.

In some embodiments, the immunogenic peptide composition comprises two or more peptides selected from the group consisting of SEQ ID NOs: 239 to 255. In some embodiments, the immunogenic peptide composition comprises a peptide derived from a NRAS Q61L protein mutation.

In another aspect, the invention provides for an immunogenic composition comprising nucleic acid sequences encoding one or more amino acid sequences selected from the group consisting of SEQ ID NOs: 273 to 285.

In some embodiments, the immunogenic composition comprises nucleic acid sequences encoding one or more amino acid sequences derived from a PIK3CA E542K protein mutation. In some embodiments, the immunogenic composition comprises nucleic acid sequences encoding two or more amino acid sequences selected from the group consisting of SEQ ID NOs: 273 to 285.

In another aspect, the invention provides for an immunogenic peptide composition comprising one or more peptides selected from the group consisting of SEQ ID NOs: 273 to 285.

In some embodiments, the immunogenic peptide composition comprises two or more peptides selected from the group consisting of SEQ ID NOs: 273 to 285. In some embodiments, the immunogenic peptide composition comprises a peptide derived from a PIK3CA E542K protein mutation.

In another aspect, the invention provides for an immunogenic composition comprising nucleic acid sequences encoding one or more amino acid sequences selected from the group consisting of SEQ ID NOs: 286 to 293.

In some embodiments, the immunogenic composition comprises nucleic acid sequences encoding one or more amino acid sequences derived from a PIK3CA E545K protein mutation. In some embodiments, the immunogenic composition comprises nucleic acid sequences encoding two or more amino acid sequences selected from the group consisting of SEQ ID NOs: 286 to 293.

In another aspect, the invention provides for an immunogenic peptide composition comprising one or more peptides selected from the group consisting of SEQ ID NOs: 286 to 293.

In some embodiments, the immunogenic peptide composition comprises two or more peptides selected from the group consisting of SEQ ID NOs: 286 to 293. In some embodiments, the immunogenic peptide composition comprises a peptide derived from a PIK3CA E545K protein mutation.

In another aspect, the invention provides for an immunogenic composition comprising nucleic acid sequences encoding one or more amino acid sequences selected from the group consisting of SEQ ID NOs: 294 to 309.

In some embodiments, the immunogenic composition comprises nucleic acid sequences encoding one or more amino acid sequences derived from a PIK3CA H1047R protein mutation. In some embodiments, the immunogenic composition comprises nucleic acid sequences encoding two or more amino acid sequences selected from the group consisting of SEQ ID NOs: 294 to 309.

In another aspect, the invention provides for an immunogenic peptide composition comprising one or more peptides selected from the group consisting of SEQ ID NOs: 294 to 309.

In some embodiments, the immunogenic peptide composition comprises two or more peptides selected from the group consisting of SEQ ID NOs: 294 to 309. In some embodiments, the immunogenic peptide composition comprises a peptide derived from a PIK3CA H1047R protein mutation.

In another aspect, the invention provides for an immunogenic composition comprising nucleic acid sequences encoding one or more amino acid sequences selected from the group consisting of SEQ ID NOs: 359 to 374.

In some embodiments, the immunogenic composition comprises nucleic acid sequences encoding one or more amino acid sequences derived from a TP53 R158L protein mutation. In some embodiments, the immunogenic composition comprises nucleic acid sequences encoding two or more amino acid sequences selected from the group consisting of SEQ ID NOs: 359 to 374.

In another aspect, the invention provides for an immunogenic peptide composition comprising one or more peptides selected from the group consisting of SEQ ID NOs: 359 to 374.

In some embodiments, the immunogenic peptide composition comprises two or more peptides selected from the group consisting of SEQ ID NOs: 359 to 374. In some embodiments, the immunogenic peptide composition comprises a peptide derived from a TP53 R158L protein mutation.

In another aspect, the invention provides for an immunogenic composition comprising nucleic acid sequences encoding one or more amino acid sequences selected from the group consisting of SEQ ID NOs: 375 to 386.

In some embodiments, the immunogenic composition comprises nucleic acid sequences encoding one or more amino acid sequences derived from a TP53 R175H protein mutation. In some embodiments, the immunogenic composition comprises nucleic acid sequences encoding two or more amino acid sequences selected from the group consisting of SEQ ID NOs: 375 to 386.

In another aspect, the invention provides for an immunogenic peptide composition comprising one or more peptides selected from the group consisting of SEQ ID NOs: 375 to 386.

In some embodiments, the immunogenic peptide composition comprises two or more peptides selected from the group consisting of SEQ ID NOs: 375 to 386. In some embodiments, the immunogenic peptide composition comprises a peptide derived from a TP53 R175H protein mutation.

In another aspect, the invention provides for an immunogenic composition comprising nucleic acid sequences encoding one or more amino acid sequences selected from the group consisting of SEQ ID NOs: 387 to 401.

In some embodiments, the immunogenic composition comprises nucleic acid sequences encoding one or more amino acid sequences derived from a TP53 R248Q protein mutation. In some embodiments, the immunogenic composition comprises nucleic acid sequences encoding two or more amino acid sequences selected from the group consisting of SEQ ID NOs: 387 to 401.

In another aspect, the invention provides for an immunogenic peptide composition comprising one or more peptides selected from the group consisting of SEQ ID NOs: 387 to 401.

In some embodiments, the immunogenic peptide composition comprises two or more peptides selected from the group consisting of SEQ ID NOs: 387 to 401. In some embodiments, the immunogenic peptide composition comprises a peptide derived from a TP53 R248Q protein mutation.

In another aspect, the invention provides for an immunogenic composition comprising nucleic acid sequences encoding one or more amino acid sequences selected from the group consisting of SEQ ID NOs: 422 to 432.

In some embodiments, the immunogenic composition comprises nucleic acid sequences encoding one or more amino acid sequences derived from a TP53 R273C protein mutation. In some embodiments, the immunogenic composition comprises nucleic acid sequences encoding two or more amino acid sequences selected from the group consisting of SEQ ID NOs: 422 to 432.

In another aspect, the invention provides for an immunogenic peptide composition comprising one or more peptides selected from the group consisting of SEQ ID NOs: 422 to 432.

In some embodiments, the immunogenic peptide composition comprises two or more peptides selected from the group consisting of SEQ ID NOs: 422 to 432. In some embodiments, the immunogenic peptide composition comprises a peptide derived from a TP53 R273C protein mutation.

In another aspect, the invention provides for an immunogenic composition comprising nucleic acid sequences encoding one or more amino acid sequences selected from the group consisting of SEQ ID NOs: 433 to 446.

In some embodiments, the immunogenic composition comprises nucleic acid sequences encoding one or more amino acid sequences derived from a TP53 R273H protein mutation. In some embodiments, the immunogenic composition comprises nucleic acid sequences encoding two or more amino acid sequences selected from the group consisting of SEQ ID NOs: 433 to 446.

In another aspect, the invention provides for an immunogenic peptide composition comprising one or more peptides selected from the group consisting of SEQ ID NOs: 433 to 446.

In some embodiments, the immunogenic peptide composition comprises two or more peptides selected from the group consisting of SEQ ID NOs: 433 to 446. In some embodiments, the immunogenic peptide composition comprises a peptide derived from a TP53 R273H protein mutation.

In another aspect, the invention provides for an immunogenic composition comprising nucleic acid sequences encoding one or more amino acid sequences selected from the group consisting of SEQ ID NOs: 402 to 421.

In some embodiments, the immunogenic composition comprises nucleic acid sequences encoding one or more amino acid sequences derived from a TP53 R248W protein mutation. In some embodiments, the immunogenic composition comprises nucleic acid sequences encoding two or more amino acid sequences selected from the group consisting of SEQ ID NOs: 402 to 421.

In another aspect, the invention provides for an immunogenic peptide composition comprising one or more peptides selected from the group consisting of SEQ ID NOs: 402 to 421.

In some embodiments, the immunogenic peptide composition comprises two or more peptides selected from the group consisting of SEQ ID NOs: 402 to 421. In some embodiments, the immunogenic peptide composition comprises a peptide derived from a TP53 R248W protein mutation.

In another aspect, the invention provides for an immunogenic composition comprising nucleic acid sequences encoding one or more amino acid sequences selected from the group consisting of SEQ ID NOs: 447 to 449.

In some embodiments, the immunogenic composition comprises nucleic acid sequences encoding one or more amino acid sequences derived from a TP53 R282W protein mutation. In some embodiments, the immunogenic composition comprises nucleic acid sequences encoding two or more amino acid sequences selected from the group consisting of SEQ ID NOs: 447 to 449.

In another aspect, the invention provides for an immunogenic peptide composition comprising one or more peptides selected from the group consisting of SEQ ID NOs: 447 to 449.

In some embodiments, the immunogenic peptide composition comprises two or more peptides selected from the group consisting of SEQ ID NOs: 447 to 449. In some embodiments, the immunogenic peptide composition comprises a peptide derived from a TP53 R282W protein mutation.

In another aspect, the invention provides for an immunogenic composition comprising nucleic acid sequences encoding one or more amino acid sequences selected from the group consisting of SEQ ID NOs: 450 to 458.

In some embodiments, the immunogenic composition comprises nucleic acid sequences encoding one or more amino acid sequences derived from a TP53 Y220C protein mutation. In some embodiments, the immunogenic composition comprises nucleic acid sequences encoding two or more amino acid sequences selected from the group consisting of SEQ ID NOs: 450 to 458.

In another aspect, the invention provides for an immunogenic peptide composition comprising one or more peptides selected from the group consisting of SEQ ID NOs: 450 to 458.

In some embodiments, the immunogenic peptide composition comprises two or more peptides selected from the group consisting of SEQ ID NOs: 450 to 458. In some embodiments, the immunogenic peptide composition comprises a peptide derived from a TP53 Y220C protein mutation.

In another aspect, the invention provides for an immunogenic composition comprising nucleic acid sequences encoding one or more amino acid sequences selected from the group consisting of SEQ ID NOs: 310 to 322.

In some embodiments, the immunogenic composition comprises nucleic acid sequences encoding one or more amino acid sequences derived from a PIK3CA R88Q protein mutation. In some embodiments, the immunogenic composition comprises nucleic acid sequences encoding two or more amino acid sequences selected from the group consisting of SEQ ID NOs: 310 to 322.

In another aspect, the invention provides for an immunogenic peptide composition comprising one or more peptides selected from the group consisting of SEQ ID NOs: 310 to 322.

In some embodiments, the immunogenic peptide composition comprises two or more peptides selected from the group consisting of SEQ ID NOs: 310 to 322. In some embodiments, the immunogenic peptide composition comprises a peptide derived from a PIK3CA R88Q protein mutation.

In another aspect, the invention provides for an immunogenic composition comprising nucleic acid sequences encoding one or more amino acid sequences selected from the group consisting of SEQ ID NOs: 99 to 118.

In some embodiments, the immunogenic composition comprises nucleic acid sequences encoding one or more amino acid sequences derived from a GTF2I L424H protein mutation. In some embodiments, the immunogenic composition comprises nucleic acid sequences encoding two or more amino acid sequences selected from the group consisting of SEQ ID NOs: 99 to 118.

In another aspect, the invention provides for an immunogenic peptide composition comprising one or more peptides selected from the group consisting of SEQ ID NOs: 99 to 118.

In some embodiments, the immunogenic peptide composition comprises two or more peptides selected from the group consisting of SEQ ID NOs: 99 to 118. In some embodiments, the immunogenic peptide composition comprises a peptide derived from a GTF2I L424H protein mutation.

In another aspect, the invention provides for an immunogenic composition comprising nucleic acid sequences encoding one or more amino acid sequences selected from the group consisting of SEQ ID NOs: 338 to 353.

In some embodiments, the immunogenic composition comprises nucleic acid sequences encoding one or more amino acid sequences derived from a PTEN R130Q protein mutation. In some embodiments, the immunogenic composition comprises nucleic acid sequences encoding two or more amino acid sequences selected from the group consisting of SEQ ID NOs: 338 to 353.

In another aspect, the invention provides for an immunogenic peptide composition comprising one or more peptides selected from the group consisting of SEQ ID NOs: 338 to 353.

In some embodiments, the immunogenic peptide composition comprises two or more peptides selected from the group consisting of SEQ ID NOs: 338 to 353. In some embodiments, the immunogenic peptide composition comprises a peptide derived from a PTEN R130Q protein mutation.

In another aspect, the invention provides for an immunogenic composition comprising nucleic acid sequences encoding one or more amino acid sequences selected from the group consisting of SEQ ID NOs: 1 to 18.

In some embodiments, the immunogenic composition comprises nucleic acid sequences encoding one or more amino acid sequences derived from a AKT1 E17K protein mutation. In some embodiments, the immunogenic composition comprises nucleic acid sequences encoding two or more amino acid sequences selected from the group consisting of SEQ ID NOs: 1 to 18.

In another aspect, the invention provides for an immunogenic peptide composition comprising one or more peptides selected from the group consisting of SEQ ID NOs: 1 to 18.

In some embodiments, the immunogenic peptide composition comprises two or more peptides selected from the group consisting of SEQ ID NOs: 1 to 18. In some embodiments, the immunogenic peptide composition comprises a peptide derived from a AKT1 E17K protein mutation.

In another aspect, the invention provides for an immunogenic composition comprising nucleic acid sequences encoding one or more amino acid sequences selected from the group consisting of SEQ ID NOs: 323 to 337.

In some embodiments, the immunogenic composition comprises nucleic acid sequences encoding one or more amino acid sequences derived from a PTEN R130G protein mutation. In some embodiments, the immunogenic composition comprises nucleic acid sequences encoding two or more amino acid sequences selected from the group consisting of SEQ ID NOs: 323 to 337.

In another aspect, the invention provides for an immunogenic peptide composition comprising one or more peptides selected from the group consisting of SEQ ID NOs: 323 to 337.

In some embodiments, the immunogenic peptide composition comprises two or more peptides selected from the group consisting of SEQ ID NOs: 323 to 337. In some embodiments, the immunogenic peptide composition comprises a peptide derived from a PTEN R130G protein mutation.

In another aspect, the invention provides for an immunogenic composition comprising nucleic acid sequences encoding one or more amino acid sequences selected from the group consisting of SEQ ID NOs: 354 to 358.

In some embodiments, the immunogenic composition comprises nucleic acid sequences encoding one or more amino acid sequences derived from a TP53 H179R protein mutation. In some embodiments, the immunogenic composition comprises nucleic acid sequences encoding two or more amino acid sequences selected from the group consisting of SEQ ID NOs: 354 to 358.

In another aspect, the invention provides for an immunogenic peptide composition comprising one or more peptides selected from the group consisting of SEQ ID NOs: 354 to 358.

In some embodiments, the immunogenic peptide composition comprises two or more peptides selected from the group consisting of SEQ ID NOs: 354 to 358. In some embodiments, the immunogenic peptide composition comprises a peptide derived from a TP53 H179R protein mutation.

In another aspect, the invention provides for an immunogenic composition comprising nucleic acid sequences encoding one or more amino acid sequences selected from the group consisting of SEQ ID NOs: 168 to 169, SEQ ID NO: 171, SEQ ID NOs: 179 to 180, SEQ ID NOs: 182 to 183, SEQ ID NOs: 203 to 204, and SEQ ID NO: 207.

In some embodiments, the immunogenic composition comprises nucleic acid sequences encoding two or more amino acid sequences selected from the group consisting of SEQ ID NOs: 168 to 169, SEQ ID NO: 171, SEQ ID NOs: 179 to 180, SEQ ID NOs: 182 to 183, SEQ ID NOs: 203 to 204, and SEQ ID NO: 207. In some embodiments, the nucleic acid sequences are administered in a construct for expression in vivo. In some embodiments, the in vivo administration of the nucleic acid sequences is configured to produce one or more peptides that is displayed by an HLA class I molecule. In some embodiments, the one or more peptides is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, the one or more peptides is a modified or unmodified fragment of a protein with a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the nucleic acid sequences are administered in an effective amount to a subject to prevent cancer. In some embodiments, the nucleic acid sequences are administered in an effective amount to a subject to treat cancer. In some embodiments, the cancer is pancreatic cancer.

In another aspect, the invention provides for a method of treating or preventing pancreatic cancer by administering to a subject an immunogenic composition comprising nucleic acid sequences encoding one or more amino acid sequences selected from the group consisting of SEQ ID NOs: 168 to 169, SEQ ID NO: 171, SEQ ID NOs: 179 to 180, SEQ ID NOs: 182 to 183, SEQ ID NOs: 203 to 204, and SEQ ID NO: 207.

In some embodiments, the immunogenic composition comprises nucleic acid sequences encoding two or more amino acid sequences selected from the group consisting of SEQ ID NOs: 168 to 169, SEQ ID NO: 171, SEQ ID NOs: 179 to 180, SEQ ID NOs: 182 to 183, SEQ ID NOs: 203 to 204, and SEQ ID NO: 207.

In another aspect, the invention provides for an immunogenic peptide composition comprising one or more peptides selected from the group consisting of SEQ ID NOs: 168 to 169, SEQ ID NO: 171, SEQ ID NOs: 179 to 180, SEQ ID NOs: 182 to 183, SEQ ID NOs: 203 to 204, and SEQ ID NO: 207.

In some embodiments, the immunogenic peptide composition comprises two or more peptides selected from the group consisting of SEQ ID NOs: 168 to 169, SEQ ID NO: 171, SEQ ID NOs: 179 to 180, SEQ ID NOs: 182 to 183, SEQ ID NOs: 203 to 204, and SEQ ID NO: 207. In some embodiments, a peptide in the immunogenic peptide composition is displayed by an HLA class I molecule. In some embodiments, a peptide in the immunogenic peptide composition is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, a peptide in the immunogenic peptide composition is a modified or unmodified fragment of a protein, wherein the protein comprises a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the immunogenic peptide composition is administered in an effective amount to a subject to prevent cancer. In some embodiments, the immunogenic peptide composition is administered in an effective amount to a subject to treat cancer. In some embodiments, the cancer is pancreatic cancer.

In another aspect, the invention provides for a method of treating or preventing pancreatic cancer in a subject comprising administering to the subject an immunogenic peptide composition comprising one or more peptides selected from the group consisting of SEQ ID NOs: 168 to 169, SEQ ID NO: 171, SEQ ID NOs: 179 to 180, SEQ ID NOs: 182 to 183, SEQ ID NOs: 203 to 204, and SEQ ID NO: 207.

In some embodiments, the immunogenic peptide composition comprises two or more peptides selected from the group consisting of SEQ ID NOs: 168 to 169, SEQ ID NO: 171, SEQ ID NOs: 179 to 180, SEQ ID NOs: 182 to 183, SEQ ID NOs: 203 to 204, and SEQ ID NO: 207.

In another aspect, the invention provides for an immunogenic composition comprising nucleic acid sequences encoding one or more amino acid sequences selected from the group consisting of SEQ ID NOs: 19 to 23, SEQ ID NOs: 34 to 40, SEQ ID NOs: 230 to 231, SEQ ID NO: 239, SEQ ID NOs: 241 to 242, and SEQ ID NOs: 260 to 262.

In some embodiments, the immunogenic composition comprises nucleic acid sequences encoding two or more amino acid sequences selected from the group consisting of SEQ ID NOs: 19 to 23, SEQ ID NOs: 34 to 40, SEQ ID NOs: 230 to 231, SEQ ID NO: 239, SEQ ID NOs: 241 to 242, and SEQ ID NOs: 260 to 262. In some embodiments, the nucleic acid sequences are administered in a construct for expression in vivo. In some embodiments, the in vivo administration of the nucleic acid sequences is configured to produce one or more peptides that is displayed by an HLA class I molecule. In some embodiments, the one or more peptides is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, the one or more peptides is a modified or unmodified fragment of a protein with a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53

R273H, TP53 R282W, and TP53 Y220C. In some embodiments, the nucleic acid sequences are administered in an effective amount to a subject to prevent cancer. In some embodiments, the nucleic acid sequences are administered in an effective amount to a subject to treat cancer. In some embodiments, the cancer is skin cancer.

In another aspect, the invention provides for a method of treating or preventing skin cancer by administering to a subject an immunogenic composition comprising nucleic acid sequences encoding one or more amino acid sequences selected from the group consisting of SEQ ID NOs: 19 to 23, SEQ ID NOs: 34 to 40, SEQ ID NOs: 230 to 231, SEQ ID NO: 239, SEQ ID NOs: 241 to 242, and SEQ ID NOs: 260 to 262.

In some embodiments, the immunogenic composition comprises nucleic acid sequences encoding two or more amino acid sequences selected from the group consisting of SEQ ID NOs: 19 to 23, SEQ ID NOs: 34 to 40, SEQ ID NOs: 230 to 231, SEQ ID NO: 239, SEQ ID NOs: 241 to 242, and SEQ ID NOs: 260 to 262.

In another aspect, the invention provides for an immunogenic peptide composition comprising one or more peptides selected from the group consisting of SEQ ID NOs: 19 to 23, SEQ ID NOs: 34 to 40, SEQ ID NOs: 230 to 231, SEQ ID NO: 239, SEQ ID NOs: 241 to 242, and SEQ ID NOs: 260 to 262.

In some embodiments, the immunogenic peptide composition comprises two or more peptides selected from the group consisting of SEQ ID NOs: 19 to 23, SEQ ID NOs: 34 to 40, SEQ ID NOs: 230 to 231, SEQ ID NO: 239, SEQ ID NOs: 241 to 242, and SEQ ID NOs: 260 to 262. In some embodiments, a peptide in the immunogenic peptide composition is displayed by an HLA class I molecule. In some embodiments, a peptide in the immunogenic peptide composition is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, a peptide in the immunogenic peptide composition is a modified or unmodified fragment of a protein, wherein the protein comprises a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the immunogenic peptide composition is administered in an effective amount to a subject to prevent cancer. In some embodiments, the immunogenic peptide composition is administered in an effective amount to a subject to treat cancer. In some embodiments, the cancer is skin cancer.

In another aspect, the invention provides for a method of treating or preventing skin cancer in a subject comprising administering to the subject an immunogenic peptide composition comprising one or more peptides selected from the group consisting of SEQ ID NOs: 19 to 23, SEQ ID NOs: 34 to 40, SEQ ID NOs: 230 to 231, SEQ ID NO: 239, SEQ ID NOs: 241 to 242, and SEQ ID NOs: 260 to 262.

In some embodiments, the immunogenic peptide composition comprises two or more peptides selected from the group consisting of SEQ ID NOs: 19 to 23, SEQ ID NOs: 34 to 40, SEQ ID NOs: 230 to 231, SEQ ID NO: 239, SEQ ID NOs: 241 to 242, and SEQ ID NOs: 260 to 262.

In another aspect, the invention provides for an immunogenic composition comprising nucleic acid sequences encoding one or more amino acid sequences selected from the group consisting of SEQ ID NOs: 19 to 23, SEQ ID NOs: 230 to 231, and SEQ ID NOs: 260 to 262.

In some embodiments, the immunogenic composition comprises nucleic acid sequences encoding two or more amino acid sequences selected from the group consisting of SEQ ID NOs: 19 to 23, SEQ ID NOs: 230 to 231, and SEQ ID NOs: 260 to 262. In some embodiments, the nucleic acid sequences are administered in a construct for expression in vivo. In some embodiments, the in vivo administration of the nucleic acid sequences is configured to produce one or more peptides that is displayed by an HLA class I molecule. In some embodiments, the one or more peptides is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, the one or more peptides is a modified or unmodified fragment of a protein with a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the nucleic acid sequences are administered in an effective amount to a subject to prevent cancer. In some embodiments, the nucleic acid sequences are administered in an effective amount to a subject to treat cancer. In some embodiments, the cancer is thyroid cancer.

In another aspect, the invention provides for a method of treating or preventing thyroid cancer by administering to a subject an immunogenic composition comprising nucleic acid sequences encoding one or more amino acid sequences selected from the group consisting of SEQ ID NOs: 19 to 23, SEQ ID NOs: 230 to 231, and SEQ ID NOs: 260 to 262.

In some embodiments, the immunogenic composition comprises nucleic acid sequences encoding two or more amino acid sequences selected from the group consisting of SEQ ID NOs: 19 to 23, SEQ ID NOs: 230 to 231, and SEQ ID NOs: 260 to 262.

In another aspect, the invention provides for an immunogenic peptide composition comprising one or more peptides selected from the group consisting of SEQ ID NOs: 19 to 23, SEQ ID NOs: 230 to 231, and SEQ ID NOs: 260 to 262.

In some embodiments, the immunogenic peptide composition comprises two or more peptides selected from the group consisting of SEQ ID NOs: 19 to 23, SEQ ID NOs: 230 to 231, and SEQ ID NOs: 260 to 262. In some embodiments, a peptide in the immunogenic peptide composition is displayed by an HLA class I molecule. In some embodiments, a peptide in the immunogenic peptide composition is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, a peptide in the immunogenic peptide composition is a modified or unmodified fragment of a protein, wherein the protein comprises a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the immunogenic peptide composition is administered in an effective amount to a subject to prevent cancer. In some embodiments, the immunogenic peptide composition is administered in an effective amount to a subject to treat cancer. In some embodiments, the cancer is thyroid cancer.

In another aspect, the invention provides for a method of treating or preventing thyroid cancer in a subject comprising administering to the subject an immunogenic peptide composition comprising one or more peptides selected from the group consisting of SEQ ID NOs: 19 to 23, SEQ ID NOs: 230 to 231, and SEQ ID NOs: 260 to 262.

In some embodiments, the immunogenic peptide composition comprises two or more peptides selected from the group consisting of SEQ ID NOs: 19 to 23, SEQ ID NOs: 230 to 231, and SEQ ID NOs: 260 to 262.

In another aspect, the invention provides for an immunogenic composition comprising nucleic acid sequences encoding one or more amino acid sequences selected from the group consisting of SEQ ID NOs: 51 to 55, SEQ ID NOs: 67 to 70, SEQ ID NOs: 72 to 73, SEQ ID NOs: 119 to 120, SEQ ID NOs: 125 to 130, SEQ ID NO: 375, SEQ ID NO: 423, and SEQ ID NO: 425.

In some embodiments, the immunogenic composition comprises nucleic acid sequences encoding two or more amino acid sequences selected from the group consisting of SEQ ID NOs: 51 to 55, SEQ ID NOs: 67 to 70, SEQ ID NOs: 72 to 73, SEQ ID NOs: 119 to 120, SEQ ID NOs: 125 to 130, SEQ ID NO: 375, SEQ ID NO: 423, and SEQ ID NO: 425. In some embodiments, the nucleic acid sequences are administered in a construct for expression in vivo. In some embodiments, the in vivo administration of the nucleic acid sequences is configured to produce one or more peptides that is displayed by an HLA class I molecule. In some embodiments, the one or more peptides is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, the one or more peptides is a modified or unmodified fragment of a protein with a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the nucleic acid sequences are administered in an effective amount to a subject to prevent cancer. In some embodiments, the nucleic acid sequences are administered in an effective amount to a subject to treat cancer. In some embodiments, the cancer is brain cancer.

In another aspect, the invention provides for a method of treating or preventing brain cancer by administering to a subject an immunogenic composition comprising nucleic acid sequences encoding one or more amino acid sequences selected from the group consisting of SEQ ID NOs: 51 to 55, SEQ ID NOs: 67 to 70, SEQ ID NOs: 72 to 73, SEQ ID NOs: 119 to 120, SEQ ID NOs: 125 to 130, SEQ ID NO: 375, SEQ ID NO: 423, and SEQ ID NO: 425.

In some embodiments, the immunogenic composition comprises nucleic acid sequences encoding two or more amino acid sequences selected from the group consisting of SEQ ID NOs: 51 to 55, SEQ ID NOs: 67 to 70, SEQ ID NOs: 72 to 73, SEQ ID NOs: 119 to 120, SEQ ID NOs: 125 to 130, SEQ ID NO: 375, SEQ ID NO: 423, and SEQ ID NO: 425.

In another aspect, the invention provides for an immunogenic peptide composition comprising one or more peptides selected from the group consisting of SEQ ID NOs: 51 to 55, SEQ ID NOs: 67 to 70, SEQ ID NOs: 72 to 73, SEQ ID NOs: 119 to 120, SEQ ID NOs: 125 to 130, SEQ ID NO: 375, SEQ ID NO: 423, and SEQ ID NO: 425.

In some embodiments, the immunogenic peptide composition comprises two or more peptides selected from the group consisting of SEQ ID NOs: 51 to 55, SEQ ID NOs: 67 to 70, SEQ ID NOs: 72 to 73, SEQ ID NOs: 119 to 120, SEQ ID NOs: 125 to 130, SEQ ID NO: 375, SEQ ID NO: 423, and SEQ ID NO: 425. In some embodiments, a peptide in the immunogenic peptide composition is displayed by an HLA class I molecule. In some embodiments, a peptide in the immunogenic peptide composition is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, a peptide in the immunogenic peptide composition is a modified or unmodified fragment of a protein, wherein the protein comprises a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the immunogenic peptide composition is administered in an effective amount to a subject to prevent cancer. In some embodiments, the immunogenic peptide composition is administered in an effective amount to a subject to treat cancer. In some embodiments, the cancer is brain cancer.

In another aspect, the invention provides for a method of treating or preventing brain cancer in a subject comprising administering to the subject an immunogenic peptide composition comprising one or more peptides selected from the group consisting of SEQ ID NOs: 51 to 55, SEQ ID NOs: 67 to 70, SEQ ID NOs: 72 to 73, SEQ ID NOs: 119 to 120, SEQ ID NOs: 125 to 130, SEQ ID NO: 375, SEQ ID NO: 423, and SEQ ID NO: 425.

In some embodiments, the immunogenic peptide composition comprises two or more peptides selected from the group consisting of SEQ ID NOs: 51 to 55, SEQ ID NOs: 67 to 70, SEQ ID NOs: 72 to 73, SEQ ID NOs: 119 to 120, SEQ ID NOs: 125 to 130, SEQ ID NO: 375, SEQ ID NO: 423, and SEQ ID NO: 425.

In another aspect, the invention provides for an immunogenic composition comprising nucleic acid sequences encoding one or more amino acid sequences selected from the group consisting of SEQ ID NOs: 20 to 23, SEQ ID NOs: 167 to 169, SEQ ID NO: 171, SEQ ID NOs: 203 to 207, SEQ ID NOs: 215 to 217, and SEQ ID NO: 288.

In some embodiments, the immunogenic composition comprises nucleic acid sequences encoding two or more amino acid sequences selected from the group consisting of SEQ ID NOs: 20 to 23, SEQ ID NOs: 167 to 169, SEQ ID NO: 171, SEQ ID NOs: 203 to 207, SEQ ID NOs: 215 to 217, and SEQ ID NO: 288. In some embodiments, the nucleic acid sequences are administered in a construct for expression in vivo. In some embodiments, the in vivo administration of the nucleic acid sequences is configured to produce one or more peptides that is displayed by an HLA class I molecule. In some embodiments, the one or more peptides is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, the one or more peptides is a modified or unmodified fragment of a protein with a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the nucleic acid sequences are administered in an effective amount to a subject to prevent cancer. In some embodiments, the nucleic acid sequences are administered in an effective amount to a subject to treat cancer. In some embodiments, the cancer is colorectal cancer.

In another aspect, the invention provides for a method of treating or preventing colorectal cancer by administering to a subject an immunogenic composition comprising nucleic acid sequences encoding one or more amino acid sequences selected from the group consisting of SEQ ID NOs: 20 to 23, SEQ ID NOs: 167 to 169, SEQ ID NO: 171, SEQ ID NOs: 203 to 207, SEQ ID NOs: 215 to 217, and SEQ ID NO: 288.

In some embodiments, the immunogenic composition comprises nucleic acid sequences encoding two or more amino acid sequences selected from the group consisting of SEQ ID NOs: 20 to 23, SEQ ID NOs: 167 to 169, SEQ ID NO: 171, SEQ ID NOs: 203 to 207, SEQ ID NOs: 215 to 217, and SEQ ID NO: 288.

In another aspect, the invention provides for an immunogenic peptide composition comprising one or more peptides selected from the group consisting of SEQ ID NOs: 20 to 23, SEQ ID NOs: 167 to 169, SEQ ID NO: 171, SEQ ID NOs: 203 to 207, SEQ ID NOs: 215 to 217, and SEQ ID NO: 288.

In some embodiments, the immunogenic peptide composition comprises two or more peptides selected from the group consisting of SEQ ID NOs: 20 to 23, SEQ ID NOs: 167 to 169, SEQ ID NO: 171, SEQ ID NOs: 203 to 207, SEQ ID NOs: 215 to 217, and SEQ ID NO: 288. In some embodiments, a peptide in the immunogenic peptide composition is displayed by an HLA class I molecule. In some embodiments, a peptide in the immunogenic peptide composition is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, a peptide in the immunogenic peptide composition is a modified or unmodified fragment of a protein, wherein the protein comprises a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the immunogenic peptide composition is administered in an effective amount to a subject to prevent cancer. In some embodiments, the immunogenic peptide composition is administered in an effective amount to a subject to treat cancer. In some embodiments, the cancer is colorectal cancer.

In another aspect, the invention provides for a method of treating or preventing colorectal cancer in a subject comprising administering to the subject an immunogenic peptide composition comprising one or more peptides selected from the group consisting of SEQ ID NOs: 20 to 23, SEQ ID NOs: 167 to 169, SEQ ID NO: 171, SEQ ID NOs: 203 to 207, SEQ ID NOs: 215 to 217, and SEQ ID NO: 288.

In some embodiments, the immunogenic peptide composition comprises two or more peptides selected from the group consisting of SEQ ID NOs: 20 to 23, SEQ ID NOs: 167 to 169, SEQ ID NO: 171, SEQ ID NOs: 203 to 207, SEQ ID NOs: 215 to 217, and SEQ ID NO: 288.

In another aspect, the invention provides for an immunogenic composition comprising nucleic acid sequences encoding one or more amino acid sequences selected from the group consisting of SEQ ID NOs: 82 to 86, SEQ ID NOs: 141 to 144, SEQ ID NOs: 154 to 159, SEQ ID NOs: 168 to 169, SEQ ID NO: 171, SEQ ID NOs: 203 to 204, SEQ ID NO: 207, SEQ ID NOs: 274 to 276, SEQ ID NO: 288, SEQ ID NO: 359, and SEQ ID NOs: 362 to 364.

In some embodiments, the immunogenic composition comprises nucleic acid sequences encoding two or more amino acid sequences selected from the group consisting of SEQ ID NOs: 82 to 86, SEQ ID NOs: 141 to 144, SEQ ID NOs: 154 to 159, SEQ ID NOs: 168 to 169, SEQ ID NO: 171, SEQ ID NOs: 203 to 204, SEQ ID NO: 207, SEQ ID NOs: 274 to 276, SEQ ID NO: 288, SEQ ID NO: 359, and SEQ ID NOs: 362 to 364. In some embodiments, the nucleic acid sequences are administered in a construct for expression in vivo. In some embodiments, the in vivo administration of the nucleic acid sequences is configured to produce one or more peptides that is displayed by an HLA class I molecule. In some embodiments, the one or more peptides is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, the one or more peptides is a modified or unmodified fragment of a protein with a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the nucleic acid sequences are administered in an effective amount to a subject to prevent cancer. In some embodiments, the nucleic acid sequences are administered in an effective amount to a subject to treat cancer. In some embodiments, the cancer is bronchus and lung cancer.

In another aspect, the invention provides for a method of treating or preventing bronchus and lung cancer by administering to a subject an immunogenic composition comprising nucleic acid sequences encoding one or more amino acid sequences selected from the group consisting of SEQ ID NOs: 82 to 86, SEQ ID NOs: 141 to 144, SEQ ID NOs: 154 to 159, SEQ ID NOs: 168 to 169, SEQ ID NO: 171, SEQ ID NOs: 203 to 204, SEQ ID NO: 207, SEQ ID NOs: 274 to 276, SEQ ID NO: 288, SEQ ID NO: 359, and SEQ ID NOs: 362 to 364.

In some embodiments, the immunogenic composition comprises nucleic acid sequences encoding two or more amino acid sequences selected from the group consisting of SEQ ID NOs: 82 to 86, SEQ ID NOs: 141 to 144, SEQ ID NOs: 154 to 159, SEQ ID NOs: 168 to 169, SEQ ID NO: 171, SEQ ID NOs: 203 to 204, SEQ ID NO: 207, SEQ ID NOs: 274 to 276, SEQ ID NO: 288, SEQ ID NO: 359, and SEQ ID NOs: 362 to 364.

In another aspect, the invention provides for an immunogenic peptide composition comprising one or more peptides selected from the group consisting of SEQ ID NOs: 82 to 86, SEQ ID NOs: 141 to 144, SEQ ID NOs: 154 to 159, SEQ ID NOs: 168 to 169, SEQ ID NO: 171, SEQ ID NOs: 203 to 204, SEQ ID NO: 207, SEQ ID NOs: 274 to 276, SEQ ID NO: 288, SEQ ID NO: 359, and SEQ ID NOs: 362 to 364.

In some embodiments, the immunogenic peptide composition comprises two or more peptides selected from the group consisting of SEQ ID NOs: 82 to 86, SEQ ID NOs: 141 to 144, SEQ ID NOs: 154 to 159, SEQ ID NOs: 168 to 169, SEQ ID NO: 171, SEQ ID NOs: 203 to 204, SEQ ID NO: 207, SEQ ID NOs: 274 to 276, SEQ ID NO: 288, SEQ ID NO: 359, and SEQ ID NOs: 362 to 364. In some embodiments, a peptide in the immunogenic peptide composition is displayed by an HLA class I molecule. In some embodiments, a peptide in the immunogenic peptide composition is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, a peptide in the immunogenic peptide composition is a modified or unmodified fragment of a protein, wherein the protein comprises a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the immunogenic peptide composition is administered in an effective amount to a subject to prevent cancer. In some embodiments, the immunogenic peptide composition is administered in an effective amount to a subject to treat cancer. In some embodiments, the cancer is bronchus and lung cancer.

In another aspect, the invention provides for a method of treating or preventing bronchus and lung cancer in a subject comprising administering to the subject an immunogenic peptide composition comprising one or more peptides selected from the group consisting of SEQ ID NOs: 82 to 86, SEQ ID NOs: 141 to 144, SEQ ID NOs: 154 to 159, SEQ ID NOs: 168 to 169, SEQ ID NO: 171, SEQ ID NOs: 203 to 204, SEQ ID NO: 207, SEQ ID NOs: 274 to 276, SEQ ID NO: 288, SEQ ID NO: 359, and SEQ ID NOs: 362 to 364.

In some embodiments, the immunogenic peptide composition comprises two or more peptides selected from the group consisting of SEQ ID NOs: 82 to 86, SEQ ID NOs: 141 to 144, SEQ ID NOs: 154 to 159, SEQ ID NOs: 168 to 169, SEQ ID NOs: 203 to 204, SEQ ID NO: 207, SEQ ID NOs: 274 to 276, SEQ ID NO: 288, SEQ ID NO: 359, and SEQ ID NOs: 362 to 364.

In another aspect, the invention provides for an immunogenic composition comprising nucleic acid sequences encoding one or more amino acid sequences selected from the group consisting of SEQ ID NOs: 273 to 309, SEQ ID NOs: 375 to 386, and SEQ ID NOs: 422 to 446.

In some embodiments, the immunogenic composition comprises nucleic acid sequences encoding two or more amino acid sequences selected from the group consisting of SEQ ID NOs: 273 to 309, SEQ ID NOs: 375 to 386, and SEQ ID NOs: 422 to 446. In some embodiments, the nucleic acid sequences are administered in a construct for expression in vivo. In some embodiments, the in vivo administration of the nucleic acid sequences is configured to produce one or more peptides that is displayed by an HLA class I molecule. In some embodiments, the one or more peptides is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, the one or more peptides is a modified or unmodified fragment of a protein with a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the nucleic acid sequences are administered in an effective amount to a subject to prevent cancer. In some embodiments, the nucleic acid sequences are administered in an effective amount to a subject to treat cancer. In some embodiments, the cancer is breast cancer.

In another aspect, the invention provides for a method of treating or preventing breast cancer by administering to a subject an immunogenic composition comprising nucleic acid sequences encoding one or more amino acid sequences selected from the group consisting of SEQ ID NOs: 273 to 309, SEQ ID NOs: 375 to 386, and SEQ ID NOs: 422 to 446.

In some embodiments, the immunogenic composition comprises nucleic acid sequences encoding two or more amino acid sequences selected from the group consisting of SEQ ID NOs: 273 to 309, SEQ ID NOs: 375 to 386, and SEQ ID NOs: 422 to 446.

In another aspect, the invention provides for an immunogenic peptide composition comprising one or more peptides selected from the group consisting of SEQ ID NOs: 273 to 309, SEQ ID NOs: 375 to 386, and SEQ ID NOs: 422 to 446.

In some embodiments, the immunogenic peptide composition comprises two or more peptides selected from the group consisting of SEQ ID NOs: 273 to 309, SEQ ID NOs: 375 to 386, and SEQ ID NOs: 422 to 446. In some embodiments, a peptide in the immunogenic peptide composition is displayed by an HLA class I molecule. In some embodiments, a peptide in the immunogenic peptide composition is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, a peptide in the immunogenic peptide composition is a modified or unmodified fragment of a protein, wherein the protein comprises a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the immunogenic peptide composition is administered in an effective amount to a subject to prevent cancer. In some embodiments, the immunogenic peptide composition is administered in an effective amount to a subject to treat cancer. In some embodiments, the cancer is breast cancer.

In another aspect, the invention provides for a method of treating or preventing breast cancer in a subject comprising administering to the subject an immunogenic peptide composition comprising one or more peptides selected from the group consisting of SEQ ID NOs: 273 to 309, SEQ ID NOs: 375 to 386, and SEQ ID NOs: 422 to 446.

In some embodiments, the immunogenic peptide composition comprises two or more peptides selected from the group consisting of SEQ ID NOs: 273 to 309, SEQ ID NOs: 375 to 386, and SEQ ID NOs: 422 to 446.

In another aspect, the invention provides for an immunogenic composition comprising nucleic acid sequences encoding one or more amino acid sequences selected from the group consisting of SEQ ID NOs: 273 to 309, SEQ ID NOs: 375 to 386, and SEQ ID NOs: 422 to 446.

In some embodiments, the immunogenic composition comprises nucleic acid sequences encoding two or more amino acid sequences selected from the group consisting of SEQ ID NOs: 273 to 309, SEQ ID NOs: 375 to 386, and SEQ ID NOs: 422 to 446. In some embodiments, the nucleic acid sequences are administered in a construct for expression in vivo. In some embodiments, the in vivo administration of the nucleic acid sequences is configured to produce one or more peptides that is displayed by an HLA class I molecule. In some embodiments, the one or more peptides is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, the one or more peptides is a modified or unmodified fragment of a protein with a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the nucleic acid sequences are administered in an effective amount to a subject to prevent cancer. In some embodiments, the nucleic acid sequences are administered in an effective amount to a subject to treat cancer. In some embodiments, the cancer is ovarian cancer.

In another aspect, the invention provides for a method of treating or preventing ovarian cancer by administering to a subject an immunogenic composition comprising nucleic acid sequences encoding one or more amino acid sequences selected from the group consisting of SEQ ID NOs: 273 to 309, SEQ ID NOs: 375 to 386, and SEQ ID NOs: 422 to 446.

In some embodiments, the immunogenic composition comprises nucleic acid sequences encoding two or more amino acid sequences selected from the group consisting of SEQ ID NOs: 273 to 309, SEQ ID NOs: 375 to 386, and SEQ ID NOs: 422 to 446.

In another aspect, the invention provides for an immunogenic peptide composition comprising one or more peptides selected from the group consisting of SEQ ID NOs: 273 to 309, SEQ ID NOs: 375 to 386, and SEQ ID NOs: 422 to 446.

In some embodiments, the immunogenic peptide composition comprises two or more peptides selected from the group consisting of SEQ ID NOs: 273 to 309, SEQ ID NOs: 375 to 386, and SEQ ID NOs: 422 to 446. In some embodiments, a peptide in the immunogenic peptide composition is displayed by an HLA class I molecule. In some embodiments, a peptide in the immunogenic peptide composition is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, a peptide in the immunogenic peptide composition is a modified or unmodified fragment of a protein, wherein the protein comprises a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the immunogenic peptide composition is administered in an effective amount to a subject to prevent cancer. In some embodiments, the immunogenic peptide composition is administered in an effective amount to a subject to treat cancer. In some embodiments, the cancer is ovarian cancer.

In another aspect, the invention provides for a method of treating or preventing ovarian cancer in a subject comprising administering to the subject an immunogenic peptide composition comprising one or more peptides selected from the group consisting of SEQ ID NOs: 273 to 309, SEQ ID NOs: 375 to 386, and SEQ ID NOs: 422 to 446.

In some embodiments, the immunogenic peptide composition comprises two or more peptides selected from the group consisting of SEQ ID NOs: 273 to 309, SEQ ID NOs: 375 to 386, and SEQ ID NOs: 422 to 446.

In one aspect, the invention provides for nucleic acid sequences encoding one or more amino acid sequences selected from the group consisting of SEQ ID NOs: 475 to 759.

In some embodiments, the nucleic acid sequences encode two or more amino acid sequences selected from the group consisting of SEQ ID NOs: 475 to 759.

In another aspect, the invention provides for an immunogenic composition comprising nucleic acid sequences encoding one or more amino acid sequences selected from the group consisting of SEQ ID NOs: 475 to 759.

In some embodiments, the immunogenic composition is administered to a subject. In some embodiments, the immunogenic composition comprises nucleic acid sequences encoding two or more amino acid sequences selected from the group consisting of SEQ ID NOs: 475 to 759. In some embodiments, the nucleic acid sequences are administered in a construct for expression in vivo. In some embodiments, the in vivo administration of the nucleic acid sequences is configured to produce one or more peptides that is displayed by an HLA class II molecule. In some embodiments, the one or more peptides is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, the one or more peptides is a modified or unmodified fragment of a protein, wherein the protein comprises a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the immunogenic composition is administered in an effective amount to a subject to prevent cancer. In some embodiments, the immunogenic composition is administered in an effective amount to a subject to treat cancer. In some embodiments, the cancer is selected from the group consisting of pancreatic cancer, skin cancer, thyroid cancer, brain cancer, colorectal cancer, bronchus and lung cancer, breast cancer, and ovarian cancer. In some embodiments, the immunogenic composition comprises nucleic acid sequences encoding at least three amino acid sequences selected from the group consisting of SEQ ID NOs: 475 to 759.

In another aspect, the invention provides for an immunogenic peptide composition comprising one or more peptides selected from the group consisting of SEQ ID NOs: 475 to 759.

In some embodiments, the immunogenic peptide composition comprises two or more peptides selected from the group consisting of SEQ ID NOs: 475 to 759.

In another aspect, the invention provides for an immunogenic composition comprising nucleic acid sequences encoding one or more amino acid sequences selected from the group consisting of SEQ ID NOs: 475 to 483.

In some embodiments, the immunogenic composition comprises nucleic acid sequences encoding one or more amino acid sequences derived from a AKT1 protein mutation. In some embodiments, the immunogenic composition comprises nucleic acid sequences encoding two or more amino acid sequences selected from the group consisting of SEQ ID NOs: 475 to 483.

In another aspect, the invention provides for an immunogenic peptide composition comprising one or more peptides selected from the group consisting of SEQ ID NOs: 475 to 483.

In some embodiments, the immunogenic peptide composition comprises two or more peptides selected from the group consisting of SEQ ID NOs: 475 to 483. In some embodiments, the one or more peptides is a modified or unmodified fragment of a mutated AKT1 protein.

In another aspect, the invention provides for an immunogenic composition comprising nucleic acid sequences encoding one or more amino acid sequences selected from the group consisting of SEQ ID NOs: 484 to 502.

In some embodiments, the immunogenic composition comprises nucleic acid sequences encoding one or more amino acid sequences derived from a BRAF protein mutation. In some embodiments, the immunogenic composition comprises nucleic acid sequences encoding two or more amino acid sequences selected from the group consisting of SEQ ID NOs: 484 to 502.

In another aspect, the invention provides for an immunogenic peptide composition comprising one or more peptides selected from the group consisting of SEQ ID NOs: 484 to 502.

In some embodiments, the immunogenic peptide composition comprises two or more peptides selected from the group consisting of SEQ ID NOs: 484 to 502. In some embodiments, the one or more peptides is a modified or unmodified fragment of a mutated BRAF protein.

In another aspect, the invention provides for an immunogenic composition comprising nucleic acid sequences encoding one or more amino acid sequences selected from the group consisting of SEQ ID NOs: 503 to 527.

In some embodiments, the immunogenic composition comprises nucleic acid sequences encoding one or more amino acid sequences derived from a EGFR protein mutation. In some embodiments, the immunogenic composition comprises nucleic acid sequences encoding two or more amino acid sequences selected from the group consisting of SEQ ID NOs: 503 to 527.

In another aspect, the invention provides for an immunogenic peptide composition comprising one or more peptides selected from the group consisting of SEQ ID NOs: 503 to 527.

In some embodiments, the immunogenic peptide composition comprises two or more peptides selected from the group consisting of SEQ ID NOs: 503 to 527. In some embodiments, the one or more peptides is a modified or unmodified fragment of a mutated EGFR protein.

In another aspect, the invention provides for an immunogenic composition comprising nucleic acid sequences encoding one or more amino acid sequences selected from the group consisting of SEQ ID NOs: 528 to 534.

In some embodiments, the immunogenic composition comprises nucleic acid sequences encoding one or more amino acid sequences derived from a GTF2I protein mutation. In some embodiments, the immunogenic composition comprises nucleic acid sequences encoding two or more amino acid sequences selected from the group consisting of SEQ ID NOs: 528 to 534.

In another aspect, the invention provides for an immunogenic peptide composition comprising one or more peptides selected from the group consisting of SEQ ID NOs: 528 to 534.

In some embodiments, the immunogenic peptide composition comprises two or more peptides selected from the group consisting of SEQ ID NOs: 528 to 534. In some embodiments, the one or more peptides is a modified or unmodified fragment of a mutated GTF2I protein.

In another aspect, the invention provides for an immunogenic composition comprising nucleic acid sequences encoding one or more amino acid sequences selected from the group consisting of SEQ ID NOs: 535 to 553.

In some embodiments, the immunogenic composition comprises nucleic acid sequences encoding one or more amino acid sequences derived from a IDH1 protein mutation. In some embodiments, the immunogenic composition comprises nucleic acid sequences encoding two or more amino acid sequences selected from the group consisting of SEQ ID NOs: 535 to 553.

In another aspect, the invention provides for an immunogenic peptide composition comprising one or more peptides selected from the group consisting of SEQ ID NOs: 535 to 553.

In some embodiments, the immunogenic peptide composition comprises two or more peptides selected from the group consisting of SEQ ID NOs: 535 to 553. In some embodiments, the one or more peptides is a modified or unmodified fragment of a mutated IDH1 protein.

In another aspect, the invention provides for an immunogenic composition comprising nucleic acid sequences encoding one or more amino acid sequences selected from the group consisting of SEQ ID NOs: 554 to 615.

In some embodiments, the immunogenic composition comprises nucleic acid sequences encoding one or more amino acid sequences derived from a KRAS protein mutation. In some embodiments, the immunogenic composition comprises nucleic acid sequences encoding two or more amino acid sequences selected from the group consisting of SEQ ID NOs:
554 to 615.

In another aspect, the invention provides for an immunogenic peptide composition comprising one or more peptides selected from the group consisting of SEQ ID NOs: 554 to 615.

In some embodiments, the immunogenic peptide composition comprises two or more peptides selected from the group consisting of SEQ ID NOs: 554 to 615. In some embodiments, the one or more peptides is a modified or unmodified fragment of a mutated KRAS protein.

In another aspect, the invention provides for an immunogenic composition comprising nucleic acid sequences encoding one or more amino acid sequences selected from the group consisting of SEQ ID NOs: 616 to 645.

In some embodiments, the immunogenic composition comprises nucleic acid sequences encoding one or more amino acid sequences derived from a NRAS protein mutation. In some embodiments, the immunogenic composition comprises nucleic acid sequences encoding two or more amino acid sequences selected from the group consisting of SEQ ID NOs: 616 to 645.

In another aspect, the invention provides for an immunogenic peptide composition comprising one or more peptides selected from the group consisting of SEQ ID NOs: 616 to 645.

In some embodiments, the immunogenic peptide composition comprises two or more peptides selected from the group consisting of SEQ ID NOs: 616 to 645. In some embodiments, the one or more peptides is a modified or unmodified fragment of a mutated NRAS protein.

In another aspect, the invention provides for an immunogenic composition comprising nucleic acid sequences encoding one or more amino acid sequences selected from the group consisting of SEQ ID NOs: 646 to 675.

In some embodiments, the immunogenic composition comprises nucleic acid sequences encoding one or more amino acid sequences derived from a PIK3CA protein mutation. In some embodiments, the immunogenic composition comprises nucleic acid sequences encoding two or more amino acid sequences selected from the group consisting of SEQ ID NOs: 646 to 675.

In another aspect, the invention provides for an immunogenic peptide composition comprising one or more peptides selected from the group consisting of SEQ ID NOs: 646 to 675.

In some embodiments, the immunogenic peptide composition comprises two or more peptides selected from the group consisting of SEQ ID NOs: 646 to 675. In some embodiments, the one or more peptides is a modified or unmodified fragment of a mutated PIK3CA protein.

In another aspect, the invention provides for an immunogenic composition comprising nucleic acid sequences encoding one or more amino acid sequences selected from the group consisting of SEQ ID NOs: 676 to 690.

In some embodiments, the immunogenic composition comprises nucleic acid sequences encoding one or more amino acid sequences derived from a PTEN protein mutation. In some embodiments, the immunogenic composition comprises nucleic acid sequences encoding two or more amino acid sequences selected from the group consisting of SEQ ID NOs: 676 to 690.

In another aspect, the invention provides for an immunogenic peptide composition comprising one or more peptides selected from the group consisting of SEQ ID NOs: 676 to 690.

In some embodiments, the immunogenic peptide composition comprises two or more peptides selected from the group consisting of SEQ ID NOs: 676 to 690. In some embodiments, the one or more peptides is a modified or unmodified fragment of a mutated PTEN protein.

In another aspect, the invention provides for an immunogenic composition comprising nucleic acid sequences encoding one or more amino acid sequences selected from the group consisting of SEQ ID NOs: 691 to 758.

In some embodiments, the immunogenic composition comprises nucleic acid sequences encoding one or more amino acid sequences derived from a TP53 protein mutation. In some embodiments, the immunogenic composition comprises nucleic acid sequences encoding two or more amino acid sequences selected from the group consisting of SEQ ID NOs: 691 to 758.

In another aspect, the invention provides for an immunogenic peptide composition comprising one or more peptides selected from the group consisting of SEQ ID NOs: 691 to 758.

In some embodiments, the immunogenic peptide composition comprises two or more peptides selected from the group consisting of SEQ ID NOs: 691 to 758. In some embodiments, the one or more peptides is a modified or unmodified fragment of a mutated TP53 protein.

In another aspect, the invention provides for an immunogenic composition comprising nucleic acid sequences encoding one or more amino acid sequences selected from the group consisting of SEQ ID NOs: 554 to 645.

In some embodiments, the immunogenic composition comprises nucleic acid sequences encoding one or more amino acid sequences derived from a RAS protein mutation. In some embodiments, the immunogenic composition comprises nucleic acid sequences encoding two or more amino acid sequences selected from the group consisting of SEQ ID NOs: 554 to 645.

In another aspect, the invention provides for an immunogenic peptide composition comprising one or more peptides selected from the group consisting of SEQ ID NOs: 554 to 645.

In some embodiments, the immunogenic peptide composition comprises two or more peptides selected from the group consisting of SEQ ID NOs: 554 to 645. In some embodiments, the one or more peptides is a modified or unmodified fragment of a mutated RAS protein.

In another aspect, the invention provides for an immunogenic composition comprising nucleic acid sequences encoding one or more amino acid sequences selected from the group consisting of SEQ ID NOs: 484 to 494.

In some embodiments, the immunogenic composition comprises nucleic acid sequences encoding one or more amino acid sequences derived from a BRAF V600E protein mutation. In some embodiments, the immunogenic composition comprises nucleic acid sequences encoding two or more amino acid sequences selected from the group consisting of SEQ ID NOs: 484 to 494.

In another aspect, the invention provides for an immunogenic peptide composition comprising one or more peptides selected from the group consisting of SEQ ID NOs: 484 to 494.

In some embodiments, the immunogenic peptide composition comprises two or more peptides selected from the group consisting of SEQ ID NOs: 484 to 494. In some embodiments, the immunogenic peptide composition comprises a peptide derived from a BRAF V600E protein mutation.

In another aspect, the invention provides for an immunogenic composition comprising nucleic acid sequences encoding one or more amino acid sequences selected from the group consisting of SEQ ID NOs: 495 to 502.

In some embodiments, the immunogenic composition comprises nucleic acid sequences encoding one or more amino acid sequences derived from a BRAF V600M protein mutation. In some embodiments, the immunogenic composition comprises nucleic acid sequences encoding two or more amino acid sequences selected from the group consisting of SEQ ID NOs: 495 to 502.

In another aspect, the invention provides for an immunogenic peptide composition comprising one or more peptides selected from the group consisting of SEQ ID NOs: 495 to 502.

In some embodiments, the immunogenic peptide composition comprises two or more peptides selected from the group consisting of SEQ ID NOs: 495 to 502. In some embodiments, the immunogenic peptide composition comprises a peptide derived from a BRAF V600M protein mutation.

In another aspect, the invention provides for an immunogenic composition comprising nucleic acid sequences encoding one or more amino acid sequences selected from the group consisting of SEQ ID NOs: 503 to 509.

In some embodiments, the immunogenic composition comprises nucleic acid sequences encoding one or more amino acid sequences derived from a EGFR A289V protein mutation. In some embodiments, the immunogenic composition comprises nucleic acid sequences encoding two or more amino acid sequences selected from the group consisting of SEQ ID NOs: 503 to 509.

In another aspect, the invention provides for an immunogenic peptide composition comprising one or more peptides selected from the group consisting of SEQ ID NOs: 503 to 509.

In some embodiments, the immunogenic peptide composition comprises two or more peptides selected from the group consisting of SEQ ID NOs: 503 to 509. In some embodiments, the immunogenic peptide composition comprises a peptide derived from a EGFR A289V protein mutation.

In another aspect, the invention provides for an immunogenic composition comprising nucleic acid sequences encoding one or more amino acid sequences selected from the group consisting of SEQ ID NOs: 510 to 519.

In some embodiments, the immunogenic composition comprises nucleic acid sequences encoding one or more amino acid sequences derived from a EGFR G598V protein mutation. In some embodiments, the immunogenic composition comprises nucleic acid sequences encoding two or more amino acid sequences selected from the group consisting of SEQ ID NOs: 510 to 519.

In another aspect, the invention provides for an immunogenic peptide composition comprising one or more peptides selected from the group consisting of SEQ ID NOs: 510 to 519.

In some embodiments, the immunogenic peptide composition comprises two or more peptides selected from the group consisting of SEQ ID NOs: 510 to 519. In some embodiments, the immunogenic peptide composition comprises a peptide derived from a EGFR G598V protein mutation.

In another aspect, the invention provides for an immunogenic composition comprising nucleic acid sequences encoding one or more amino acid sequences selected from the group consisting of SEQ ID NOs: 520 to 527.

In some embodiments, the immunogenic composition comprises nucleic acid sequences encoding one or more amino acid sequences derived from a EGFR L858R protein mutation. In some embodiments, the immunogenic composition comprises nucleic acid sequences encoding two or more amino acid sequences selected from the group consisting of SEQ ID NOs: 520 to 527.

In another aspect, the invention provides for an immunogenic peptide composition comprising one or more peptides selected from the group consisting of SEQ ID NOs: 520 to 527.

In some embodiments, the immunogenic peptide composition comprises two or more peptides selected from the group consisting of SEQ ID NOs: 520 to 527. In some embodiments, the immunogenic peptide composition comprises a peptide derived from a EGFR L858R protein mutation.

In another aspect, the invention provides for an immunogenic composition comprising nucleic acid sequences encoding one or more amino acid sequences selected from the group consisting of SEQ ID NOs: 543 to 553.

In some embodiments, the immunogenic composition comprises nucleic acid sequences encoding one or more amino acid sequences derived from a IDH1 R132H protein mutation. In some embodiments, the immunogenic composition comprises nucleic acid sequences encoding two or more amino acid sequences selected from the group consisting of SEQ ID NOs: 543 to 553.

In another aspect, the invention provides for an immunogenic peptide composition comprising one or more peptides selected from the group consisting of SEQ ID NOs: 543 to 553.

In some embodiments, the immunogenic peptide composition comprises two or more peptides selected from the group consisting of SEQ ID NOs: 543 to 553. In some embodiments, the immunogenic peptide composition comprises a peptide derived from a IDH1 R132H protein mutation.

In another aspect, the invention provides for an immunogenic composition comprising nucleic acid sequences encoding one or more amino acid sequences selected from the group consisting of SEQ ID NOs: 535 to 542.

In some embodiments, the immunogenic composition comprises nucleic acid sequences encoding one or more amino acid sequences derived from a IDH1 R132C protein mutation. In some embodiments, the immunogenic composition comprises nucleic acid sequences encoding two or more amino acid sequences selected from the group consisting of SEQ ID NOs: 535 to 542.

In another aspect, the invention provides for an immunogenic peptide composition comprising one or more peptides selected from the group consisting of SEQ ID NOs: 535 to 542.

In some embodiments, the immunogenic peptide composition comprises two or more peptides selected from the group consisting of SEQ ID NOs: 535 to 542. In some embodiments, the immunogenic peptide composition comprises a peptide derived from a IDH1 R132C protein mutation.

In another aspect, the invention provides for an immunogenic composition comprising nucleic acid sequences encoding one or more amino acid sequences selected from the group consisting of SEQ ID NOs: 569 to 577.

In some embodiments, the immunogenic composition comprises nucleic acid sequences encoding one or more amino acid sequences derived from a KRAS G12D protein mutation. In some embodiments, the immunogenic composition comprises nucleic acid sequences encoding two or more amino acid sequences selected from the group consisting of SEQ ID NOs: 569 to 577.

In another aspect, the invention provides for an immunogenic peptide composition comprising one or more peptides selected from the group consisting of SEQ ID NOs: 569 to 577.

In some embodiments, the immunogenic peptide composition comprises two or more peptides selected from the group consisting of SEQ ID NOs: 569 to 577. In some embodiments, the immunogenic peptide composition comprises a peptide derived from a KRAS G12D protein mutation.

In another aspect, the invention provides for an immunogenic composition comprising nucleic acid sequences encoding one or more amino acid sequences selected from the group consisting of SEQ ID NOs: 596 to 605.

In some embodiments, the immunogenic composition comprises nucleic acid sequences encoding one or more amino acid sequences derived from a KRAS G12V protein mutation. In some embodiments, the immunogenic composition comprises nucleic acid sequences encoding two or more amino acid sequences selected from the group consisting of SEQ ID NOs: 596 to 605.

In another aspect, the invention provides for an immunogenic peptide composition comprising one or more peptides selected from the group consisting of SEQ ID NOs: 596 to 605.

In some embodiments, the immunogenic peptide composition comprises two or more peptides selected from the group consisting of SEQ ID NOs: 596 to 605. In some embodiments, the immunogenic peptide composition comprises a peptide derived from a KRAS G12V protein mutation.

In another aspect, the invention provides for an immunogenic composition comprising nucleic acid sequences encoding one or more amino acid sequences selected from the group consisting of SEQ ID NOs: 578 to 587.

In some embodiments, the immunogenic composition comprises nucleic acid sequences encoding one or more amino acid sequences derived from a KRAS G12R protein mutation. In some embodiments, the immunogenic composition comprises nucleic acid sequences encoding two or more amino acid sequences selected from the group consisting of SEQ ID NOs: 578 to 587.

In another aspect, the invention provides for an immunogenic peptide composition comprising one or more peptides selected from the group consisting of SEQ ID NOs: 578 to 587.

In some embodiments, the immunogenic peptide composition comprises two or more peptides selected from the group consisting of SEQ ID NOs: 578 to 587. In some embodiments, the immunogenic peptide composition comprises a peptide derived from a KRAS G12R protein mutation.

In another aspect, the invention provides for an immunogenic composition comprising nucleic acid sequences encoding one or more amino acid sequences selected from the group consisting of SEQ ID NOs: 561 to 568.

In some embodiments, the immunogenic composition comprises nucleic acid sequences encoding one or more amino acid sequences derived from a KRAS G12C protein mutation. In some embodiments, the immunogenic composition comprises nucleic acid sequences encoding two or more amino acid sequences selected from the group consisting of SEQ ID NOs: 561 to 568.

In another aspect, the invention provides for an immunogenic peptide composition comprising one or more peptides selected from the group consisting of SEQ ID NOs: 561 to 568.

In some embodiments, the immunogenic peptide composition comprises two or more peptides selected from the group consisting of SEQ ID NOs: 561 to 568. In some embodiments, the immunogenic peptide composition comprises a peptide derived from a KRAS G12C protein mutation.

In another aspect, the invention provides for an immunogenic composition comprising nucleic acid sequences encoding one or more amino acid sequences selected from the group consisting of SEQ ID NOs: 606 to 615.

In some embodiments, the immunogenic composition comprises nucleic acid sequences encoding one or more amino acid sequences derived from a KRAS G13D protein mutation. In some embodiments, the immunogenic composition comprises nucleic acid sequences encoding two or more amino acid sequences selected from the group consisting of SEQ ID NOs: 606 to 615.

In another aspect, the invention provides for an immunogenic peptide composition comprising one or more peptides selected from the group consisting of SEQ ID NOs: 606 to 615.

In some embodiments, the immunogenic peptide composition comprises two or more peptides selected from the group consisting of SEQ ID NOs: 606 to 615. In some embodiments, the immunogenic peptide composition comprises a peptide derived from a KRAS G13D protein mutation.

In another aspect, the invention provides for an immunogenic composition comprising nucleic acid sequences encoding one or more amino acid sequences selected from the group consisting of SEQ ID NOs: 554 to 560.

In some embodiments, the immunogenic composition comprises nucleic acid sequences encoding one or more amino acid sequences derived from a KRAS G12A protein mutation. In some embodiments, the immunogenic composition comprises nucleic acid sequences encoding two or more amino acid sequences selected from the group consisting of SEQ ID NOs: 554 to 560.

In another aspect, the invention provides for an immunogenic peptide composition comprising one or more peptides selected from the group consisting of SEQ ID NOs: 554 to 560.

In some embodiments, the immunogenic peptide composition comprises two or more peptides selected from the group consisting of SEQ ID NOs: 554 to 560. In some embodiments, the immunogenic peptide composition comprises a peptide derived from a KRAS G12A protein mutation.

In another aspect, the invention provides for an immunogenic composition comprising nucleic acid sequences encoding one or more amino acid sequences selected from the group consisting of SEQ ID NOs: 588 to 595.

In some embodiments, the immunogenic composition comprises nucleic acid sequences encoding one or more amino acid sequences derived from a KRAS G12S protein mutation. In some embodiments, the immunogenic composition comprises nucleic acid sequences encoding two or more amino acid sequences selected from the group consisting of SEQ ID NOs: 588 to 595.

In another aspect, the invention provides for an immunogenic peptide composition comprising one or more peptides selected from the group consisting of SEQ ID NOs: 588 to 595.

In some embodiments, the immunogenic peptide composition comprises two or more peptides selected from the group consisting of SEQ ID NOs: 588 to 595. In some embodiments, the immunogenic peptide composition comprises a peptide derived from a KRAS G12S protein mutation.

In another aspect, the invention provides for an immunogenic composition comprising nucleic acid sequences encoding one or more amino acid sequences selected from the group consisting of SEQ ID NOs: 634 to 645.

In some embodiments, the immunogenic composition comprises nucleic acid sequences encoding one or more amino acid sequences derived from a NRAS Q61R protein mutation. In some embodiments, the immunogenic composition comprises nucleic acid sequences encoding two or more amino acid sequences selected from the group consisting of SEQ ID NOs: 634 to 645.

In another aspect, the invention provides for an immunogenic peptide composition comprising one or more peptides selected from the group consisting of SEQ ID NOs: 634 to 645.

In some embodiments, the immunogenic peptide composition comprises two or more peptides selected from the group consisting of SEQ ID NOs: 634 to 645. In some embodiments, the immunogenic peptide composition comprises a peptide derived from a NRAS Q61R protein mutation.

In another aspect, the invention provides for an immunogenic composition comprising nucleic acid sequences encoding one or more amino acid sequences selected from the group consisting of SEQ ID NOs: 616 to 624.

In some embodiments, the immunogenic composition comprises nucleic acid sequences encoding one or more amino acid sequences derived from a NRAS Q61K protein mutation. In some embodiments, the immunogenic composition comprises nucleic acid sequences encoding two or more amino acid sequences selected from the group consisting of SEQ ID NOs: 616 to 624.

In another aspect, the invention provides for an immunogenic peptide composition comprising one or more peptides selected from the group consisting of SEQ ID NOs: 616 to 624.

In some embodiments, the immunogenic peptide composition comprises two or more peptides selected from the group consisting of SEQ ID NOs: 616 to 624. In some embodiments, the immunogenic peptide composition comprises a peptide derived from a NRAS Q61K protein mutation.

In another aspect, the invention provides for an immunogenic composition comprising nucleic acid sequences encoding one or more amino acid sequences selected from the group consisting of SEQ ID NOs: 625 to 633.

In some embodiments, the immunogenic composition comprises nucleic acid sequences encoding one or more amino acid sequences derived from a NRAS Q61L protein mutation. In some embodiments, the immunogenic composition comprises nucleic acid sequences encoding two or more amino acid sequences selected from the group consisting of SEQ ID NOs: 625 to 633.

In another aspect, the invention provides for an immunogenic peptide composition comprising one or more peptides selected from the group consisting of SEQ ID NOs: 625 to 633.

In some embodiments, the immunogenic peptide composition comprises two or more peptides selected from the group consisting of SEQ ID NOs: 625 to 633. In some embodiments, the immunogenic peptide composition comprises a peptide derived from a NRAS Q61L protein mutation.

In another aspect, the invention provides for an immunogenic composition comprising nucleic acid sequences encoding one or more amino acid sequences selected from the group consisting of SEQ ID NOs: 646 to 650.

In some embodiments, the immunogenic composition comprises nucleic acid sequences encoding one or more amino acid sequences derived from a PIK3CA E542K protein mutation. In some embodiments, the immunogenic composition comprises nucleic acid sequences encoding two or more amino acid sequences selected from the group consisting of SEQ ID NOs: 646 to 650.

In another aspect, the invention provides for an immunogenic peptide composition comprising one or more peptides selected from the group consisting of SEQ ID NOs: 646 to 650.

In some embodiments, the immunogenic peptide composition comprises two or more peptides selected from the group consisting of SEQ ID NOs: 646 to 650. In some embodiments, the immunogenic peptide composition comprises a peptide derived from a PIK3CA E542K protein mutation.

In another aspect, the invention provides for an immunogenic composition comprising nucleic acid sequences encoding one or more amino acid sequences selected from the group consisting of SEQ ID NOs: 651 to 657.

In some embodiments, the immunogenic composition comprises nucleic acid sequences encoding one or more amino acid sequences derived from a PIK3CA E545K protein mutation. In some embodiments, the immunogenic composition comprises nucleic acid sequences encoding two or more amino acid sequences selected from the group consisting of SEQ ID NOs: 651 to 657.

In another aspect, the invention provides for an immunogenic peptide composition comprising one or more peptides selected from the group consisting of SEQ ID NOs: 651 to 657.

In some embodiments, the immunogenic peptide composition comprises two or more peptides selected from the group consisting of SEQ ID NOs: 651 to 657. In some embodiments, the immunogenic peptide composition comprises a peptide derived from a PIK3CA E545K protein mutation.

In another aspect, the invention provides for an immunogenic composition comprising nucleic acid sequences encoding one or more amino acid sequences selected from the group consisting of SEQ ID NOs: 658 to 667.

In some embodiments, the immunogenic composition comprises nucleic acid sequences encoding one or more amino acid sequences derived from a PIK3CA H1047R protein mutation. In some embodiments, the immunogenic composition comprises nucleic acid sequences encoding two or more amino acid sequences selected from the group consisting of SEQ ID NOs: 658 to 667.

In another aspect, the invention provides for an immunogenic peptide composition comprising one or more peptides selected from the group consisting of SEQ ID NOs: 658 to 667.

In some embodiments, the immunogenic peptide composition comprises two or more peptides selected from the group consisting of SEQ ID NOs: 658 to 667. In some embodiments, the immunogenic peptide composition comprises a peptide derived from a PIK3CA H1047R protein mutation.

In another aspect, the invention provides for an immunogenic composition comprising nucleic acid sequences encoding one or more amino acid sequences selected from the group consisting of SEQ ID NOs: 700 to 707.

In some embodiments, the immunogenic composition comprises nucleic acid sequences encoding one or more amino acid sequences derived from a TP53 R158L protein mutation. In some embodiments, the immunogenic composition comprises nucleic acid sequences encoding two or more amino acid sequences selected from the group consisting of SEQ ID NOs: 700 to 707.

In another aspect, the invention provides for an immunogenic peptide composition comprising one or more peptides selected from the group consisting of SEQ ID NOs: 700 to 707.

In some embodiments, the immunogenic peptide composition comprises two or more peptides selected from the group consisting of SEQ ID NOs: 700 to 707. In some embodiments, the immunogenic peptide composition comprises a peptide derived from a TP53 R158L protein mutation.

In another aspect, the invention provides for an immunogenic composition comprising nucleic acid sequences encoding one or more amino acid sequences selected from the group consisting of SEQ ID NOs: 708 to 717.

In some embodiments, the immunogenic composition comprises nucleic acid sequences encoding one or more amino acid sequences derived from a TP53 R175H protein mutation. In some embodiments, the immunogenic composition comprises nucleic acid sequences encoding two or more amino acid sequences selected from the group consisting of SEQ ID NOs: 708 to 717.

In another aspect, the invention provides for an immunogenic peptide composition comprising one or more peptides selected from the group consisting of SEQ ID NOs: 708 to 717.

In some embodiments, the immunogenic peptide composition comprises two or more peptides selected from the group consisting of SEQ ID NOs: 708 to 717. In some embodiments, the immunogenic peptide composition comprises a peptide derived from a TP53 R175H protein mutation.

In another aspect, the invention provides for an immunogenic composition comprising nucleic acid sequences encoding one or more amino acid sequences selected from the group consisting of SEQ ID NOs: 718 to 723.

In some embodiments, the immunogenic composition comprises nucleic acid sequences encoding one or more amino acid sequences derived from a TP53 R248Q protein mutation. In some embodiments, the immunogenic composition comprises nucleic acid sequences encoding two or more amino acid sequences selected from the group consisting of SEQ ID NOs: 718 to 723.

In another aspect, the invention provides for an immunogenic peptide composition comprising one or more peptides selected from the group consisting of SEQ ID NOs: 718 to 723.

In some embodiments, the immunogenic peptide composition comprises two or more peptides selected from the group consisting of SEQ ID NOs: 718 to 723. In some embodiments, the immunogenic peptide composition comprises a peptide derived from a TP53 R248Q protein mutation.

In another aspect, the invention provides for an immunogenic composition comprising nucleic acid sequences encoding one or more amino acid sequences selected from the group consisting of SEQ ID NOs: 733 to 739.

In some embodiments, the immunogenic composition comprises nucleic acid sequences encoding one or more amino acid sequences derived from a TP53 R273C protein mutation. In some embodiments, the immunogenic composition comprises nucleic acid sequences encoding two or more amino acid sequences selected from the group consisting of SEQ ID NOs: 733 to 739.

In another aspect, the invention provides for an immunogenic peptide composition comprising one or more peptides selected from the group consisting of SEQ ID NOs: 733 to 739.

In some embodiments, the immunogenic peptide composition comprises two or more peptides selected from the group consisting of SEQ ID NOs: 733 to 739. In some embodiments, the immunogenic peptide composition comprises a peptide derived from a TP53 R273C protein mutation.

In another aspect, the invention provides for an immunogenic composition comprising nucleic acid sequences encoding one or more amino acid sequences selected from the group consisting of SEQ ID NOs: 740 to 748.

In some embodiments, the immunogenic composition comprises nucleic acid sequences encoding one or more amino acid sequences derived from a TP53 R273H protein mutation. In some embodiments, the immunogenic composition comprises nucleic acid sequences encoding two or more amino acid sequences selected from the group consisting of SEQ ID NOs: 740 to 748.

In another aspect, the invention provides for an immunogenic peptide composition comprising one or more peptides selected from the group consisting of SEQ ID NOs: 740 to 748.

In some embodiments, the immunogenic peptide composition comprises two or more peptides selected from the group consisting of SEQ ID NOs: 740 to 748. In some embodiments, the immunogenic peptide composition comprises a peptide derived from a TP53 R273H protein mutation.

In another aspect, the invention provides for an immunogenic composition comprising nucleic acid sequences encoding one or more amino acid sequences selected from the group consisting of SEQ ID NOs: 724 to 732.

In some embodiments, the immunogenic composition comprises nucleic acid sequences encoding one or more amino acid sequences derived from a TP53 R248W protein mutation. In some embodiments, the immunogenic composition comprises nucleic acid sequences encoding two or more amino acid sequences selected from the group consisting of SEQ ID NOs: 724 to 732.

In another aspect, the invention provides for an immunogenic peptide composition comprising one or more peptides selected from the group consisting of SEQ ID NOs: 724 to 732.

In some embodiments, the immunogenic peptide composition comprises two or more peptides selected from the group consisting of SEQ ID NOs: 724 to 732. In some embodiments, the immunogenic peptide composition comprises a peptide derived from a TP53 R248W protein mutation.

In another aspect, the invention provides for an immunogenic composition comprising nucleic acid sequences encoding one or more amino acid sequences selected from the group consisting of SEQ ID NOs: 749 to 750.

In some embodiments, the immunogenic composition comprises nucleic acid sequences encoding one or more amino acid sequences derived from a TP53 R282W protein mutation. In some embodiments, the immunogenic composition comprises nucleic acid sequences encoding two or more amino acid sequences selected from the group consisting of SEQ ID NOs: 749 to 750.

In another aspect, the invention provides for an immunogenic peptide composition comprising one or more peptides selected from the group consisting of SEQ ID NOs: 749 to 750.

In some embodiments, the immunogenic peptide composition comprises two or more peptides selected from the group consisting of SEQ ID NOs: 749 to 750. In some embodiments, the immunogenic peptide composition comprises a peptide derived from a TP53 R282W protein mutation.

In another aspect, the invention provides for an immunogenic composition comprising nucleic acid sequences encoding one or more amino acid sequences selected from the group consisting of SEQ ID NOs: 751 to 758.

In some embodiments, the immunogenic composition comprises nucleic acid sequences encoding one or more amino acid sequences derived from a TP53 Y220C protein mutation. In some embodiments, the immunogenic composition comprises nucleic acid sequences encoding two or more amino acid sequences selected from the group consisting of SEQ ID NOs: 751 to 758.

In another aspect, the invention provides for an immunogenic peptide composition comprising one or more peptides selected from the group consisting of SEQ ID NOs: 751 to 758.

In some embodiments, the immunogenic peptide composition comprises two or more peptides selected from the group consisting of SEQ ID NOs: 751 to 758. In some embodiments, the immunogenic peptide composition comprises a peptide derived from a TP53 Y220C protein mutation.

In another aspect, the invention provides for an immunogenic composition comprising nucleic acid sequences encoding one or more amino acid sequences selected from the group consisting of SEQ ID NOs: 668 to 675.

In some embodiments, the immunogenic composition comprises nucleic acid sequences encoding one or more amino acid sequences derived from a PIK3CA R88Q protein mutation. In some embodiments, the immunogenic composition comprises nucleic acid sequences encoding two or more amino acid sequences selected from the group consisting of SEQ ID NOs: 668 to 675.

In another aspect, the invention provides for an immunogenic peptide composition comprising one or more peptides selected from the group consisting of SEQ ID NOs: 668 to 675.

In some embodiments, the immunogenic peptide composition comprises two or more peptides selected from the group consisting of SEQ ID NOs: 668 to 675. In some embodiments, the immunogenic peptide composition comprises a peptide derived from a PIK3CA R88Q protein mutation.

In another aspect, the invention provides for an immunogenic composition comprising nucleic acid sequences encoding one or more amino acid sequences selected from the group consisting of SEQ ID NOs: 528 to 534.

In some embodiments, the immunogenic composition comprises nucleic acid sequences encoding one or more amino acid sequences derived from a GTF2I L424H protein mutation. In some embodiments, the immunogenic composition comprises nucleic acid sequences encoding two or more amino acid sequences selected from the group consisting of SEQ ID NOs: 528 to 534.

In another aspect, the invention provides for an immunogenic peptide composition comprising one or more peptides selected from the group consisting of SEQ ID NOs: 528 to 534.

In some embodiments, the immunogenic peptide composition comprises two or more peptides selected from the group consisting of SEQ ID NOs: 528 to 534. In some embodiments, the immunogenic peptide composition comprises a peptide derived from a GTF2I L424H protein mutation.

In another aspect, the invention provides for an immunogenic composition comprising nucleic acid sequences encoding one or more amino acid sequences selected from the group consisting of SEQ ID NOs: 681 to 690.

In some embodiments, the immunogenic composition comprises nucleic acid sequences encoding one or more amino acid sequences derived from a PTEN R130Q protein mutation. In some embodiments, the immunogenic composition comprises nucleic acid sequences encoding two or more amino acid sequences selected from the group consisting of SEQ ID NOs: 681 to 690.

In another aspect, the invention provides for an immunogenic peptide composition comprising one or more peptides selected from the group consisting of SEQ ID NOs: 681 to 690.

In some embodiments, the immunogenic peptide composition comprises two or more peptides selected from the group consisting of SEQ ID NOs: 681 to 690. In some embodiments, the immunogenic peptide composition comprises a peptide derived from a PTEN R130Q protein mutation.

In another aspect, the invention provides for an immunogenic composition comprising nucleic acid sequences encoding one or more amino acid sequences selected from the group consisting of SEQ ID NOs: 475 to 483.

In some embodiments, the immunogenic composition comprises nucleic acid sequences encoding one or more amino acid sequences derived from a AKT1 E17K protein mutation. In some embodiments, the immunogenic composition comprises nucleic acid sequences encoding two or more amino acid sequences selected from the group consisting of SEQ ID NOs: 475 to 483.

In another aspect, the invention provides for an immunogenic peptide composition comprising one or more peptides selected from the group consisting of SEQ ID NOs: 475 to 483.

In some embodiments, the immunogenic peptide composition comprises two or more peptides selected from the group consisting of SEQ ID NOs: 475 to 483. In some embodiments, the immunogenic peptide composition comprises a peptide derived from a AKT1 E17K protein mutation.

In another aspect, the invention provides for an immunogenic composition comprising nucleic acid sequences encoding one or more amino acid sequences selected from the group consisting of SEQ ID NOs: 676 to 680.

In some embodiments, the immunogenic composition comprises nucleic acid sequences encoding one or more amino acid sequences derived from a PTEN R130G protein mutation. In some embodiments, the immunogenic composition comprises nucleic acid sequences encoding two or more amino acid sequences selected from the group consisting of SEQ ID NOs: 676 to 680.

In another aspect, the invention provides for an immunogenic peptide composition comprising one or more peptides selected from the group consisting of SEQ ID NOs: 676 to 680.

In some embodiments, the immunogenic peptide composition comprises two or more peptides selected from the group consisting of SEQ ID NOs: 676 to 680. In some embodiments, the immunogenic peptide composition comprises a peptide derived from a PTEN R130G protein mutation.

In another aspect, the invention provides for an immunogenic composition comprising nucleic acid sequences encoding one or more amino acid sequences selected from the group consisting of SEQ ID NOs: 691 to 699.

In some embodiments, the immunogenic composition comprises nucleic acid sequences encoding one or more amino acid sequences derived from a TP53 H179R protein mutation. In some embodiments, the immunogenic composition comprises nucleic acid sequences encoding two or more amino acid sequences selected from the group consisting of SEQ ID NOs: 691 to 699.

In another aspect, the invention provides for an immunogenic peptide composition comprising one or more peptides selected from the group consisting of SEQ ID NOs: 691 to 699.

In some embodiments, the immunogenic peptide composition comprises two or more peptides selected from the group consisting of SEQ ID NOs: 691 to 699. In some embodiments, the immunogenic peptide composition comprises a peptide derived from a TP53 H179R protein mutation.

In another aspect, the invention provides for an immunogenic composition comprising nucleic acid sequences encoding one or more amino acid sequences selected from the group consisting of SEQ ID NOs: 569 to 574, SEQ ID NOs: 578 to 584, SEQ ID NOs: 596 to 599, and SEQ ID NOs: 601 to 603.

In some embodiments, the immunogenic composition comprises nucleic acid sequences encoding two or more amino acid sequences selected from the group consisting of SEQ ID NOs: 569 to 574, SEQ ID NOs: 578 to 584, SEQ ID NOs: 596 to 599, and SEQ ID NOs: 601 to 603. In some embodiments, the nucleic acid sequences are administered in a construct for expression in vivo. In some embodiments, the in vivo administration of the nucleic acid sequences is configured to produce one or more peptides that is displayed by an HLA class II molecule. In some embodiments, the one or more peptides is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, the one or more peptides is a modified or unmodified fragment of a protein with a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the nucleic acid sequences are administered in an effective amount to a subject to prevent cancer. In some embodiments, the nucleic acid sequences are administered in an effective amount to a subject to treat cancer. In some embodiments, the cancer is pancreatic cancer.

In another aspect, the invention provides for a method of treating or preventing pancreatic cancer by administering to a subject an immunogenic composition comprising nucleic acid sequences encoding one or more amino acid sequences selected from the group consisting of SEQ ID NOs: 569 to 574, SEQ ID NOs: 578 to 584, SEQ ID NOs: 596 to 599, and SEQ ID NOs: 601 to 603.

In some embodiments, the immunogenic composition comprises nucleic acid sequences encoding two or more amino acid sequences selected from the group consisting of SEQ ID NOs: 569 to 574, SEQ ID NOs: 578 to 584, SEQ ID NOs: 596 to 599, and SEQ ID NOs: 601 to 603.

In another aspect, the invention provides for an immunogenic peptide composition comprising one or more peptides selected from the group consisting of SEQ ID NOs: 569 to 574, SEQ ID NOs: 578 to 584, SEQ ID NOs: 596 to 599, and SEQ ID NOs: 601 to 603.

In some embodiments, the immunogenic peptide composition comprises two or more peptides selected from the group consisting of SEQ ID NOs: 569 to 574, SEQ ID NOs: 578 to 584, SEQ ID NOs: 596 to 599, and SEQ ID NOs: 601 to 603. In some embodiments, a peptide in the immunogenic peptide composition is displayed by an HLA class II molecule. In some embodiments, a peptide in the immunogenic peptide composition is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, a peptide in the immunogenic peptide composition is a modified or unmodified fragment of a protein, wherein the protein comprises a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the immunogenic peptide composition is administered in an effective amount to a subject to prevent cancer. In some embodiments, the immunogenic peptide composition is administered in an effective amount to a subject to treat cancer. In some embodiments, the cancer is pancreatic cancer.

In another aspect, the invention provides for a method of treating or preventing pancreatic cancer in a subject comprising administering to the subject an immunogenic peptide composition comprising one or more peptides selected from the group consisting of SEQ ID NOs: 569 to 574, SEQ ID NOs: 578 to 584, SEQ ID NOs: 596 to 599, and SEQ ID NOs: 601 to 603.

In some embodiments, the immunogenic peptide composition comprises two or more peptides selected from the group consisting of SEQ ID NOs: 569 to 574, SEQ ID NOs: 578 to 584, SEQ ID NOs: 596 to 599, and SEQ ID NOs: 601 to 603.

In another aspect, the invention provides for an immunogenic composition comprising nucleic acid sequences encoding one or more amino acid sequences selected from the group consisting of SEQ ID NOs: 484 to 485, SEQ ID NOs: 488 to 489, SEQ ID NOs: 495 to 499, SEQ ID NO: 616, SEQ ID NOs: 619 to 620, SEQ ID NOs: 625 to 628, SEQ ID NO: 634, SEQ ID NO: 637, and SEQ ID NOs: 639 to 640.

In some embodiments, the immunogenic composition comprises nucleic acid sequences encoding two or more amino acid sequences selected from the group consisting of SEQ ID NOs: 484 to 485, SEQ ID NOs: 488 to 489, SEQ ID NOs: 495 to 499, SEQ ID NO: 616, SEQ ID NOs: 619 to 620, SEQ ID NOs: 625 to 628, SEQ ID NO: 634, SEQ ID NO: 637, and SEQ ID NOs: 639 to 640. In some embodiments, the nucleic acid sequences are administered in a construct for expression in vivo. In some embodiments, the in vivo administration of the nucleic acid sequences is configured to produce one or more peptides that is displayed by an HLA class II molecule. In some embodiments, the one or more peptides is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, the one or more peptides is a modified or unmodified fragment of a protein with a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the nucleic acid sequences are administered in an effective amount to a subject to prevent cancer. In some embodiments, the nucleic acid sequences are administered in an effective amount to a subject to treat cancer. In some embodiments, the cancer is skin cancer.

In another aspect, the invention provides for a method of treating or preventing skin cancer by administering to a subject an immunogenic composition comprising nucleic acid sequences encoding one or more amino acid sequences selected from the group consisting of SEQ ID NOs: 484 to 485, SEQ ID NOs: 488 to 489, SEQ ID NOs: 495 to 499, SEQ ID NO: 616, SEQ ID NOs: 619 to 620, SEQ ID NOs: 625 to 628, SEQ ID NO: 634, SEQ ID NO: 637, and SEQ ID NOs: 639 to 640.

In some embodiments, the immunogenic composition comprises nucleic acid sequences encoding two or more amino acid sequences selected from the group consisting of SEQ ID NOs: 484 to 485, SEQ ID NOs: 488 to 489, SEQ ID NOs: 495 to 499, SEQ ID NO: 616, SEQ ID NOs: 619 to 620, SEQ ID NOs: 625 to 628, SEQ ID NO: 634, SEQ ID NO: 637, and SEQ ID NOs: 639 to 640.

In another aspect, the invention provides for an immunogenic peptide composition comprising one or more peptides selected from the group consisting of SEQ ID NOs: 484 to 485, SEQ ID NOs: 488 to 489, SEQ ID NOs: 495 to 499, SEQ ID NO: 616, SEQ ID NOs: 619 to 620, SEQ ID NOs: 625 to 628, SEQ ID NO: 634, SEQ ID NO: 637, and SEQ ID NOs: 639 to 640.

In some embodiments, the immunogenic peptide composition comprises two or more peptides selected from the group consisting of SEQ ID NOs: 484 to 485, SEQ ID NOs: 488 to 489, SEQ ID NOs: 495 to 499, SEQ ID NO: 616, SEQ ID NOs: 619 to 620, SEQ ID NOs: 625 to 628, SEQ ID NO: 634, SEQ ID NO: 637, and SEQ ID NOs: 639 to 640. In some embodiments, a peptide in the immunogenic peptide composition is displayed by an HLA class II molecule. In some embodiments, a peptide in the immunogenic peptide composition is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, a peptide in the immunogenic peptide composition is a modified or unmodified fragment of a protein, wherein the protein comprises a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the immunogenic peptide composition is administered in an effective amount to a subject to prevent cancer. In some embodiments, the immunogenic peptide composition is administered in an effective amount to a subject to treat cancer. In some embodiments, the cancer is skin cancer.

In another aspect, the invention provides for a method of treating or preventing skin cancer in a subject comprising administering to the subject an immunogenic peptide composition comprising one or more peptides selected from the group consisting of SEQ ID NOs: 484 to 485, SEQ ID NOs: 488 to 489, SEQ ID NOs: 495 to 499, SEQ ID NO: 616, SEQ ID NOs: 619 to 620, SEQ ID NOs: 625 to 628, SEQ ID NO: 634, SEQ ID NO: 637, and SEQ ID NOs: 639 to 640.

In some embodiments, the immunogenic peptide composition comprises two or more peptides selected from the group consisting of SEQ ID NOs: 484 to 485, SEQ ID NOs: 488 to 489, SEQ ID NOs: 495 to 499, SEQ ID NO: 616, SEQ ID NOs: 619 to 620, SEQ ID NOs: 625 to 628, SEQ ID NO: 634, SEQ ID NO: 637, and SEQ ID NOs: 639 to 640.

In another aspect, the invention provides for an immunogenic composition comprising nucleic acid sequences encoding one or more amino acid sequences selected from the group consisting of SEQ ID NOs: 484 to 485, SEQ ID NOs: 488 to 489, SEQ ID NO: 616, SEQ ID NOs: 619 to 620, SEQ ID NO: 634, SEQ ID NO: 637, and SEQ ID NO: 640.

In some embodiments, the immunogenic composition comprises nucleic acid sequences encoding two or more amino acid sequences selected from the group consisting of SEQ ID NOs: 484 to 485, SEQ ID NOs: 488 to 489, SEQ ID NO: 616, SEQ ID NOs: 619 to 620, SEQ ID NO: 634, SEQ ID NO: 637, and SEQ ID NO: 640. In some embodiments, the nucleic acid sequences are administered in a construct for expression in vivo. In some embodiments, the in vivo administration of the nucleic acid sequences is configured to produce one or more peptides that is displayed by an HLA class II molecule. In some embodiments, the one or more peptides is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, the one or more peptides is a modified or unmodified fragment of a protein with a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the nucleic acid sequences are administered in an effective amount to a subject to prevent cancer. In some embodiments, the nucleic acid sequences are administered in an effective amount to a subject to treat cancer. In some embodiments, the cancer is thyroid cancer.

In another aspect, the invention provides for a method of treating or preventing thyroid cancer by administering to a subject an immunogenic composition comprising nucleic acid sequences encoding one or more amino acid sequences selected from the group consisting of SEQ ID NOs: 484 to 485, SEQ ID NOs: 488 to 489, SEQ ID NO: 616, SEQ ID NOs: 619 to 620, SEQ ID NO: 634, SEQ ID NO: 637, and SEQ ID NO: 640.

In some embodiments, the immunogenic composition comprises nucleic acid sequences encoding two or more amino acid sequences selected from the group consisting of SEQ ID NOs: 484 to 485, SEQ ID NOs: 488 to 489, SEQ ID NO: 616, SEQ ID NOs: 619 to 620, SEQ ID NO: 634, SEQ ID NO: 637, and SEQ ID NO: 640.

In another aspect, the invention provides for an immunogenic peptide composition comprising one or more peptides selected from the group consisting of SEQ ID NOs: 484 to 485, SEQ ID NOs: 488 to 489, SEQ ID NO: 616, SEQ ID NOs: 619 to 620, SEQ ID NO: 634, SEQ ID NO: 637, and SEQ ID NO: 640.

In some embodiments, the immunogenic peptide composition comprises two or more peptides selected from the group consisting of SEQ ID NOs: 484 to 485, SEQ ID NOs: 488 to 489, SEQ ID NO: 616, SEQ ID NOs: 619 to 620, SEQ ID NO: 634, SEQ ID NO: 637, and SEQ ID NO: 640. In some embodiments, a peptide in the immunogenic peptide composition is displayed by an HLA class II molecule. In some embodiments, a peptide in the immunogenic peptide composition is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, a peptide in the immunogenic peptide composition is a modified or unmodified fragment of a protein, wherein the protein comprises a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the immunogenic peptide composition is administered in an effective amount to a subject to prevent cancer. In some embodiments, the immunogenic peptide composition is administered in an effective amount to a subject to treat cancer. In some embodiments, the cancer is thyroid cancer.

In another aspect, the invention provides for a method of treating or preventing thyroid cancer in a subject comprising administering to the subject an immunogenic peptide composition comprising one or more peptides selected from the group consisting of SEQ ID NOs: 484 to 485, SEQ ID NOs: 488 to 489, SEQ ID NO: 616, SEQ ID NOs: 619 to 620, SEQ ID NO: 634, SEQ ID NO: 637, and SEQ ID NO: 640.

In some embodiments, the immunogenic peptide composition comprises two or more peptides selected from the group consisting of SEQ ID NOs: 484 to 485, SEQ ID NOs: 488 to 489, SEQ ID NO: 616, SEQ ID NOs: 619 to 620, SEQ ID NO: 634, SEQ ID NO: 637, and SEQ ID NO: 640.

In another aspect, the invention provides for an immunogenic composition comprising nucleic acid sequences encoding one or more amino acid sequences selected from the group consisting of SEQ ID NO: 508, SEQ ID NO: 510, SEQ ID NO: 512, SEQ ID NO: 514, SEQ ID NOs: 535 to 537, SEQ ID NO: 539, SEQ ID NOs: 543 to 551, SEQ ID NO: 708, SEQ ID NO: 712, and SEQ ID NO: 738.

In some embodiments, the immunogenic composition comprises nucleic acid sequences encoding two or more amino acid sequences selected from the group consisting of SEQ ID NO: 508, SEQ ID NO: 510, SEQ ID NO: 512, SEQ ID NO: 514, SEQ ID NOs: 535 to 537, SEQ ID NO: 539, SEQ ID NOs: 543 to 551, SEQ ID NO: 708, SEQ ID NO: 712, and SEQ ID NO: 738. In some embodiments, the nucleic acid sequences are administered in a construct for expression in vivo. In some embodiments, the in vivo administration of the nucleic acid sequences is configured to produce one or more peptides that is displayed by an HLA class II molecule. In some embodiments, the one or more peptides is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, the one or more peptides is a modified or unmodified fragment of a protein with a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the nucleic acid sequences are administered in an effective amount to a subject to prevent cancer. In some embodiments, the nucleic acid sequences are administered in an effective amount to a subject to treat cancer. In some embodiments, the cancer is brain cancer.

In another aspect, the invention provides for a method of treating or preventing brain cancer by administering to a subject an immunogenic composition comprising nucleic acid sequences encoding one or more amino acid sequences selected from the group consisting of SEQ ID NO: 508, SEQ ID NO: 510, SEQ ID NO: 512, SEQ ID NO: 514, SEQ ID NOs: 535 to 537, SEQ ID NO: 539, SEQ ID NOs: 543 to 551, SEQ ID NO: 708, SEQ ID NO: 712, and SEQ ID NO: 738.

In some embodiments, the immunogenic composition comprises nucleic acid sequences encoding two or more amino acid sequences selected from the group consisting of SEQ ID NO: 508, SEQ ID NO: 510, SEQ ID NO: 512, SEQ ID NO: 514, SEQ ID NOs: 535 to 537, SEQ ID NO: 539, SEQ ID NOs: 543 to 551, SEQ ID NO: 708, SEQ ID NO: 712, and SEQ ID NO: 738.

In another aspect, the invention provides for an immunogenic peptide composition comprising one or more peptides selected from the group consisting of SEQ ID NO: 508, SEQ ID NO: 510, SEQ ID NO: 512, SEQ ID NO: 514, SEQ ID NOs: 535 to 537, SEQ ID NO: 539, SEQ ID NOs: 543 to 551, SEQ ID NO: 708, SEQ ID NO: 712, and SEQ ID NO: 738.

In some embodiments, the immunogenic peptide composition comprises two or more peptides selected from the group consisting of SEQ ID NO: 508, SEQ ID NO: 510, SEQ ID NO: 512, SEQ ID NO: 514, SEQ ID NOs: 535 to 537, SEQ ID NO: 539, SEQ ID NOs: 543 to 551, SEQ ID NO: 708, SEQ ID NO: 712, and SEQ ID NO: 738. In some embodiments, a peptide in the immunogenic peptide composition is displayed by an HLA class II molecule. In some embodiments, a peptide in the immunogenic peptide composition is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, a peptide in the immunogenic peptide composition is a modified or unmodified fragment of a protein, wherein the protein comprises a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the immunogenic peptide composition is administered in an effective amount to a subject to prevent cancer. In some embodiments, the immunogenic peptide composition is administered in an effective amount to a subject to treat cancer. In some embodiments, the cancer is brain cancer.

In another aspect, the invention provides for a method of treating or preventing brain cancer in a subject comprising administering to the subject an immunogenic peptide composition comprising one or more peptides selected from the group consisting of SEQ ID NO: 508, SEQ ID NO: 510, SEQ ID NO: 512, SEQ ID NO: 514, SEQ ID NOs: 535 to 537, SEQ ID NO: 539, SEQ ID NOs: 543 to 551, SEQ ID NO: 708, SEQ ID NO: 712, and SEQ ID NO: 738.

In some embodiments, the immunogenic peptide composition comprises two or more peptides selected from the group consisting of SEQ ID NO: 508, SEQ ID NO: 510, SEQ ID NO: 512, SEQ ID NO: 514, SEQ ID NOs: 535 to 537, SEQ ID NO: 539, SEQ ID NOs: 543 to 551, SEQ ID NO: 708, SEQ ID NO: 712, and SEQ ID NO: 738.

In another aspect, the invention provides for an immunogenic composition comprising nucleic acid sequences encoding one or more amino acid sequences selected from the group consisting of SEQ ID NOs: 484 to 485, SEQ ID NOs: 488 to 489, SEQ ID NOs: 569 to 575, SEQ ID NOs: 596 to 599, SEQ ID NOs: 601 to 604, SEQ ID NOs: 606 to 612, SEQ ID NO: 656, SEQ ID NO: 708, and SEQ ID NO: 712.

In some embodiments, the immunogenic composition comprises nucleic acid sequences encoding two or more amino acid sequences selected from the group consisting of SEQ ID NOs: 484 to 485, SEQ ID NOs: 488 to 489, SEQ ID NOs: 569 to 575, SEQ ID NOs: 596 to 599, SEQ ID NOs: 601 to 604, SEQ ID NOs: 606 to 612, SEQ ID NO: 656, SEQ ID NO: 708, and SEQ ID NO: 712. In some embodiments, the nucleic acid sequences are administered in a construct for expression in vivo. In some embodiments, the in vivo administration of the nucleic acid sequences is configured to produce one or more peptides that is displayed by an HLA class II molecule. In some embodiments, the one or more peptides is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, the one or more peptides is a modified or unmodified fragment of a protein with a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the nucleic acid sequences are administered in an effective amount to a subject to prevent cancer. In some embodiments, the nucleic acid sequences are administered in an effective amount to a subject to treat cancer. In some embodiments, the cancer is colorectal cancer.

In another aspect, the invention provides for a method of treating or preventing colorectal cancer by administering to a subject an immunogenic composition comprising nucleic acid sequences encoding one or more amino acid sequences selected from the group consisting of SEQ ID NOs: 484 to 485, SEQ ID NOs: 488 to 489, SEQ ID NOs: 569 to 575, SEQ ID NOs: 596 to 599, SEQ ID NOs: 601 to 604, SEQ ID NOs: 606 to 612, SEQ ID NO: 656, SEQ ID NO: 708, and SEQ ID NO: 712.

In some embodiments, the immunogenic composition comprises nucleic acid sequences encoding two or more amino acid sequences selected from the group consisting of SEQ ID NOs: 484 to 485, SEQ ID NOs: 488 to 489, SEQ ID NOs: 569 to 575, SEQ ID NOs: 596 to 599, SEQ ID NOs: 601 to 604, SEQ ID NOs: 606 to 612, SEQ ID NO: 656, SEQ ID NO: 708, and SEQ ID NO: 712.

In another aspect, the invention provides for an immunogenic peptide composition comprising one or more peptides selected from the group consisting of SEQ ID NOs: 484 to 485, SEQ ID NOs: 488 to 489, SEQ ID NOs: 569 to 575, SEQ ID NOs: 596 to 599, SEQ ID NOs: 601 to 604, SEQ ID NOs: 606 to 612, SEQ ID NO: 656, SEQ ID NO: 708, and SEQ ID NO: 712.

In some embodiments, the immunogenic peptide composition comprises two or more peptides selected from the group consisting of SEQ ID NOs: 484 to 485, SEQ ID NOs: 488 to 489, SEQ ID NOs: 569 to 575, SEQ ID NOs: 596 to 599, SEQ ID NOs: 601 to 604, SEQ ID NOs: 606 to 612, SEQ ID NO: 656, SEQ ID NO: 708, and SEQ ID NO: 712. In some embodiments, a peptide in the immunogenic peptide composition is displayed by an HLA class II molecule. In some embodiments, a peptide in the immunogenic peptide composition is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, a peptide in the immunogenic peptide composition is a modified or unmodified fragment of a protein, wherein the protein comprises a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the immunogenic peptide composition is administered in an effective amount to a subject to prevent cancer. In some embodiments, the immunogenic peptide composition is administered in an effective amount to a subject to treat cancer. In some embodiments, the cancer is colorectal cancer.

In another aspect, the invention provides for a method of treating or preventing colorectal cancer in a subject comprising administering to the subject an immunogenic peptide composition comprising one or more peptides selected from the group consisting of SEQ ID NOs: 484 to 485, SEQ ID NOs: 488 to 489, SEQ ID NOs: 569 to 575, SEQ ID NOs: 596 to 599, SEQ ID NOs: 601 to 604, SEQ ID NOs: 606 to 612, SEQ ID NO: 656, SEQ ID NO: 708, and SEQ ID NO: 712.

In some embodiments, the immunogenic peptide composition comprises two or more peptides selected from the group consisting of SEQ ID NOs: 484 to 485, SEQ ID NOs: 488 to 489, SEQ ID NOs: 569 to 575, SEQ ID NOs: 596 to 599, SEQ ID NOs: 601 to 604, SEQ ID NOs: 606 to 612, SEQ ID NO: 656, SEQ ID NO: 708, and SEQ ID NO: 712.

In another aspect, the invention provides for an immunogenic composition comprising nucleic acid sequences encoding one or more amino acid sequences selected from the group consisting of SEQ ID NOs: 520 to 521, SEQ ID NOs: 523 to 524, SEQ ID NOs: 554 to 556, SEQ ID NO: 558, SEQ ID NO: 561, SEQ ID NOs: 563 to 565, SEQ ID NOs: 569 to 573, SEQ ID NOs: 596 to 600, SEQ ID NO: 650, SEQ ID NO: 656, and SEQ ID NOs: 700 to 705.

In some embodiments, the immunogenic composition comprises nucleic acid sequences encoding two or more amino acid sequences selected from the group consisting of SEQ ID NOs: 520 to 521, SEQ ID NOs: 523 to 524, SEQ ID NOs: 554 to 556, SEQ ID NO: 558, SEQ ID NO: 561, SEQ ID NOs: 563 to 565, SEQ ID NOs: 569 to 573, SEQ ID NOs: 596 to 600, SEQ ID NO: 650, SEQ ID NO: 656, and SEQ ID NOs: 700 to 705. In some embodiments, the nucleic acid sequences are administered in a construct for expression in vivo. In some embodiments, the in vivo administration of the nucleic acid sequences is configured to produce one or more peptides that is displayed by an HLA class II molecule. In some embodiments, the one or more peptides is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, the one or more peptides is a modified or unmodified fragment of a protein with a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the nucleic acid sequences are administered in an effective amount to a subject to prevent cancer. In some embodiments, the nucleic acid sequences are administered in an effective amount to a subject to treat cancer. In some embodiments, the cancer is bronchus and lung cancer.

In another aspect, the invention provides for a method of treating or preventing bronchus and lung cancer by administering to a subject an immunogenic composition comprising nucleic acid sequences encoding one or more amino acid sequences selected from the group consisting of SEQ ID NOs: 520 to 521, SEQ ID NOs: 523 to 524, SEQ ID NOs: 554 to 556, SEQ ID NO: 558, SEQ ID NO: 561, SEQ ID NOs: 563 to 565, SEQ ID NOs: 569 to 573, SEQ ID NOs: 596 to 600, SEQ ID NO: 650, SEQ ID NO: 656, and SEQ ID NOs: 700 to 705.

In some embodiments, the immunogenic composition comprises nucleic acid sequences encoding two or more amino acid sequences selected from the group consisting of SEQ ID NOs: 520 to 521, SEQ ID NOs: 523 to 524, SEQ ID NOs: 554 to 556, SEQ ID NO: 558, SEQ ID NO: 561, SEQ ID NOs: 563 to 565, SEQ ID NOs: 569 to 573, SEQ ID NOs: 596 to 600, SEQ ID NO: 650, SEQ ID NO: 656, and SEQ ID NOs: 700 to 705.

In another aspect, the invention provides for an immunogenic peptide composition comprising one or more peptides selected from the group consisting of SEQ ID NOs: 520 to 521, SEQ ID NOs: 523 to 524, SEQ ID NOs: 554 to 556, SEQ ID NO: 558, SEQ ID NO: 561, SEQ ID NOs: 563 to 565, SEQ ID NOs: 569 to 573, SEQ ID NOs: 596 to 600, SEQ ID NO: 650, SEQ ID NO: 656, and SEQ ID NOs: 700 to 705.

In some embodiments, the immunogenic peptide composition comprises two or more peptides selected from the group consisting of SEQ ID NOs: 520 to 521, SEQ ID NOs: 523 to 524, SEQ ID NOs: 554 to 556, SEQ ID NO: 558, SEQ ID NO: 561, SEQ ID NOs: 563 to 565, SEQ ID NOs: 569 to 573, SEQ ID NOs: 596 to 600, SEQ ID NO: 650, SEQ ID NO: 656, and SEQ ID NOs: 700 to 705. In some embodiments, a peptide in the immunogenic peptide composition is displayed by an HLA class II molecule. In some embodiments, a peptide in the immunogenic peptide composition is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, a peptide in the immunogenic peptide composition is a modified or unmodified fragment of a protein, wherein the protein comprises a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the immunogenic peptide composition is administered in an effective amount to a subject to prevent cancer. In some embodiments, the immunogenic peptide composition is administered in an effective amount to a subject to treat cancer. In some embodiments, the cancer is bronchus and lung cancer.

In another aspect, the invention provides for a method of treating or preventing bronchus and lung cancer in a subject comprising administering to the subject an immunogenic peptide composition comprising one or more peptides selected from the group consisting of SEQ ID NOs: 520 to 521, SEQ ID NOs: 523 to 524, SEQ ID NOs: 554 to 556, SEQ ID NO: 558, SEQ ID NO: 561, SEQ ID NOs: 563 to 565, SEQ ID NOs: 569 to 573, SEQ ID NOs: 596 to 600, SEQ ID NO: 650, SEQ ID NO: 656, and SEQ ID NOs: 700 to 705.

In some embodiments, the immunogenic peptide composition comprises two or more peptides selected from the group consisting of SEQ ID NOs: 520 to 521, SEQ ID NOs: 523 to 524, SEQ ID NOs: 554 to 556, SEQ ID NO: 558, SEQ ID NO: 561, SEQ ID NOs: 563 to 565, SEQ ID NOs: 569 to 573, SEQ ID NOs: 596 to 600, SEQ ID NO: 650, SEQ ID NO: 656, and SEQ ID NOs: 700 to 705.

In another aspect, the invention provides for an immunogenic composition comprising nucleic acid sequences encoding one or more amino acid sequences selected from the group consisting of SEQ ID NOs: 646 to 667, SEQ ID NOs: 708 to 717, and SEQ ID NOs: 733 to 748.

In some embodiments, the immunogenic composition comprises nucleic acid sequences encoding two or more amino acid sequences selected from the group consisting of SEQ ID NOs: 646 to 667, SEQ ID NOs: 708 to 717, and SEQ ID NOs: 733 to 748. In some embodiments, the nucleic acid sequences are administered in a construct for expression in vivo. In some embodiments, the in vivo administration of the nucleic acid sequences is configured to produce one or more peptides that is displayed by an HLA class II molecule. In some embodiments, the one or more peptides is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, the one or more peptides is a modified or unmodified fragment of a protein with a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the nucleic acid sequences are administered in an effective amount to a subject to prevent cancer. In some embodiments, the nucleic acid sequences are administered in an effective amount to a subject to treat cancer. In some embodiments, the cancer is breast cancer.

In another aspect, the invention provides for a method of treating or preventing breast cancer by administering to a subject an immunogenic composition comprising nucleic acid sequences encoding one or more amino acid sequences selected from the group consisting of SEQ ID NOs: 646 to 667, SEQ ID NOs: 708 to 717, and SEQ ID NOs: 733 to 748.

In some embodiments, the immunogenic composition comprises nucleic acid sequences encoding two or more amino acid sequences selected from the group consisting of SEQ ID NOs: 646 to 667, SEQ ID NOs: 708 to 717, and SEQ ID NOs: 733 to 748.

In another aspect, the invention provides for an immunogenic peptide composition comprising one or more peptides selected from the group consisting of SEQ ID NOs: 646 to 667, SEQ ID NOs: 708 to 717, and SEQ ID NOs: 733 to 748.

In some embodiments, the immunogenic peptide composition comprises two or more peptides selected from the group consisting of SEQ ID NOs: 646 to 667, SEQ ID NOs: 708 to 717, and SEQ ID NOs: 733 to 748. In some embodiments, a peptide in the immunogenic peptide composition is displayed by an HLA class II molecule. In some embodiments, a peptide in the immunogenic peptide composition is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, a peptide in the immunogenic peptide composition is a modified or unmodified fragment of a protein, wherein the protein comprises a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the immunogenic peptide composition is administered in an effective amount to a subject to prevent cancer. In some embodiments, the immunogenic peptide composition is administered in an effective amount to a subject to treat cancer. In some embodiments, the cancer is breast cancer.

In another aspect, the invention provides for a method of treating or preventing breast cancer in a subject comprising administering to the subject an immunogenic peptide composition comprising one or more peptides selected from the group consisting of SEQ ID NOs: 646 to 667, SEQ ID NOs: 708 to 717, and SEQ ID NOs: 733 to 748.

In some embodiments, the immunogenic peptide composition comprises two or more peptides selected from the group consisting of SEQ ID NOs: 646 to 667, SEQ ID NOs: 708 to 717, and SEQ ID NOs: 733 to 748.

In another aspect, the invention provides for an immunogenic composition comprising nucleic acid sequences encoding one or more amino acid sequences selected from the group consisting of SEQ ID NOs: 646 to 667, SEQ ID NOs: 708 to 717, and SEQ ID NOs: 733 to 748.

In some embodiments, the immunogenic composition comprises nucleic acid sequences encoding two or more amino acid sequences selected from the group consisting of SEQ ID NOs: 646 to 667, SEQ ID NOs: 708 to 717, and SEQ ID NOs: 733 to 748. In some embodiments, the nucleic acid sequences are administered in a construct for expression in vivo. In some embodiments, the in vivo administration of the nucleic acid sequences is configured to produce one or more peptides that is displayed by an HLA class II molecule. In some embodiments, the one or more peptides is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, the one or more peptides is a modified or unmodified fragment of a protein with a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the nucleic acid sequences are administered in an effective amount to a subject to prevent cancer. In some embodiments, the nucleic acid sequences are administered in an effective amount to a subject to treat cancer. In some embodiments, the cancer is ovarian cancer.

In another aspect, the invention provides for a method of treating or preventing ovarian cancer by administering to a subject an immunogenic composition comprising nucleic acid sequences encoding one or more amino acid sequences selected from the group consisting of SEQ ID NOs: 646 to 667, SEQ ID NOs: 708 to 717, and SEQ ID NOs: 733 to 748.

In some embodiments, the immunogenic composition comprises nucleic acid sequences encoding two or more amino acid sequences selected from the group consisting of SEQ ID NOs: 646 to 667, SEQ ID NOs: 708 to 717, and SEQ ID NOs: 733 to 748.

In another aspect, the invention provides for an immunogenic peptide composition comprising one or more peptides selected from the group consisting of SEQ ID NOs: 646 to 667, SEQ ID NOs: 708 to 717, and SEQ ID NOs: 733 to 748.

In some embodiments, the immunogenic peptide composition comprises two or more peptides selected from the group consisting of SEQ ID NOs: 646 to 667, SEQ ID NOs: 708 to 717, and SEQ ID NOs: 733 to 748. In some embodiments, a peptide in the immunogenic peptide composition is displayed by an HLA class II molecule. In some embodiments, a peptide in the immunogenic peptide composition is a modified or unmodified fragment of a mutated protein selected from the group consisting of AKT1, BRAF, EGFR, GTF2I, HRAS, IDH1, KRAS, NRAS, PIK3CA, PTEN, and TP53. In some embodiments, a peptide in the immunogenic peptide composition is a modified or unmodified fragment of a protein, wherein the protein comprises a mutation selected from the group consisting of AKT1 E17K, BRAF V600E, BRAF V600M, EGFR A289V, EGFR G598V, EGFR L858R, GTF2I L424H, IDH1 R132C, IDH1 R132H, KRAS G12A, KRAS G12C, KRAS G12D, KRAS G12R, KRAS G12S, KRAS G12V, KRAS G13D, NRAS Q61K, NRAS Q61L, NRAS Q61R, PIK3CA E542K, PIK3CA E545K, PIK3CA H1047R, PIK3CA R88Q, PTEN R130G, PTEN R130Q, TP53 H179R, TP53 R158L, TP53 R175H, TP53 R248Q, TP53 R248W, TP53 R273C, TP53 R273H, TP53 R282W, and TP53 Y220C. In some embodiments, the immunogenic peptide composition is administered in an effective amount to a subject to prevent cancer. In some embodiments, the immunogenic peptide composition is administered in an effective amount to a subject to treat cancer. In some embodiments, the cancer is ovarian cancer.

In another aspect, the invention provides for a method of treating or preventing ovarian cancer in a subject comprising administering to the subject an immunogenic peptide composition comprising one or more peptides selected from the group consisting of SEQ ID NOs: 646 to 667, SEQ ID NOs: 708 to 717, and SEQ ID NOs: 733 to 748.

In some embodiments, the immunogenic peptide composition comprises two or more peptides selected from the group consisting of SEQ ID NOs: 646 to 667, SEQ ID NOs: 708 to 717, and SEQ ID NOs: 733 to 748.

Vaccines for CT Antigens

In one aspect, the invention provides for nucleic acid sequences encoding one or more amino acid sequences selected from the group consisting of SEQ ID NOs: 28796 to 28864, SEQ ID NOs: 37110 to 37174, SEQ ID NOs: 41321 to 41397, SEQ ID NO: 41770, SEQ ID NO: 49004, SEQ ID NO: 49071, SEQ ID NO: 49395, SEQ ID NO: 50632, SEQ ID NO: 50729, SEQ ID NOs: 51434 to 51510, SEQ ID NO: 55758, SEQ ID NOs: 60456 to 60527, SEQ ID NOs: 68238 to 68321, SEQ ID NO: 77091, SEQ ID NO: 77210, SEQ ID NO: 84188, SEQ ID NO: 87951, SEQ ID NO: 88144, SEQ ID NOs: 95593 to 95664, SEQ ID NOs: 113808 to 113869, SEQ ID NOs: 125134 to 125218, SEQ ID NOs: 144109 to 144188, SEQ ID NOs: 162383 to 162453, SEQ ID NOs: 166444 to 166531, SEQ ID NO: 167118, SEQ ID NO: 169740, SEQ ID NO: 173412, SEQ ID NO: 179404, and SEQ ID NOs: 182574 to 182654.

In some embodiments, the nucleic acid sequences encode two or more amino acid sequences selected from the group consisting of SEQ ID NOs: 28796 to 28864, SEQ ID NOs: 37110 to 37174, SEQ ID NOs: 41321 to 41397, SEQ ID NO: 41770, SEQ ID NO: 49004, SEQ ID NO: 49071, SEQ ID NO: 49395, SEQ ID NO: 50632, SEQ ID NO: 50729, SEQ ID NOs: 51434 to 51510, SEQ ID NO: 55758, SEQ ID NOs: 60456 to 60527, SEQ ID NOs: 68238 to 68321, SEQ ID NO: 77091, SEQ ID NO: 77210, SEQ ID NO: 84188, SEQ ID NO: 87951, SEQ ID NO: 88144, SEQ ID NOs: 95593 to 95664, SEQ ID NOs: 113808 to 113869, SEQ ID NOs: 125134 to 125218, SEQ ID NOs: 144109 to 144188, SEQ ID NOs: 162383 to 162453, SEQ ID NOs: 166444 to 166531, SEQ ID NO: 167118, SEQ ID NO: 169740, SEQ ID NO: 173412, SEQ ID NO: 179404, and SEQ ID NOs: 182574 to 182654.

In another aspect, the invention provides for an immunogenic composition comprising nucleic acid sequences encoding one or more amino acid sequences selected from the group consisting of SEQ ID NOs: 28796 to 28864, SEQ ID NOs: 37110 to 37174, SEQ ID NOs: 41321 to 41397, SEQ ID NO: 41770, SEQ ID NO: 49004, SEQ ID NO: 49071, SEQ ID NO: 49395, SEQ ID NO: 50632, SEQ ID NO: 50729, SEQ ID NOs: 51434 to 51510, SEQ ID NO: 55758, SEQ ID NOs: 60456 to 60527, SEQ ID NOs: 68238 to 68321, SEQ ID NO: 77091, SEQ ID NO: 77210, SEQ ID NO: 84188, SEQ ID NO: 87951, SEQ ID NO: 88144, SEQ ID NOs: 95593 to 95664, SEQ ID NOs: 113808 to 113869, SEQ ID NOs: 125134 to 125218, SEQ ID NOs: 144109 to 144188, SEQ ID NOs: 162383 to 162453, SEQ ID NOs: 166444 to 166531, SEQ ID NO: 167118, SEQ ID NO: 169740, SEQ ID NO: 173412, SEQ ID NO: 179404, and SEQ ID NOs: 182574 to 182654.

In some embodiments, the immunogenic composition is administered to a subject. In some embodiments, the immunogenic composition comprises nucleic acid sequences encoding two or more amino acid sequences selected from the group consisting of SEQ ID NOs: 28796 to 28864, SEQ ID NOs: 37110 to 37174, SEQ ID NOs: 41321 to 41397, SEQ ID NO: 41770, SEQ ID NO: 49004, SEQ ID NO: 49071, SEQ ID NO: 49395, SEQ ID NO: 50632, SEQ ID NO: 50729, SEQ ID NOs: 51434 to 51510, SEQ ID NO: 55758, SEQ ID NOs: 60456 to 60527, SEQ ID NOs: 68238 to 68321, SEQ ID NO: 77091, SEQ ID NO: 77210, SEQ ID NO: 84188, SEQ ID NO: 87951, SEQ ID NO: 88144, SEQ ID NOs: 95593 to 95664, SEQ ID NOs: 113808 to 113869, SEQ ID NOs: 125134 to 125218, SEQ ID NOs: 144109 to 144188, SEQ ID NOs: 162383 to 162453, SEQ ID NOs: 166444 to 166531, SEQ ID NO: 167118, SEQ ID NO: 169740, SEQ ID NO: 173412, SEQ ID NO: 179404, and SEQ ID NOs: 182574 to 182654. In some embodiments, the nucleic acid sequences are administered in a construct for expression in vivo. In some embodiments, the in vivo administration of the nucleic acid sequences is configured to produce one or more peptides that is displayed by an HLA class I molecule. In some embodiments, the one or more peptides is a modified or unmodified fragment of a protein selected from the group consisting of CTG1B, KKLC1, MAGA1, MAGA3, MAGA4, MAGC1, MAGC3, MAR1, PMEL, PRAME, SSX2, TYRP1, and TYRP2. In some embodiments, the immunogenic composition is administered in an effective amount to a subject to prevent cancer. In some embodiments, the immunogenic composition is administered in an effective amount to a subject to treat cancer. In some embodiments, the cancer is selected from the group consisting of pancreatic cancer, skin cancer, thyroid cancer, brain cancer, colorectal cancer, bronchus and lung cancer, breast cancer, and ovarian cancer. In some embodiments, the immunogenic composition comprises nucleic acid sequences encoding at least three amino acid sequences selected from the group consisting of SEQ ID NOs: 28796 to 28864, SEQ ID NOs: 37110 to 37174, SEQ ID NOs: 41321 to 41397, SEQ ID NO: 41770, SEQ ID NO: 49004, SEQ ID NO: 49071, SEQ ID NO: 49395, SEQ ID NO: 50632, SEQ ID NO: 50729, SEQ ID NOs: 51434 to 51510, SEQ ID NO: 55758, SEQ ID NOs: 60456 to 60527, SEQ ID NOs: 68238 to 68321, SEQ ID NO: 77091, SEQ ID NO: 77210, SEQ ID NO: 84188, SEQ ID NO: 87951, SEQ ID NO: 88144, SEQ ID NOs: 95593 to 95664, SEQ ID NOs: 113808 to 113869, SEQ ID NOs: 125134 to 125218, SEQ ID NOs: 144109 to 144188, SEQ ID NOs: 162383 to 162453, SEQ ID NOs: 166444 to 166531, SEQ ID NO: 167118, SEQ ID NO: 169740, SEQ ID NO: 173412, SEQ ID NO: 179404, and SEQ ID NOs: 182574 to 182654.

In another aspect, the invention provides for an immunogenic peptide composition comprising one or more peptides selected from the group consisting of SEQ ID NOs: 28796 to 28864, SEQ ID NOs: 37110 to 37174, SEQ ID NOs: 41321 to 41397, SEQ ID NO: 41770, SEQ ID NO: 49004, SEQ ID NO: 49071, SEQ ID NO: 49395, SEQ ID NO: 50632, SEQ ID NO: 50729, SEQ ID NOs: 51434 to 51510, SEQ ID NO: 55758, SEQ ID NOs: 60456 to 60527, SEQ ID NOs: 68238 to 68321, SEQ ID NO: 77091, SEQ ID NO: 77210, SEQ ID NO: 84188, SEQ ID NO: 87951, SEQ ID NO: 88144, SEQ ID NOs: 95593 to 95664, SEQ ID NOs: 113808 to 113869, SEQ ID NOs: 125134 to 125218, SEQ ID NOs: 144109 to 144188, SEQ ID NOs: 162383 to 162453, SEQ ID NOs: 166444 to 166531, SEQ ID NO: 167118, SEQ ID NO: 169740, SEQ ID NO: 173412, SEQ ID NO: 179404, and SEQ ID NOs: 182574 to 182654.

In some embodiments, the immunogenic peptide composition comprises two or more peptides selected from the group consisting of SEQ ID NOs: 28796 to 28864, SEQ ID NOs: 37110 to 37174, SEQ ID NOs: 41321 to 41397, SEQ ID NO: 41770, SEQ ID NO: 49004, SEQ ID NO: 49071, SEQ ID NO: 49395, SEQ ID NO: 50632, SEQ ID NO: 50729, SEQ ID NOs: 51434 to 51510, SEQ ID NO: 55758, SEQ ID NOs: 60456 to 60527, SEQ ID NOs: 68238 to 68321, SEQ ID NO: 77091, SEQ ID NO: 77210, SEQ ID NO: 84188, SEQ ID NO: 87951, SEQ ID NO: 88144, SEQ ID NOs: 95593 to 95664, SEQ ID NOs: 113808 to 113869, SEQ ID NOs: 125134 to 125218, SEQ ID NOs: 144109 to 144188, SEQ ID NOs: 162383 to 162453, SEQ ID NOs: 166444 to 166531, SEQ ID NO: 167118, SEQ ID NO: 169740, SEQ ID NO: 173412, SEQ ID NO: 179404, and SEQ ID NOs: 182574 to 182654.

In another aspect, the invention provides for an immunogenic composition comprising nucleic acid sequences encoding one or more amino acid sequences selected from the group consisting of SEQ ID NOs: 28796 to 28830.

In some embodiments, the immunogenic composition comprises nucleic acid sequences encoding one or more amino acid sequences derived from a CTG1B protein. In some embodiments, the immunogenic composition comprises nucleic acid sequences encoding two or more amino acid sequences selected from the group consisting of SEQ ID NOs: 28796 to 28830.

In another aspect, the invention provides for an immunogenic peptide composition comprising one or more peptides selected from the group consisting of SEQ ID NOs: 28796 to 28830.

In some embodiments, the immunogenic peptide composition comprises two or more peptides selected from the group consisting of SEQ ID NOs: 28796 to 28830. In some embodiments, the one or more peptides is a modified or unmodified fragment of a CTG1B protein.

In another aspect, the invention provides for an immunogenic composition comprising nucleic acid sequences encoding one or more amino acid sequences selected from the group consisting of SEQ ID NOs: 41321 to 41354.

In some embodiments, the immunogenic composition comprises nucleic acid sequences encoding one or more amino acid sequences derived from a MAGA1 protein. In some embodiments, the immunogenic composition comprises nucleic acid sequences encoding two or more amino acid sequences selected from the group consisting of SEQ ID NOs: 41321 to 41354.

In another aspect, the invention provides for an immunogenic peptide composition comprising one or more peptides selected from the group consisting of SEQ ID NOs: 41321 to 41354.

In some embodiments, the immunogenic peptide composition comprises two or more peptides selected from the group consisting of SEQ ID NOs: 41321 to 41354. In some embodiments, the one or more peptides is a modified or unmodified fragment of a MAGA1 protein.

In another aspect, the invention provides for an immunogenic composition comprising nucleic acid sequences encoding one or more amino acid sequences selected from the group consisting of SEQ ID NO: 41770, SEQ ID NO: 49004, and SEQ ID NOs: 51434 to 51468.

In some embodiments, the immunogenic composition comprises nucleic acid sequences encoding one or more amino acid sequences derived from a MAGA3 protein. In some embodiments, the immunogenic composition comprises nucleic acid sequences encoding two or more amino acid sequences selected from the group consisting of SEQ ID NO: 41770, SEQ ID NO: 49004, and SEQ ID NOs: 51434 to 51468.

In another aspect, the invention provides for an immunogenic peptide composition comprising one or more peptides selected from the group consisting of SEQ ID NO: 41770, SEQ ID NO: 49004, and SEQ ID NOs: 51434 to 51468.

In some embodiments, the immunogenic peptide composition comprises two or more peptides selected from the group consisting of SEQ ID NO: 41770, SEQ ID NO: 49004, and SEQ ID NOs: 51434 to 51468. In some embodiments, the one or more peptides is a modified or unmodified fragment of a MAGA3 protein.

In another aspect, the invention provides for an immunogenic composition comprising nucleic acid sequences encoding one or more amino acid sequences selected from the group consisting of SEQ ID NO: 41352, SEQ ID NO: 41770, and SEQ ID NOs: 60456 to 60487.

In some embodiments, the immunogenic composition comprises nucleic acid sequences encoding one or more amino acid sequences derived from a MAGA4 protein. In some embodiments, the immunogenic composition comprises nucleic acid sequences encoding two or more amino acid sequences selected from the group consisting of SEQ ID NO: 41352, SEQ ID NO: 41770, and SEQ ID NOs: 60456 to 60487.

In another aspect, the invention provides for an immunogenic peptide composition comprising one or more peptides selected from the group consisting of SEQ ID NO: 41352, SEQ ID NO: 41770, and SEQ ID NOs: 60456 to 60487.

In some embodiments, the immunogenic peptide composition comprises two or more peptides selected from the group consisting of SEQ ID NO: 41352, SEQ ID NO: 41770, and SEQ ID NOs: 60456 to 60487. In some embodiments, the one or more peptides is a modified or unmodified fragment of a MAGA4 protein.

In another aspect, the invention provides for an immunogenic composition comprising nucleic acid sequences encoding one or more amino acid sequences selected from the group consisting of SEQ ID NO: 49395 and SEQ ID NOs: 68238 to 68272.

In some embodiments, the immunogenic composition comprises nucleic acid sequences encoding one or more amino acid sequences derived from a MAGC1 protein. In some embodiments, the immunogenic composition comprises nucleic acid sequences encoding two or more amino acid sequences selected from the group consisting of SEQ ID NO: 49395 and SEQ ID NOs: 68238 to 68272.

In another aspect, the invention provides for an immunogenic peptide composition comprising one or more peptides selected from the group consisting of SEQ ID NO: 49395 and SEQ ID NOs: 68238 to 68272.

In some embodiments, the immunogenic peptide composition comprises two or more peptides selected from the group consisting of SEQ ID NO: 49395 and SEQ ID NOs: 68238 to 68272. In some embodiments, the one or more peptides is a modified or unmodified fragment of a MAGC1 protein.

In another aspect, the invention provides for an immunogenic composition comprising nucleic acid sequences encoding one or more amino acid sequences selected from the group consisting of SEQ ID NO: 77091, SEQ ID NO: 77210, SEQ ID NO: 84188, SEQ ID NO: 88144, and SEQ ID NOs: 95593 to 95624.

In some embodiments, the immunogenic composition comprises nucleic acid sequences encoding one or more amino acid sequences derived from a MAGC3 protein. In some embodiments, the immunogenic composition comprises nucleic acid sequences encoding two or more amino acid sequences selected from the group consisting of SEQ ID NO: 77091, SEQ ID NO: 77210, SEQ ID NO: 84188, SEQ ID NO: 88144, and SEQ ID NOs: 95593 to 95624.

In another aspect, the invention provides for an immunogenic peptide composition comprising one or more peptides selected from the group consisting of SEQ ID NO: 77091, SEQ ID NO: 77210, SEQ ID NO: 84188, SEQ ID NO: 88144, and SEQ ID NOs: 95593 to 95624.

In some embodiments, the immunogenic peptide composition comprises two or more peptides selected from the group consisting of SEQ ID NO: 77091, SEQ ID NO: 77210, SEQ ID NO: 84188, SEQ ID NO: 88144, and SEQ ID NOs: 95593 to 95624. In some embodiments, the one or more peptides is a modified or unmodified fragment of a MAGC3 protein.

In another aspect, the invention provides for an immunogenic composition comprising nucleic acid sequences encoding one or more amino acid sequences selected from the group consisting of SEQ ID NOs: 162383 to 162420.

In some embodiments, the immunogenic composition comprises nucleic acid sequences encoding one or more amino acid sequences derived from a SSX2 protein. In some embodiments, the immunogenic composition comprises nucleic acid sequences encoding two or more amino acid sequences selected from the group consisting of SEQ ID NOs: 162383 to 162420.

In another aspect, the invention provides for an immunogenic peptide composition comprising one or more peptides selected from the group consisting of SEQ ID NOs: 162383 to 162420.

In some embodiments, the immunogenic peptide composition comprises two or more peptides selected from the group consisting of SEQ ID NOs: 162383 to 162420. In some embodiments, the one or more peptides is a modified or unmodified fragment of a SSX2 protein.

In another aspect, the invention provides for an immunogenic composition comprising nucleic acid sequences encoding one or more amino acid sequences selected from the group consisting of SEQ ID NOs: 144109 to 144142.

In some embodiments, the immunogenic composition comprises nucleic acid sequences encoding one or more amino acid sequences derived from a PRAME protein. In some embodiments, the immunogenic composition comprises nucleic acid sequences encoding two or more amino acid sequences selected from the group consisting of SEQ ID NOs: 144109 to 144142.

In another aspect, the invention provides for an immunogenic peptide composition comprising one or more peptides selected from the group consisting of SEQ ID NOs: 144109 to 144142.

In some embodiments, the immunogenic peptide composition comprises two or more peptides selected from the group consisting of SEQ ID NOs: 144109 to 144142. In some embodiments, the one or more peptides is a modified or unmodified fragment of a PRAME protein.

In another aspect, the invention provides for an immunogenic composition comprising nucleic acid sequences encoding one or more amino acid sequences selected from the group consisting of SEQ ID NOs: 37110 to 37145.

In some embodiments, the immunogenic composition comprises nucleic acid sequences encoding one or more amino acid sequences derived from a KKLC1 protein. In some embodiments, the immunogenic composition comprises nucleic acid sequences encoding two or more amino acid sequences selected from the group consisting of SEQ ID NOs: 37110 to 37145.

In another aspect, the invention provides for an immunogenic peptide composition comprising one or more peptides selected from the group consisting of SEQ ID NOs: 37110 to 37145.

In some embodiments, the immunogenic peptide composition comprises two or more peptides selected from the group consisting of SEQ ID NOs: 37110 to 37145. In some embodiments, the one or more peptides is a modified or unmodified fragment of a KKLC1 protein.

In another aspect, the invention provides for an immunogenic composition comprising nucleic acid sequences encoding one or more amino acid sequences selected from the group consisting of SEQ ID NOs: 125134 to 125167.

In some embodiments, the immunogenic composition comprises nucleic acid sequences encoding one or more amino acid sequences derived from a PMEL protein. In some embodiments, the immunogenic composition comprises nucleic acid sequences encoding two or more amino acid sequences selected from the group consisting of SEQ ID NOs: 125134 to 125167.

In another aspect, the invention provides for an immunogenic peptide composition comprising one or more peptides selected from the group consisting of SEQ ID NOs: 125134 to 125167.

In some embodiments, the immunogenic peptide composition comprises two or more peptides selected from the group consisting of SEQ ID NOs: 125134 to 125167. In some embodiments, the one or more peptides is a modified or unmodified fragment of a PMEL protein.

In another aspect, the invention provides for an immunogenic composition comprising nucleic acid sequences encoding one or more amino acid sequences selected from the group consisting of SEQ ID NOs: 166444 to 166480.

In some embodiments, the immunogenic composition comprises nucleic acid sequences encoding one or more amino acid sequences derived from a TYRP1 protein. In some embodiments, the immunogenic composition comprises nucleic acid sequences encoding two or more amino acid sequences selected from the group consisting of SEQ ID NOs: 166444 to 166480.

In another aspect, the invention provides for an immunogenic peptide composition comprising one or more peptides selected from the group consisting of SEQ ID NOs: 166444 to 166480.

In some embodiments, the immunogenic peptide composition comprises two or more peptides selected from the group consisting of SEQ ID NOs: 166444 to 166480. In some embodiments, the one or more peptides is a modified or unmodified fragment of a TYRP1 protein.

In another aspect, the invention provides for an immunogenic composition comprising nucleic acid sequences encoding one or more amino acid sequences selected from the group consisting of SEQ ID NO: 169740, SEQ ID NO: 173412, SEQ ID NO: 179404, and SEQ ID NOs: 182574 to 182606.

In some embodiments, the immunogenic composition comprises nucleic acid sequences encoding one or more amino acid sequences derived from a TYRP2 protein. In some embodiments, the immunogenic composition comprises nucleic acid sequences encoding two or more amino acid sequences selected from the group consisting of SEQ ID NO: 169740, SEQ ID NO: 173412, SEQ ID NO: 179404, and SEQ ID NOs: 182574 to 182606.

In another aspect, the invention provides for an immunogenic peptide composition comprising one or more peptides selected from the group consisting of SEQ ID NO: 169740, SEQ ID NO: 173412, SEQ ID NO: 179404, and SEQ ID NOs: 182574 to 182606.

In some embodiments, the immunogenic peptide composition comprises two or more peptides selected from the group consisting of SEQ ID NO: 169740, SEQ ID NO: 173412, SEQ ID NO: 179404, and SEQ ID NOs: 182574 to 182606. In some embodiments, the one or more peptides is a modified or unmodified fragment of a TYRP2 protein.

In another aspect, the invention provides for an immunogenic composition comprising nucleic acid sequences encoding one or more amino acid sequences selected from the group consisting of SEQ ID NOs: 113808 to 113843.

In some embodiments, the immunogenic composition comprises nucleic acid sequences encoding one or more amino acid sequences derived from a MAR1 protein. In some embodiments, the immunogenic composition comprises nucleic acid sequences encoding two or more amino acid sequences selected from the group consisting of SEQ ID NOs: 113808 to 113843.

In another aspect, the invention provides for an immunogenic peptide composition comprising one or more peptides selected from the group consisting of SEQ ID NOs: 113808 to 113843.

In some embodiments, the immunogenic peptide composition comprises two or more peptides selected from the group consisting of SEQ ID NOs: 113808 to 113843. In some embodiments, the one or more peptides is a modified or unmodified fragment of a MAR1 protein.

In one aspect, the invention provides for nucleic acid sequences encoding one or more amino acid sequences selected from the group consisting of SEQ ID NOs: 28796 to 28864, SEQ ID NOs: 37110 to 37174, SEQ ID NOs: 41321 to 41397, SEQ ID NO: 41770, SEQ ID NO: 49004, SEQ ID NO: 49071, SEQ ID NO: 49395, SEQ ID NO: 50632, SEQ ID NO: 50729, SEQ ID NOs: 51434 to 51510, SEQ ID NO: 55758, SEQ ID NOs: 60456 to 60527, SEQ ID NOs: 68238 to 68321, SEQ ID NO: 77091, SEQ ID NO: 77210, SEQ ID NO: 84188, SEQ ID NO: 87951, SEQ ID NO: 88144, SEQ ID NOs: 95593 to 95664, SEQ ID NOs: 113808 to 113869, SEQ ID NOs: 125134 to 125218, SEQ ID NOs: 144109 to 144188, SEQ ID NOs: 162383 to 162453, SEQ ID NOs: 166444 to 166531, SEQ ID NO: 167118, SEQ ID NO: 169740, SEQ ID NO: 173412, SEQ ID NO: 179404, and SEQ ID NOs: 182574 to 182654.

In some embodiments, the nucleic acid sequences encode two or more amino acid sequences selected from the group consisting of SEQ ID NOs: 28796 to 28864, SEQ ID NOs: 37110 to 37174, SEQ ID NOs: 41321 to 41397, SEQ ID NO: 41770, SEQ ID NO: 49004, SEQ ID NO: 49071, SEQ ID NO: 49395, SEQ ID NO: 50632, SEQ ID NO: 50729, SEQ ID NOs: 51434 to 51510, SEQ ID NO: 55758, SEQ ID NOs: 60456 to 60527, SEQ ID NOs: 68238 to 68321, SEQ ID NO: 77091, SEQ ID NO: 77210, SEQ ID NO: 84188, SEQ ID NO: 87951, SEQ ID NO: 88144, SEQ ID NOs: 95593 to 95664, SEQ ID NOs: 113808 to 113869, SEQ ID NOs: 125134 to 125218, SEQ ID NOs: 144109 to 144188, SEQ ID NOs: 162383 to 162453, SEQ ID NOs: 166444 to 166531, SEQ ID NO: 167118, SEQ ID NO: 169740, SEQ ID NO: 173412, SEQ ID NO: 179404, and SEQ ID NOs: 182574 to 182654.

In another aspect, the invention provides for an immunogenic composition comprising nucleic acid sequences encoding one or more amino acid sequences selected from the group consisting of SEQ ID NOs: 28796 to 28864, SEQ ID NOs: 37110 to 37174, SEQ ID NOs: 41321 to 41397, SEQ ID NO: 41770, SEQ ID NO: 49004, SEQ ID NO: 49071, SEQ ID NO: 49395, SEQ ID NO: 50632, SEQ ID NO: 50729, SEQ ID NOs: 51434 to 51510, SEQ ID NO: 55758, SEQ ID NOs: 60456 to 60527, SEQ ID NOs: 68238 to 68321, SEQ ID NO: 77091, SEQ ID NO: 77210, SEQ ID NO: 84188, SEQ ID NO: 87951, SEQ ID NO: 88144, SEQ ID NOs: 95593 to 95664, SEQ ID NOs: 113808 to 113869, SEQ ID NOs: 125134 to 125218, SEQ ID NOs: 144109 to 144188, SEQ ID NOs: 162383 to 162453, SEQ ID NOs: 166444 to 166531, SEQ ID NO: 167118, SEQ ID NO: 169740, SEQ ID NO: 173412, SEQ ID NO: 179404, and SEQ ID NOs: 182574 to 182654.

In some embodiments, the immunogenic composition is administered to a subject. In some embodiments, the immunogenic composition comprises nucleic acid sequences encoding two or more amino acid sequences selected from the group consisting of SEQ ID NOs: 28796 to 28864, SEQ ID NOs: 37110 to 37174, SEQ ID NOs: 41321 to 41397, SEQ ID NO: 41770, SEQ ID NO: 49004, SEQ ID NO: 49071, SEQ ID NO: 49395, SEQ ID NO: 50632, SEQ ID NO: 50729, SEQ ID NOs: 51434 to 51510, SEQ ID NO: 55758, SEQ ID NOs: 60456 to 60527, SEQ ID NOs: 68238 to 68321, SEQ ID NO: 77091, SEQ ID NO: 77210, SEQ ID NO: 84188, SEQ ID NO: 87951, SEQ ID NO: 88144, SEQ ID NOs: 95593 to 95664, SEQ ID NOs: 113808 to 113869, SEQ ID NOs: 125134 to 125218, SEQ ID NOs: 144109 to 144188, SEQ ID NOs: 162383 to 162453, SEQ ID NOs: 166444 to 166531, SEQ ID NO: 167118, SEQ ID NO: 169740, SEQ ID NO: 173412, SEQ ID NO: 179404, and SEQ ID NOs: 182574 to 182654. In some embodiments, the nucleic acid sequences are administered in a construct for expression in vivo. In some embodiments, the in vivo administration of the nucleic acid sequences is configured to produce one or more peptides that is displayed by an HLA class II molecule. In some embodiments, the one or more peptides is a modified or unmodified fragment of a protein selected from the group consisting of CTG1B, KKLC1, MAGA1, MAGA3, MAGA4, MAGC1, MAGC3, MAR1, PMEL, PRAME, SSX2, TYRP1, and TYRP2. In some embodiments, the immunogenic composition is administered in an effective amount to a subject to prevent cancer. In some embodiments, the immunogenic composition is administered in an effective amount to a subject to treat cancer. In some embodiments, the cancer is selected from the group consisting of pancreatic cancer, skin cancer, thyroid cancer, brain cancer, colorectal cancer, bronchus and lung cancer, breast cancer, and ovarian cancer. In some embodiments, the immunogenic composition comprises nucleic acid sequences encoding at least three amino acid sequences selected from the group consisting of SEQ ID NOs: 28796 to 28864, SEQ ID NOs: 37110 to 37174, SEQ ID NOs: 41321 to 41397, SEQ ID NO: 41770, SEQ ID NO: 49004, SEQ ID NO: 49071, SEQ ID NO: 49395, SEQ ID NO: 50632, SEQ ID NO: 50729, SEQ ID NOs: 51434 to 51510, SEQ ID NO: 55758, SEQ ID NOs: 60456 to 60527, SEQ ID NOs: 68238 to 68321, SEQ ID NO: 77091, SEQ ID NO: 77210, SEQ ID NO: 84188, SEQ ID NO: 87951, SEQ ID NO: 88144, SEQ ID NOs: 95593 to 95664, SEQ ID NOs: 113808 to 113869, SEQ ID NOs: 125134 to 125218, SEQ ID NOs: 144109 to 144188, SEQ ID NOs: 162383 to 162453, SEQ ID NOs: 166444 to 166531, SEQ ID NO: 167118, SEQ ID NO: 169740, SEQ ID NO: 173412, SEQ ID NO: 179404, and SEQ ID NOs: 182574 to 182654.

In another aspect, the invention provides for an immunogenic peptide composition comprising one or more peptides selected from the group consisting of SEQ ID NOs: 28796 to 28864, SEQ ID NOs: 37110 to 37174, SEQ ID NOs: 41321 to 41397, SEQ ID NO: 41770, SEQ ID NO: 49004, SEQ ID NO: 49071, SEQ ID NO: 49395, SEQ ID NO: 50632, SEQ ID NO: 50729, SEQ ID NOs: 51434 to 51510, SEQ ID NO: 55758, SEQ ID NOs: 60456 to 60527, SEQ ID NOs: 68238 to 68321, SEQ ID NO: 77091, SEQ ID NO: 77210, SEQ ID NO: 84188, SEQ ID NO: 87951, SEQ ID NO: 88144, SEQ ID NOs: 95593 to 95664, SEQ ID NOs: 113808 to 113869, SEQ ID NOs: 125134 to 125218, SEQ ID NOs: 144109 to 144188, SEQ ID NOs: 162383 to 162453, SEQ ID NOs: 166444 to 166531, SEQ ID NO: 167118, SEQ ID NO: 169740, SEQ ID NO: 173412, SEQ ID NO: 179404, and SEQ ID NOs: 182574 to 182654.

In some embodiments, the immunogenic peptide composition comprises two or more peptides selected from the group consisting of SEQ ID NOs: 28796 to 28864, SEQ ID NOs: 37110 to 37174, SEQ ID NOs: 41321 to 41397, SEQ ID NO: 41770, SEQ ID NO: 49004, SEQ ID NO: 49071, SEQ ID NO: 49395, SEQ ID NO: 50632, SEQ ID NO: 50729, SEQ ID NOs: 51434 to 51510, SEQ ID NO: 55758, SEQ ID NOs: 60456 to 60527, SEQ ID NOs: 68238 to 68321, SEQ ID NO: 77091, SEQ ID NO: 77210, SEQ ID NO: 84188, SEQ ID NO: 87951, SEQ ID NO: 88144, SEQ ID NOs: 95593 to 95664, SEQ ID NOs: 113808 to 113869, SEQ ID NOs: 125134 to 125218, SEQ ID NOs: 144109 to 144188, SEQ ID NOs: 162383 to 162453, SEQ ID NOs: 166444 to 166531, SEQ ID NO: 167118, SEQ ID NO: 169740, SEQ ID NO: 173412, SEQ ID NO: 179404, and SEQ ID NOs: 182574 to 182654.

In another aspect, the invention provides for an immunogenic composition comprising nucleic acid sequences encoding one or more amino acid sequences selected from the group consisting of SEQ ID NOs: 197897 to 197901.

In some embodiments, the immunogenic composition comprises nucleic acid sequences encoding one or more amino acid sequences derived from a CTG1B protein. In some embodiments, the immunogenic composition comprises nucleic acid sequences encoding two or more amino acid sequences selected from the group consisting of SEQ ID NOs: 197897 to 197901.

In another aspect, the invention provides for an immunogenic peptide composition comprising one or more peptides selected from the group consisting of SEQ ID NOs: 197897 to 197901.

In some embodiments, the immunogenic peptide composition comprises two or more peptides selected from the group consisting of SEQ ID NOs: 197897 to 197901. In some embodiments, the one or more peptides is a modified or unmodified fragment of a CTG1B protein.

In another aspect, the invention provides for an immunogenic composition comprising nucleic acid sequences encoding one or more amino acid sequences selected from the group consisting of SEQ ID NOs: 211901 to 211904.

In some embodiments, the immunogenic composition comprises nucleic acid sequences encoding one or more amino acid sequences derived from a MAGA1 protein. In some embodiments, the immunogenic composition comprises nucleic acid sequences encoding two or more amino acid sequences selected from the group consisting of SEQ ID NOs: 211901 to 211904.

In another aspect, the invention provides for an immunogenic peptide composition comprising one or more peptides selected from the group consisting of SEQ ID NOs: 211901 to 211904.

In some embodiments, the immunogenic peptide composition comprises two or more peptides selected from the group consisting of SEQ ID NOs: 211901 to 211904. In some embodiments, the one or more peptides is a modified or unmodified fragment of a MAGA1 protein.

In another aspect, the invention provides for an immunogenic composition comprising nucleic acid sequences encoding one or more amino acid sequences selected from the group consisting of SEQ ID NOs: 223623 to 223627.

In some embodiments, the immunogenic composition comprises nucleic acid sequences encoding one or more amino acid sequences derived from a MAGA3 protein. In some embodiments, the immunogenic composition comprises nucleic acid sequences encoding two or more amino acid sequences selected from the group consisting of SEQ ID NOs: 223623 to 223627.

In another aspect, the invention provides for an immunogenic peptide composition comprising one or more peptides selected from the group consisting of SEQ ID NOs: 223623 to 223627.

In some embodiments, the immunogenic peptide composition comprises two or more peptides selected from the group consisting of SEQ ID NOs: 223623 to 223627. In some embodiments, the one or more peptides is a modified or unmodified fragment of a MAGA3 protein.

In another aspect, the invention provides for an immunogenic composition comprising nucleic acid sequences encoding one or more amino acid sequences selected from the group consisting of SEQ ID NOs: 236016 to 236020.

In some embodiments, the immunogenic composition comprises nucleic acid sequences encoding one or more amino acid sequences derived from a MAGA4 protein. In some embodiments, the immunogenic composition comprises nucleic acid sequences encoding two or more amino acid sequences selected from the group consisting of SEQ ID NOs: 236016 to 236020.

In another aspect, the invention provides for an immunogenic peptide composition comprising one or more peptides selected from the group consisting of SEQ ID NOs: 236016 to 236020.

In some embodiments, the immunogenic peptide composition comprises two or more peptides selected from the group consisting of SEQ ID NOs: 236016 to 236020. In some embodiments, the one or more peptides is a modified or unmodified fragment of a MAGA4 protein.

In another aspect, the invention provides for an immunogenic composition comprising nucleic acid sequences encoding one or more amino acid sequences selected from the group consisting of SEQ ID NOs: 247059 to 247063.

In some embodiments, the immunogenic composition comprises nucleic acid sequences encoding one or more amino acid sequences derived from a MAGC1 protein. In some embodiments, the immunogenic composition comprises nucleic acid sequences encoding two or more amino acid sequences selected from the group consisting of SEQ ID NOs: 247059 to 247063.

In another aspect, the invention provides for an immunogenic peptide composition comprising one or more peptides selected from the group consisting of SEQ ID NOs: 247059 to 247063.

In some embodiments, the immunogenic peptide composition comprises two or more peptides selected from the group consisting of SEQ ID NOs: 247059 to 247063. In some embodiments, the one or more peptides is a modified or unmodified fragment of a MAGC1 protein.

In another aspect, the invention provides for an immunogenic composition comprising nucleic acid sequences encoding one or more amino acid sequences selected from the group consisting of SEQ ID NOs: 281350 to 281353.

In some embodiments, the immunogenic composition comprises nucleic acid sequences encoding one or more amino acid sequences derived from a MAGC3 protein. In some embodiments, the immunogenic composition comprises nucleic acid sequences encoding two or more amino acid sequences selected from the group consisting of SEQ ID NOs: 281350 to 281353.

In another aspect, the invention provides for an immunogenic peptide composition comprising one or more peptides selected from the group consisting of SEQ ID NOs: 281350 to 281353.

In some embodiments, the immunogenic peptide composition comprises two or more peptides selected from the group consisting of SEQ ID NOs: 281350 to 281353. In some embodiments, the one or more peptides is a modified or unmodified fragment of a MAGC3 protein.

In another aspect, the invention provides for an immunogenic composition comprising nucleic acid sequences encoding one or more amino acid sequences selected from the group consisting of SEQ ID NOs: 369027 to 369031.

In some embodiments, the immunogenic composition comprises nucleic acid sequences encoding one or more amino acid sequences derived from a SSX2 protein. In some embodiments, the immunogenic composition comprises nucleic acid sequences encoding two or more amino acid sequences selected from the group consisting of SEQ ID NOs: 369027 to 369031.

In another aspect, the invention provides for an immunogenic peptide composition comprising one or more peptides selected from the group consisting of SEQ ID NOs: 369027 to 369031.

In some embodiments, the immunogenic peptide composition comprises two or more peptides selected from the group consisting of SEQ ID NOs: 369027 to 369031. In some embodiments, the one or more peptides is a modified or unmodified fragment of a SSX2 protein.

In another aspect, the invention provides for an immunogenic composition comprising nucleic acid sequences encoding one or more amino acid sequences selected from the group consisting of SEQ ID NOs: 342521 to 342525.

In some embodiments, the immunogenic composition comprises nucleic acid sequences encoding one or more amino acid sequences derived from a PRAME protein. In some embodiments, the immunogenic composition comprises nucleic acid sequences encoding two or more amino acid sequences selected from the group consisting of SEQ ID NOs: 342521 to 342525.

In another aspect, the invention provides for an immunogenic peptide composition comprising one or more peptides selected from the group consisting of SEQ ID NOs: 342521 to 342525.

In some embodiments, the immunogenic peptide composition comprises two or more peptides selected from the group consisting of SEQ ID NOs: 342521 to 342525. In some embodiments, the one or more peptides is a modified or unmodified fragment of a PRAME protein.

In another aspect, the invention provides for an immunogenic composition comprising nucleic acid sequences encoding one or more amino acid sequences selected from the group consisting of SEQ ID NOs: 206663 to 206665.

In some embodiments, the immunogenic composition comprises nucleic acid sequences encoding one or more amino acid sequences derived from a KKLC1 protein. In some embodiments, the immunogenic composition comprises nucleic acid sequences encoding two or more amino acid sequences selected from the group consisting of SEQ ID NOs: 206663 to 206665.

In another aspect, the invention provides for an immunogenic peptide composition comprising one or more peptides selected from the group consisting of SEQ ID NOs: 206663 to 206665.

In some embodiments, the immunogenic peptide composition comprises two or more peptides selected from the group consisting of SEQ ID NOs: 206663 to 206665. In some embodiments, the one or more peptides is a modified or unmodified fragment of a KKLC1 protein.

In another aspect, the invention provides for an immunogenic composition comprising nucleic acid sequences encoding one or more amino acid sequences selected from the group consisting of SEQ ID NOs: 317360 to 317363.

In some embodiments, the immunogenic composition comprises nucleic acid sequences encoding one or more amino acid sequences derived from a PMEL protein. In some embodiments, the immunogenic composition comprises nucleic acid sequences encoding two or more amino acid sequences selected from the group consisting of SEQ ID NOs: 317360 to 317363.

In another aspect, the invention provides for an immunogenic peptide composition comprising one or more peptides selected from the group consisting of SEQ ID NOs: 317360 to 317363.

In some embodiments, the immunogenic peptide composition comprises two or more peptides selected from the group consisting of SEQ ID NOs: 317360 to 317363. In some embodiments, the one or more peptides is a modified or unmodified fragment of a PMEL protein.

In another aspect, the invention provides for an immunogenic composition comprising nucleic acid sequences encoding one or more amino acid sequences selected from the group consisting of SEQ ID NOs: 373348 to 373350.

In some embodiments, the immunogenic composition comprises nucleic acid sequences encoding one or more amino acid sequences derived from a TYRP1 protein. In some embodiments, the immunogenic composition comprises nucleic acid sequences encoding two or more amino acid sequences selected from the group consisting of SEQ ID NOs: 373348 to 373350.

In another aspect, the invention provides for an immunogenic peptide composition comprising one or more peptides selected from the group consisting of SEQ ID NOs: 373348 to 373350.

In some embodiments, the immunogenic peptide composition comprises two or more peptides selected from the group consisting of SEQ ID NOs: 373348 to 373350. In some embodiments, the one or more peptides is a modified or unmodified fragment of a TYRP1 protein.

In another aspect, the invention provides for an immunogenic composition comprising nucleic acid sequences encoding one or more amino acid sequences selected from the group consisting of SEQ ID NOs: 392434 to 392437.

In some embodiments, the immunogenic composition comprises nucleic acid sequences encoding one or more amino acid sequences derived from a TYRP2 protein. In some embodiments, the immunogenic composition comprises nucleic acid sequences encoding two or more amino acid sequences selected from the group consisting of SEQ ID NOs: 392434 to 392437.

In another aspect, the invention provides for an immunogenic peptide composition comprising one or more peptides selected from the group consisting of SEQ ID NOs: 392434 to 392437.

In some embodiments, the immunogenic peptide composition comprises two or more peptides selected from the group consisting of SEQ ID NOs: 392434 to 392437. In some embodiments, the one or more peptides is a modified or unmodified fragment of a TYRP2 protein.

In another aspect, the invention provides for an immunogenic composition comprising nucleic acid sequences encoding one or more amino acid sequences selected from the group consisting of SEQ ID NOs: 305566 to 305570.

In some embodiments, the immunogenic composition comprises nucleic acid sequences encoding one or more amino acid sequences derived from a MAR1 protein. In some embodiments, the immunogenic composition comprises nucleic acid sequences encoding two or more amino acid sequences selected from the group consisting of SEQ ID NOs: 305566 to 305570.

In another aspect, the invention provides for an immunogenic peptide composition comprising one or more peptides selected from the group consisting of SEQ ID NOs: 305566 to 305570.

In some embodiments, the immunogenic peptide composition comprises two or more peptides selected from the group consisting of SEQ ID NOs: 305566 to 305570. In some embodiments, the one or more peptides is a modified or unmodified fragment of a MAR1 protein.

Vaccines for Autoimmune Diseases

In another aspect, the invention provides for an immunogenic composition comprising nucleic acid sequences encoding one or more amino acid sequences selected from the group consisting of SEQ ID NOs: 34169 to 34204.

In some embodiments, the immunogenic composition comprises nucleic acid sequences encoding one or more amino acid sequences derived from a INS protein. In some embodiments, the immunogenic composition comprises nucleic acid sequences encoding two or more amino acid sequences selected from the group consisting of SEQ ID NOs: 34169 to 34204.

In another aspect, the invention provides for an immunogenic peptide composition comprising one or more peptides selected from the group consisting of SEQ ID NOs: 34169 to 34204.

In some embodiments, the immunogenic peptide composition comprises two or more peptides selected from the group consisting of SEQ ID NOs: 34169 to 34204. In some embodiments, the one or more peptides is a modified or unmodified fragment of a INS protein.

In another aspect, the invention provides for an immunogenic composition comprising nucleic acid sequences encoding one or more amino acid sequences selected from the group consisting of SEQ ID NOs: 116478 to 116515.

In some embodiments, the immunogenic composition comprises nucleic acid sequences encoding one or more amino acid sequences derived from a MOG protein. In some embodiments, the immunogenic composition comprises nucleic acid sequences encoding two or more amino acid sequences selected from the group consisting of SEQ ID NOs: 116478 to 116515.

In another aspect, the invention provides for an immunogenic peptide composition comprising one or more peptides selected from the group consisting of SEQ ID NOs: 116478 to 116515.

In some embodiments, the immunogenic peptide composition comprises two or more peptides selected from the group consisting of SEQ ID NOs: 116478 to 116515. In some embodiments, the one or more peptides is a modified or unmodified fragment of a MOG protein.

In another aspect, the invention provides for an immunogenic composition comprising nucleic acid sequences encoding one or more amino acid sequences selected from the group consisting of SEQ ID NOs: 203517 to 203521.

In some embodiments, the immunogenic composition comprises nucleic acid sequences encoding one or more amino acid sequences derived from a INS protein. In some embodiments, the immunogenic composition comprises nucleic acid sequences encoding two or more amino acid sequences selected from the group consisting of SEQ ID NOs: 203517 to 203521.

In another aspect, the invention provides for an immunogenic peptide composition comprising one or more peptides selected from the group consisting of SEQ ID NOs: 203517 to 203521.

In some embodiments, the immunogenic peptide composition comprises two or more peptides selected from the group consisting of SEQ ID NOs: 203517 to 203521. In some embodiments, the one or more peptides is a modified or unmodified fragment of a INS protein.

In another aspect, the invention provides for an immunogenic composition comprising nucleic acid sequences encoding one or more amino acid sequences selected from the group consisting of SEQ ID NOs: 307670 to 307674.

In some embodiments, the immunogenic composition comprises nucleic acid sequences encoding one or more amino acid sequences derived from a MOG protein. In some embodiments, the immunogenic composition comprises nucleic acid sequences encoding two or more amino acid sequences selected from the group consisting of SEQ ID NOs: 307670 to 307674.

In another aspect, the invention provides for an immunogenic peptide composition comprising one or more peptides selected from the group consisting of SEQ ID NOs: 307670 to 307674.

In some embodiments, the immunogenic peptide composition comprises two or more peptides selected from the group consisting of SEQ ID NOs: 307670 to 307674. In some embodiments, the one or more peptides is a modified or unmodified fragment of a MOG protein.

Compositions

In some embodiments, a peptide vaccine comprises one or more peptides of this disclosure and is administered in a pharmaceutical composition that includes a pharmaceutically acceptable carrier. In some embodiments, the peptide vaccine is comprised of the third peptide set, as described in this disclosure. In some embodiments, the pharmaceutical composition is in the form of a spray, aerosol, gel, solution, emulsion, lipid nanoparticle, nanoparticle, or suspension.

The composition is preferably administered to a subject with a pharmaceutically acceptable carrier. Typically, in some embodiments, an appropriate amount of a pharmaceutically acceptable salt is used in the formulation, which in some embodiments can render the formulation isotonic.

In certain embodiments, the peptides are provided as an immunogenic composition comprising any one of the peptides described herein and a pharmaceutically acceptable carrier. In certain embodiments, the immunogenic composition further comprises an adjuvant. In certain embodiments, the peptides are conjugated with other molecules to increase their effectiveness as is known by those practiced in the art. For example, peptides can be coupled to antibodies that recognize cell surface proteins on antigen presenting cells to enhance vaccine effectiveness. One such method for increasing the effectiveness of peptide delivery is described in Woodham, et al., (2018). In certain embodiments for the treatment of autoimmune disorders, the peptides are delivered with a composition and protocol designed to induce tolerance as is known in the art. Example methods for using peptides for immune tolerization are described in Alhadj Ali, et al., (2017) and Gibson, et al., (2015).

In some embodiments, the pharmaceutically acceptable carrier is selected from the group consisting of saline, Ringer's solution, dextrose solution, and a combination thereof. Other suitable pharmaceutically acceptable carriers known in the art are contemplated. Suitable carriers and their formulations are described in Remington's Pharmaceutical Sciences, 2005, Mack Publishing Co. The pH of the solution is preferably from about 5 to about 8, and more preferably from about 7 to about 7.5. The formulation may also comprise a lyophilized powder. Further carriers include sustained release preparations such as semipermeable matrices of solid hydrophobic polymers, which matrices are in the form of shaped articles, e.g., films, liposomes or microparticles. It will be apparent to those persons skilled in the art that certain carriers may be more preferable depending upon, for instance, the route of administration and concentration of peptides being administered.

The phrase pharmaceutically acceptable carrier as used herein means a pharmaceutically acceptable material, composition or vehicle, such as a liquid or solid filler, diluent, excipient, solvent or encapsulating material, involved in carrying or transporting the subject pharmaceutical agent from one organ, or portion of the body, to another organ, or portion of the body. Each carrier is acceptable in the sense of being compatible with the other ingredients of the formulation and not injurious to the patient. Some examples of materials which can serve as pharmaceutically acceptable carriers include: sugars, such as lactose, glucose and sucrose; starches, such as corn starch and potato starch; cellulose, and its derivatives, such as sodium carboxymethyl cellulose, ethyl cellulose and cellulose acetate; powdered tragacanth; malt; gelatin; talc; excipients, such as cocoa butter and suppository waxes; oils, such as peanut oil, cottonseed oil, safflower oil, sesame oil, olive oil, corn oil and soybean oil; glycols, such as butylene glycol; polyols, such as glycerin, sorbitol, mannitol and polyethylene glycol; esters, such as ethyl oleate and ethyl laurate; agar; buffering agents, such as magnesium hydroxide and aluminum hydroxide; alginic acid; pyrogen-free water; isotonic saline; Ringer's solution; ethyl alcohol; phosphate buffer solutions; and other non-toxic compatible substances employed in pharmaceutical formulations. The term carrier denotes an organic or inorganic ingredient, natural or synthetic, with which the active ingredient is combined to facilitate the application. The components of the pharmaceutical compositions also are capable of being comingled with the compounds of the present invention, and with each other, in a manner such that there is no interaction which would substantially impair the desired pharmaceutical efficiency. The composition may also include additional agents such as an isotonicity agent, a preservative, a surfactant, and, a divalent cation, preferably, zinc.

The composition can also include an excipient, or an agent for stabilization of a peptide composition, such as a buffer, a reducing agent, a bulk protein, amino acids (such as e.g., glycine or praline) or a carbohydrate. Bulk proteins useful in formulating peptide compositions include albumin. Typical carbohydrates useful in formulating peptides include but are not limited to sucrose, mannitol, lactose, trehalose, or glucose.

Surfactants may also be used to prevent soluble and insoluble aggregation and/or precipitation of peptides or proteins included in the composition. Suitable surfactants include but are not limited to sorbitan trioleate, soya lecithin, and oleic acid. In certain cases, solution aerosols are preferred using solvents such as ethanol. Thus, formulations including peptides can also include a surfactant that can reduce or prevent surface-induced aggregation of peptides by atomization of the solution in forming an aerosol. Various conventional surfactants can be employed, such as polyoxyethylene fatty acid esters and alcohols, and polyoxyethylene sorbitol fatty acid esters. Amounts will generally range between 0.001% and 4% by weight of the formulation. In some embodiments, surfactants used with the present disclosure are polyoxyethylene sorbitan mono-oleate, polysorbate 80, polysorbate 20. Additional agents known in the art can also be included in the composition.

In some embodiments, the pharmaceutical compositions and dosage forms further comprise one or more compounds that reduce the rate by which an active ingredient will decay, or the composition will change in character. So called stabilizers or preservatives may include, but are not limited to, amino acids, antioxidants, pH buffers, or salt buffers. Nonlimiting examples of antioxidants include butylated hydroxy anisole (BHA), ascorbic acid and derivatives thereof, tocopherol and derivatives thereof, butylated hydroxy anisole and cysteine. Nonlimiting examples of preservatives include parabens, such as methyl or propyl p-hydroxybenzoate and benzalkonium chloride. Additional nonlimiting examples of amino acids include glycine or proline.

The present invention also teaches the stabilization (preventing or minimizing thermally or mechanically induced soluble or insoluble aggregation and/or precipitation of an inhibitor protein) of liquid solutions containing peptides at neutral pH or less than neutral pH by the use of amino acids including proline or glycine, with or without divalent cations resulting in clear or nearly clear solutions that are stable at room temperature or preferred for pharmaceutical administration.

In one embodiment, the composition is a pharmaceutical composition of single unit or multiple unit dosage forms. Pharmaceutical compositions of single unit or multiple unit dosage forms of the invention comprise a prophylactically or therapeutically effective amount of one or more compositions (e.g., a compound of the invention, or other prophylactic or therapeutic agent), typically, one or more vehicles, carriers, or excipients, stabilizing agents, and/or preservatives. Preferably, the vehicles, carriers, excipients, stabilizing agents and preservatives are pharmaceutically acceptable.

In some embodiments, the pharmaceutical compositions and dosage forms comprise anhydrous pharmaceutical compositions and dosage forms. Anhydrous pharmaceutical compositions and dosage forms of the invention can be prepared using anhydrous or low moisture containing ingredients and low moisture or low humidity conditions. Pharmaceutical compositions and dosage forms that comprise lactose and at least one active ingredient that comprise a primary or secondary amine are preferably anhydrous if substantial contact with moisture and/or humidity during manufacturing, packaging, and/or storage is expected. An anhydrous pharmaceutical composition should be prepared and stored such that its anhydrous nature is maintained. Accordingly, anhydrous compositions are preferably packaged using materials known to prevent exposure to water such that they can be included in suitable formulary kits. Examples of suitable packaging include, but are not limited to, hermetically sealed foils, plastics, unit dose containers (e.g., vials), blister packs, and strip packs.

Suitable vehicles are well known to those skilled in the art of pharmacy, and non-limiting examples of suitable vehicles include glucose, sucrose, starch, lactose, gelatin, rice, silica gel, glycerol, talc, sodium chloride, dried skim milk, propylene glycol, water, sodium stearate, ethanol, and similar substances well known in the art. Saline solutions and aqueous dextrose and glycerol solutions can also be employed as liquid vehicles. Whether a particular vehicle is suitable for incorporation into a pharmaceutical composition or dosage form depends on a variety of factors well known in the art including, but not limited to, the way in which the dosage form will be administered to a patient and the specific active ingredients in the dosage form. Pharmaceutical vehicles can be sterile liquids, such as water and oils, including those of petroleum, animal, vegetable or synthetic origin, such as peanut oil, soybean oil, mineral oil, sesame oil and the like.

The invention also provides that a pharmaceutical composition can be packaged in a hermetically sealed container such as an ampoule or sachette indicating the quantity. In one embodiment, the pharmaceutical composition can be supplied as a dry sterilized lyophilized powder in a delivery device suitable for administration to the lower airways of a patient. The pharmaceutical compositions can, if desired, be presented in a pack or dispenser device that can contain one or more unit dosage forms containing the active ingredient. The pack can for example comprise metal or plastic foil, such as a blister pack. The pack or dispenser device can be accompanied by instructions for administration.

Methods of preparing these formulations or compositions include the step of bringing into association a compound of the present invention with the carrier and, optionally, one or more accessory ingredients. In general, the formulations are prepared by uniformly and intimately bringing into association a compound of the present invention with liquid carriers, or finely divided solid carriers, or both, and then, if necessary, shaping the product.

Formulations of the invention suitable for administration may be in the form of powders, granules, or as a solution or a suspension in an aqueous or non-aqueous liquid, or as an oil-in-water or water-in-oil liquid emulsion, or as an elixir or syrup, or as pastilles (using an inert base, such as gelatin and glycerin, or sucrose and acacia) and/or as mouthwashes and the like, each containing a predetermined amount of a compound of the present invention (e.g., peptides) as an active ingredient.

A liquid composition herein can be used as such with a delivery device, or they can be used for the preparation of pharmaceutically acceptable formulations comprising peptides that are prepared for example by the method of spray drying. The methods of spray freeze-drying peptides/proteins for pharmaceutical administration disclosed in Maa et al., Curr. Pharm. Biotechnol., 2001, 1, 283-302, are incorporated herein. In another embodiment, the liquid solutions herein are freeze spray dried and the spray-dried product is collected as a dispersible peptide-containing powder that is therapeutically effective when administered to an individual.

The compounds and pharmaceutical compositions of the present invention can be employed in combination therapies, that is, the compounds and pharmaceutical compositions can be administered concurrently with, prior to, or subsequent to, one or more other desired therapeutics or medical procedures (e.g., peptide vaccine can be used in combination therapy with another treatment such as chemotherapy, radiation, pharmaceutical agents, and/or another treatment). The particular combination of therapies (therapeutics or procedures) to employ in a combination regimen will take into account compatibility of the desired therapeutics and/or procedures and the desired therapeutic effect to be achieved. It will also be appreciated that the therapies employed may achieve a desired effect for the same disorder (for example, the compound of the present invention may be administered concurrently with another therapeutic or prophylactic).

The invention also provides a pharmaceutical pack or kit comprising one or more containers filled with one or more of the ingredients of the pharmaceutical compositions of the invention. Optionally associated with such container(s) can be a notice in the form prescribed by a governmental agency regulating the manufacture, use or sale of pharmaceuticals or biological products, which notice reflects approval by the agency of manufacture, use or sale for human administration.

The current invention provides for dosage forms comprising peptides suitable for treating cancer or other diseases. The dosage forms can be formulated, e.g., as sprays, aerosols, nanoparticles, liposomes, or other forms known to one of skill in the art. See, e.g., Remington's Pharmaceutical Sciences; Remington: The Science and Practice of Pharmacy supra; Pharmaceutical Dosage Forms and Drug Delivery Systems by Howard C., Ansel et al., Lippincott Williams & Wilkins; 7th edition (Oct. 1, 1999).

Generally, a dosage form used in the acute treatment of a disease may contain larger amounts of one or more of the active ingredients it comprises than a dosage form used in the chronic treatment of the same disease. In addition, the prophylactically and therapeutically effective dosage form may vary among different conditions. For example, a therapeutically effective dosage form may contain peptides that has an appropriate immunogenic action when intending to treat cancer or other disease. On the other hand, a different effective dosage may contain peptides that has an appropriate immunogenic action when intending to use the peptides of the invention as a prophylactic (e.g., vaccine) against cancer or another disease/condition. These and other ways in which specific dosage forms encompassed by this invention will vary from one another and will be readily apparent to those skilled in the art. See, e.g., Remington's Pharmaceutical Sciences, 2005, Mack Publishing Co.; Remington: The Science and Practice of Pharmacy by Gennaro, Lippincott Williams & Wilkins; 20th edition (2003); Pharmaceutical Dosage Forms and Drug Delivery Systems by Howard C. Ansel et al., Lippincott Williams & Wilkins; 7th edition (Oct. 1, 1999); and Encyclopedia of Pharmaceutical Technology, edited by Swarbrick, J. & J. C. Boylan, Marcel Dekker, Inc., New York, 1988, which are incorporated herein by reference in their entirety.

The pH of a pharmaceutical composition or dosage form may also be adjusted to improve delivery and/or stability of one or more active ingredients. Similarly, the polarity of a solvent carrier, its ionic strength, or tonicity can be adjusted to improve delivery. Compounds such as stearates can also be added to pharmaceutical compositions or dosage forms to alter advantageously the hydrophilicity or lipophilicity of one or more active ingredients to improve delivery. In this regard, stearates can also serve as a lipid vehicle for the formulation, as an emulsifying agent or surfactant, and as a delivery enhancing or penetration-enhancing agent. Different salts, hydrates, or solvates of the active ingredients can be used to adjust further the properties of the resulting composition.

Compositions can be formulated with appropriate carriers and adjuvants using techniques to yield compositions suitable for immunization. The compositions can include an adjuvant, such as, for example but not limited to, alum, poly IC, MF-59, squalene-based adjuvants, or liposomal based adjuvants suitable for immunization.

In some embodiments, the compositions and methods comprise any suitable agent or immune modulation which could modulate mechanisms of host immune tolerance and release of the induced antibodies. In certain embodiments, an immunomodulatory agent is administered in at time and in an amount sufficient for transient modulation of the subject's immune response so as to induce an immune response which comprises antibodies against for example tumor neoantigens (i.e., tumor-specific antigens (TSA)).

Expression Systems

In certain aspects, the invention provides culturing a cell line that expresses any one of the peptides of the invention in a culture medium comprising any of the peptides described herein.

Various expression systems for producing recombinant proteins/peptides are known in the art, and include, prokaryotic (e.g., bacteria), plant, insect, yeast, and mammalian expression systems. Suitable cell lines, can be transformed, transduced, or transfected with nucleic acids containing coding sequences for the peptides of the invention in order to produce the molecule of interest. Expression vectors containing such a nucleic acid sequence, which can be linked to at least one regulatory sequence in a manner that allows expression of the nucleotide sequence in a host cell, can be introduced via methods known in the art. Practitioners in the art understand that designing an expression vector can depend on factors, such as the choice of host cell to be transfected and/or the type and/or amount of desired protein to be expressed. Enhancer regions, which are those sequences found upstream or downstream of the promoter region in non-coding DNA regions, are also known in the art to be important in optimizing expression. If needed, origins of replication from viral sources can be employed, such as if a prokaryotic host is utilized for introduction of plasmid DNA. However, in eukaryotic organisms, chromosome integration is a common mechanism for DNA replication. For stable transfection of mammalian cells, a small fraction of cells can integrate introduced DNA into their genomes. The expression vector and transfection method utilized can be factors that contribute to a successful integration event. For stable amplification and expression of a desired protein, a vector containing DNA encoding a protein of interest is stably integrated into the genome of eukaryotic cells (for example mammalian cells), resulting in the stable expression of transfected genes. A gene that encodes a selectable marker (for example, resistance to antibiotics or drugs) can be introduced into host cells along with the gene of interest in order to identify and select clones that stably express a gene encoding a protein of interest. Cells containing the gene of interest can be identified by drug selection wherein cells that have incorporated the selectable marker gene will survive in the presence of the drug. Cells that have not incorporated the gene for the selectable marker die. Surviving cells can then be screened for the production of the desired protein molecule.

A host cell strain, which modulates the expression of the inserted sequences, or modifies and processes the nucleic acid in a specific fashion desired also may be chosen. Such modifications (for example, glycosylation and other post-translational modifications) and processing (for example, cleavage) of peptide/protein products may be important for the function of the peptide/protein. Different host cell strains have characteristic and specific mechanisms for the post-translational processing and modification of proteins and gene products. As such, appropriate host systems or cell lines can be chosen to ensure the correct modification and processing of the target protein expressed. Thus, eukaryotic host cells possessing the cellular machinery for proper processing of the primary transcript, glycosylation, and phosphorylation of the gene product may be used.

Various culturing parameters can be used with respect to the host cell being cultured. Appropriate culture conditions for mammalian cells are well known in the art (Cleveland W L, et al., J Immunol Methods, 1983, 56(2): 221-234) or can be determined by the skilled artisan (see, for example, Animal Cell Culture: A Practical Approach 2nd Ed., Rickwood, D. and Hames, B. D., eds. (Oxford University Press: New York, 1992)). Cell culturing conditions can vary according to the type of host cell selected. Commercially available medium can be utilized.

Peptides of the invention can be purified from any human or non-human cell which expresses the polypeptide, including those which have been transfected with expression constructs that express peptides of the invention. For protein recovery, isolation and/or purification, the cell culture medium or cell lysate is centrifuged to remove particulate cells and cell debris. The desired polypeptide molecule is isolated or purified away from contaminating soluble proteins and polypeptides by suitable purification techniques. Non-limiting purification methods for proteins include: size exclusion chromatography; affinity chromatography; ion exchange chromatography; ethanol precipitation; reverse phase HPLC; chromatography on a resin, such as silica, or cation exchange resin, e.g., DEAE; chromatofocusing; SDS-PAGE; ammonium sulfate precipitation; gel filtration using, e.g., Sephadex G-75, Sepharose; protein A sepharose chromatography for removal of immunoglobulin contaminants; and the like. Other additives, such as protease inhibitors (e.g., PMSF or proteinase K) can be used to inhibit proteolytic degradation during purification. Purification procedures that can select for carbohydrates can also be used, e.g., ion-exchange soft gel chromatography, or HPLC using cation- or anionexchange resins, in which the more acidic fraction(s) is/are collected.

Methods of Treatment

In one embodiment, the subject matter disclosed herein relates to a preventive medical treatment started after following diagnosis of cancer in order to prevent the disease from worsening or curing the disease. In one embodiment, the subject matter disclosed herein relates to prophylaxis of subjects who are believed to be at risk for cancer or have previously been diagnosed with cancer (or another disease). In one embodiment, said subjects can be administered the peptide vaccine described herein or pharmaceutical compositions thereof. The invention contemplates using any of the peptides produced by the systems and methods described herein. In one embodiment, the peptide vaccines described herein can be administered subcutaneously via syringe or any other suitable method know in the art.

The compound(s) or combination of compounds disclosed herein, or pharmaceutical compositions may be administered to a cell, mammal, or human by any suitable means. Non-limiting examples of methods of administration include, among others, (a) administration though oral pathways, which includes administration in capsule, tablet, granule, spray, syrup, or other such forms; (b) administration through non-oral pathways such as intraocular, intranasal, intraauricular, rectal, vaginal, intraurethral, transmucosal, buccal, or transdermal, which includes administration as an aqueous suspension, an oily preparation or the like or as a drip, spray, suppository, salve, ointment or the like; (c) administration via injection, including subcutaneously, intraperitoneally, intravenously, intramuscularly, intradermally, intraorbitally, intracapsularly, intraspinally, intrasternally, or the like, including infusion pump delivery; (d) administration locally such as by injection directly in the renal or cardiac area, e.g., by depot implantation; (e) administration topically; as deemed appropriate by those of skill in the art for bringing the compound or combination of compounds disclosed herein into contact with living tissue; (f) administration via inhalation, including through aerosolized, nebulized, and powdered formulations; and (g) administration through implantation.

As will be readily apparent to one skilled in the art, the effective in vivo dose to be administered and the particular mode of administration will vary depending upon the age, weight and species treated, and the specific use for which the compound or combination of compounds disclosed herein are employed. The determination of effective dose levels, that is the dose levels necessary to achieve the desired result, can be accomplished by one skilled in the art using routine pharmacological methods. Typically, human clinical applications of products are commenced at lower dose levels, with dose level being increased until the desired effect is achieved. Alternatively, acceptable in vitro studies can be used to establish useful doses and routes of administration of the compositions identified by the present methods using established pharmacological methods. Effective animal doses from in vivo studies can be converted to appropriate human doses using conversion methods known in the art (e.g., see Nair A B, Jacob S. A simple practice guide for dose conversion between animals and human. Journal of basic and clinical pharmacy. 2016 March; 7(2):27)

Methods of Prevention

In some embodiments, the peptides prepared using methods of the invention can be used as a vaccine to promote an immune response against cancer (e.g., against tumor neoantigens). In some embodiments, the invention provides compositions and methods for induction of immune response, for example induction of antibodies to tumor neoantigens. In some embodiments, the antibodies are broadly neutralizing antibodies. In some embodiments, the peptides prepared using methods of the invention can be used as a vaccine to promote an immune response against a pathogen. In some embodiments, the peptides prepared using methods of the invention can be used to promote immune tolerance as an autoimmune disease therapeutic.

The compositions, systems, and methods disclosed herein are not to be limited in scope to the specific embodiments described herein. Indeed, various modifications of the compositions, systems, and methods in addition to those described will become apparent to those of skill in the art from the foregoing description.

SEQUENCE LISTING (410310 sequences)

SEQ ID NO: 1 - protein, 10 aa, Artificial Sequence
  Description of Artificial Sequence: Synthetic peptide
  Seed: KYIKTWRPRY (AKT1 E17K)
KFIKTWRPRK

SEQ ID NO: 2 - protein, 10 aa, Artificial Sequence
  Description of Artificial Sequence: Synthetic peptide
  Seed: KYIKTWRPRY (AKT1 E17K)
KVIKTWRPRY

SEQ ID NO: 3 - protein, 9 aa, Artificial Sequence
  Description of Artificial Sequence: Synthetic peptide
  Seed: RGKYIKTWR (AKT1 E17K)
RVKYIKTWR

SEQ ID NO: 4 - protein, 9 aa, Artificial Sequence
  Description of Artificial Sequence: Synthetic peptide
  Seed: WLHKRGKYI (AKT1 E17K)
WAHKRGKYL

SEQ ID NO: 5 - protein, 9 aa, Artificial Sequence
  Description of Artificial Sequence: Synthetic peptide
  Seed: GWLHKRGKY (AKT1 E17K)
GTLHKRGKY

SEQ ID NO: 6 - protein, 9 aa, Artificial Sequence
  Description of Artificial Sequence: Synthetic peptide
  Seed: KRGKYIKTW (AKT1 E17K)
KRGKYIKTF

SEQ ID NO: 7 - protein, 9 aa, Artificial Sequence
  Description of Artificial Sequence: Synthetic peptide
  Seed: KRGKYIKTW (AKT1 E17K)
KRGKYIKTY

SEQ ID NO: 8 - protein, 9 aa, Artificial Sequence
  Description of Artificial Sequence: Synthetic peptide
  Seed: KRGKYIKTW (AKT1 E17K)
KTGKYIKTF

SEQ ID NO: 9 - protein, 10 aa, Artificial Sequence
  Description of Artificial Sequence: Synthetic peptide
  Seed: KYIKTWRPRY (AKT1 E17K)
KYIKTWRPRF

SEQ ID NO: 10 - protein, 9 aa, Artificial Sequence
  Description of Artificial Sequence: Synthetic peptide
  Seed: RGKYIKTWR (AKT1 E17K)
RTKYIKTWK

SEQ ID NO: 11 - protein, 9 aa, Artificial Sequence
  Description of Artificial Sequence: Synthetic peptide
  Seed: RGKYIKTWR (AKT1 E17K)
RVKYIKTWK

SEQ ID NO: 12 - protein, 9 aa, Artificial Sequence
  Description of Artificial Sequence: Synthetic peptide
  Seed: WLHKRGKYI (AKT1 E17K)
WLHKRGKYV

SEQ ID NO: 13 - protein, 10 aa, Artificial Sequence
  Description of Artificial Sequence: Synthetic peptide
  Seed: KYIKTWRPRY (AKT1 E17K)
KMIKTWRPRY

SEQ ID NO: 14 - protein, 9 aa, Artificial Sequence
  Description of Artificial Sequence: Synthetic peptide
  Seed: RGKYIKTWR (AKT1 E17K)
RMKYIKTWR

SEQ ID NO: 15 - protein, 9 aa, Artificial Sequence
  Description of Artificial Sequence: Synthetic peptide
  Seed: GWLHKRGKY (AKT1 E17K)
GMLHKRGKY

SEQ ID NO: 16 - protein, 9 aa, Artificial Sequence
  Description of Artificial Sequence: Synthetic peptide
  Seed: KRGKYIKTW (AKT1 E17K)
KRGKYIKTL

SEQ ID NO: 17 - protein, 9 aa, Artificial Sequence
  Description of Artificial Sequence: Synthetic peptide
  Seed: RGKYIKTWR (AKT1 E17K)
RSKYIKTWK

SEQ ID NO: 18 - protein, 9 aa, Artificial Sequence
  Description of Artificial Sequence: Synthetic peptide
  Seed: WLHKRGKYI (AKT1 E17K)
WMHKRGKYV

SEQ ID NO: 19 - protein, 10 aa, Artificial Sequence
  Description of Artificial Sequence: Synthetic peptide
  Seed: FGLATEKSRW (BRAF V600E)
FSLATEKSRW

SEQ ID NO: 20 - protein, 10 aa, Artificial Sequence
  Description of Artificial Sequence: Synthetic peptide
  Seed: FGLATEKSRW (BRAF V600E)
FTLATEKSRW

SEQ ID NO: 21 - protein, 11 aa, Artificial Sequence
  Description of Artificial Sequence: Synthetic peptide
  Seed: KIGDFGLATEK (BRAF V600E)
KMGDFGLATEK

SEQ ID NO: 22 - protein, 11 aa, Artificial Sequence
  Description of Artificial Sequence: Synthetic peptide
  Seed: KIGDFGLATEK (BRAF V600E)
KTGDFGLATEK

SEQ ID NO: 23 - protein, 11 aa, Artificial Sequence
  Description of Artificial Sequence: Synthetic peptide
  Seed: KIGDFGLATEK (BRAF V600E)
KVGDFGLATER

SEQ ID NO: 24 - protein, 9 aa, Artificial Sequence
  Description of Artificial Sequence: Synthetic peptide
  Seed: FGLATEKSR (BRAF V600E)
FTLATEKSR

SEQ ID NO: 25 - protein, 9 aa, Artificial Sequence
  Description of Artificial Sequence: Synthetic peptide
  Seed: GDFGLATEK (BRAF V600E)
GAFGLATEL

SEQ ID NO: 26 - protein, 9 aa, Artificial Sequence
  Description of Artificial Sequence: Synthetic peptide
  Seed: GLATEKSRW (BRAF V600E)
GQATEKSRL

SEQ ID NO: 27 - protein, 9 aa, Artificial Sequence
  Description of Artificial Sequence: Synthetic peptide
  Seed: GLATEKSRW (BRAF V600E)
GSATEKSRW

SEQ ID NO: 28 - protein, 10 aa, Artificial Sequence
  Description of Artificial Sequence: Synthetic peptide
  Seed: IGDFGLATEK (BRAF V600E)
ISDFGLATEY

SEQ ID NO: 29 - protein, 11 aa, Artificial Sequence
  Description of Artificial Sequence: Synthetic peptide
  Seed: KIGDFGLATEK (BRAF V600E)
KAGDFGLATEY

SEQ ID NO: 30 - protein, 11 aa, Artificial Sequence
  Description of Artificial Sequence: Synthetic peptide
  Seed: KIGDFGLATEK (BRAF V600E)
KVGDFGLATEK

SEQ ID NO: 31 - protein, 11 aa, Artificial Sequence
  Description of Artificial Sequence: Synthetic peptide
  Seed: KIGDFGLATEK (BRAF V600E)
KMGDFGLATER

SEQ ID NO: 32 - protein, 9 aa, Artificial Sequence
  Description of Artificial Sequence: Synthetic peptide
  Seed: GDFGLATEK (BRAF V600E)
GAFGLATEF

SEQ ID NO: 33 - protein, 10 aa, Artificial Sequence
  Description of Artificial Sequence: Synthetic peptide
  Seed: IGDFGLATEK (BRAF V600E)
IADFGLATEY

SEQ ID NO: 34 - protein, 10 aa, Artificial Sequence
  Description of Artificial Sequence: Synthetic peptide
  Seed: ATMKSRWSGS (BRAF V600M)
AYMKSRWSGK

SEQ ID NO: 35 - protein, 10 aa, Artificial Sequence
  Description of Artificial Sequence: Synthetic peptide
  Seed: FGLATMKSRW (BRAF V600M)
FTLATMKSRW

SEQ ID NO: 36 - protein, 11 aa, Artificial Sequence
  Description of Artificial Sequence: Synthetic peptide
  Seed: KIGDFGLATMK (BRAF V600M)
KMGDFGLATMK

SEQ ID NO: 37 - protein, 11 aa, Artificial Sequence
  Description of Artificial Sequence: Synthetic peptide
  Seed: KIGDFGLATMK (BRAF V600M)
KTGDFGLATMK

SEQ ID NO: 38 - protein, 11 aa, Artificial Sequence
  Description of Artificial Sequence: Synthetic peptide
  Seed: MKSRWSGSHQF (BRAF V600M)
MMSRWSGSHQF

SEQ ID NO: 39 - protein, 9 aa, Artificial Sequence
  Description of Artificial Sequence: Synthetic peptide
  Seed: FGLATMKSR (BRAF V600M)
FTLATMKSR

SEQ ID NO: 40 - protein, 11 aa, Artificial Sequence
  Description of Artificial Sequence: Synthetic peptide
  Seed: KIGDFGLATMK (BRAF V600M)
KYGDFGLATMR

SEQ ID NO: 41 - protein, 9 aa, Artificial Sequence
  Description of Artificial Sequence: Synthetic peptide
  Seed: FGLATMKSR (BRAF V600M)
FTLATMKSK

SEQ ID NO: 42 - protein, 9 aa, Artificial Sequence
  Description of Artificial Sequence: Synthetic peptide
  Seed: FGLATMKSR (BRAF V600M)
FVLATMKSR

SEQ ID NO: 43 - protein, 9 aa, Artificial Sequence
  Description of Artificial Sequence: Synthetic peptide
  Seed: GLATMKSRW (BRAF V600M)
GSATMKSRW

SEQ ID NO: 44 - protein, 9 aa, Artificial Sequence
  Description of Artificial Sequence: Synthetic peptide
  Seed: GLATMKSRW (BRAF V600M)
GTATMKSRW

SEQ ID NO: 45 - protein, 11 aa, Artificial Sequence
  Description of Artificial Sequence: Synthetic peptide
  Seed: KIGDFGLATMK (BRAF V600M)
KTGDFGLATMR

SEQ ID NO: 46 - protein, 11 aa, Artificial Sequence
  Description of Artificial Sequence: Synthetic peptide
  Seed: KIGDFGLATMK (BRAF V600M)
KVGDFGLATMK

SEQ ID NO: 47 - protein, 9 aa, Artificial Sequence
  Description of Artificial Sequence: Synthetic peptide
  Seed: ATMKSRWSG (BRAF V600M)
ATMKSRWSK

SEQ ID NO: 48 - protein, 10 aa, Artificial Sequence
  Description of Artificial Sequence: Synthetic peptide
  Seed: FGLATMKSRW (BRAF V600M)
FSLATMKSRW

SEQ ID NO: 49 - protein, 11 aa, Artificial Sequence
  Description of Artificial Sequence: Synthetic peptide
  Seed: MKSRWSGSHQF (BRAF V600M)
MQSRWSGSHQF

SEQ ID NO: 50 - protein, 10 aa, Artificial Sequence
  Description of Artificial Sequence: Synthetic peptide
  Seed: IGDFGLATMK (BRAF V600M)
ITDFGLATMY

SEQ ID NO: 51 - protein, 10 aa, Artificial Sequence
  Description of Artificial Sequence: Synthetic peptide
  Seed: KYSFGVTCVK (EGFR A289V)
KMSFGVTCVK

SEQ ID NO: 52 - protein, 9 aa, Artificial Sequence
  Description of Artificial Sequence: Synthetic peptide
  Seed: KYSFGVTCV (EGFR A289V)
KYSFGVTCL

SEQ ID NO: 53 - protein, 8 aa, Artificial Sequence
  Description of Artificial Sequence: Synthetic peptide
  Seed: YSFGVTCV (EGFR A289V)
YAFGVTCM

SEQ ID NO: 54 - protein, 9 aa, Artificial Sequence
  Description of Artificial Sequence: Synthetic peptide
  Seed: YSFGVTCVK (EGFR A289V)
YTFGVTCVR

SEQ ID NO: 55 - protein, 9 aa, Artificial Sequence
  Description of Artificial Sequence: Synthetic peptide
  Seed: YSFGVTCVK (EGFR A289V)
YVFGVTCVM

SEQ ID NO: 56 - protein, 9 aa, Artificial Sequence
  Description of Artificial Sequence: Synthetic peptide
  Seed: GKYSFGVTC (EGFR A289V)
GRYSFGVTF

SEQ ID NO: 57 - protein, 9 aa, Artificial Sequence
  Description of Artificial Sequence: Synthetic peptide
  Seed: KYSFGVTCV (EGFR A289V)
KYSFGVTCF

SEQ ID NO: 58 - protein, 9 aa, Artificial Sequence
  Description of Artificial Sequence: Synthetic peptide
  Seed: YSFGVTCVK (EGFR A289V)
YMFGVTCVK

SEQ ID NO: 59 - protein, 9 aa, Artificial Sequence
  Description of Artificial Sequence: Synthetic peptide
  Seed: YSFGVTCVK (EGFR A289V)
YSFGVTCVM

SEQ ID NO: 60 - protein, 9 aa, Artificial Sequence
  Description of Artificial Sequence: Synthetic peptide
  Seed: YSFGVTCVK (EGFR A289V)
YTFGVTCVK

SEQ ID NO: 61 - protein, 9 aa, Artificial Sequence
  Description of Artificial Sequence: Synthetic peptide
  Seed: YSFGVTCVK (EGFR A289V)
YTFGVTCVY

SEQ ID NO: 62 - protein, 9 aa, Artificial Sequence
  Description of Artificial Sequence: Synthetic peptide
  Seed: YSFGVTCVK (EGFR A289V)
YVFGVTCVR

SEQ ID NO: 63 - protein, 9 aa, Artificial Sequence
  Description of Artificial Sequence: Synthetic peptide
  Seed: YSFGVTCVK (EGFR A289V)
YMFGVTCVY

SEQ ID NO: 64 - protein, 9 aa, Artificial Sequence
  Description of Artificial Sequence: Synthetic peptide
  Seed: GKYSFGVTC (EGFR A289V)
GQYSFGVTL

SEQ ID NO: 65 - protein, 9 aa, Artificial Sequence
  Description of Artificial Sequence: Synthetic peptide
  Seed: YSFGVTCVK (EGFR A289V)
YLFGVTCVK

SEQ ID NO: 66 - protein, 9 aa, Artificial Sequence
  Description of Artificial Sequence: Synthetic peptide
  Seed: YSFGVTCVK (EGFR A289V)
YTFGVTCVM

SEQ ID NO: 67 - protein, 10 aa, Artificial Sequence
  Description of Artificial Sequence: Synthetic peptide
  Seed: VVMGENNTLV (EGFR G598V)
VMMGENNTLV

SEQ ID NO: 68 - protein, 9 aa, Artificial Sequence
  Description of Artificial Sequence: Synthetic peptide
  Seed: VVMGENNTL (EGFR G598V)
VMMGENNTV

SEQ ID NO: 69 - protein, 11 aa, Artificial Sequence
  Description of Artificial Sequence: Synthetic peptide
  Seed: VVMGENNTLVW (EGFR G598V)
VSMGENNTLVW

SEQ ID NO: 70 - protein, 9 aa, Artificial Sequence
  Description of Artificial Sequence: Synthetic peptide
  Seed: VVMGENNTL (EGFR G598V)
VSMGENNTM

SEQ ID NO: 71 - protein, 9 aa, Artificial Sequence
  Description of Artificial Sequence: Synthetic peptide
  Seed: VKTCPAVVM (EGFR G598V)
VSTCPAVVF

SEQ ID NO: 72 - protein, 9 aa, Artificial Sequence
  Description of Artificial Sequence: Synthetic peptide
  Seed: VVMGENNTL (EGFR G598V)
VAMGENNTM

SEQ ID NO: 73 - protein, 9 aa, Artificial Sequence
  Description of Artificial Sequence: Synthetic peptide
  Seed: VKTCPAVVM (EGFR G598V)
VQTCPAVVL

SEQ ID NO: 74 - protein, 9 aa, Artificial Sequence
  Description of Artificial Sequence: Synthetic peptide
  Seed: VVMGENNTL (EGFR G598V)
VAMGENNTL

SEQ ID NO: 75 - protein, 9 aa, Artificial Sequence
  Description of Artificial Sequence: Synthetic peptide
  Seed: VVMGENNTL (EGFR G598V)
VLMGENNTW

SEQ ID NO: 76 - protein, 9 aa, Artificial Sequence
  Description of Artificial Sequence: Synthetic peptide
  Seed: VVMGENNTL (EGFR G598V)
VPMGENNTL

SEQ ID NO: 77 - protein, 11 aa, Artificial Sequence
  Description of Artificial Sequence: Synthetic peptide
  Seed: VVMGENNTLVW (EGFR G598V)
VPMGENNTLVW

SEQ ID NO: 78 - protein, 9 aa, Artificial Sequence
  Description of Artificial Sequence: Synthetic peptide
  Seed: VVMGENNTL (EGFR G598V)
VRMGENNTL

SEQ ID NO: 79 - protein, 11 aa, Artificial Sequence
  Description of Artificial Sequence: Synthetic peptide
  Seed: VVMGENNTLVW (EGFR G598V)
VTMGENNTLVW

SEQ ID NO: 80 - protein, 9 aa, Artificial Sequence
  Description of Artificial Sequence: Synthetic peptide
  Seed: VVMGENNTL (EGFR G598V)
VTMGENNTV

SEQ ID NO: 81 - protein, 9 aa, Artificial Sequence
  Description of Artificial Sequence: Synthetic peptide
  Seed: VKTCPAVVM (EGFR G598V)
VQTCPAVVF

SEQ ID NO: 82 - protein, 9 aa, Artificial Sequence
  Description of Artificial Sequence: Synthetic peptide
  Seed: FGRAKLLGA (EGFR L858R)
FQRAKLLGL

SEQ ID NO: 83 - protein, 9 aa, Artificial Sequence
  Description of Artificial Sequence: Synthetic peptide
  Seed: ITDFGRAKL (EGFR L858R)
IADFGRAKM

SEQ ID NO: 84 - protein, 9 aa, Artificial Sequence
  Description of Artificial Sequence: Synthetic peptide
  Seed: KITDFGRAK (EGFR L858R)
KMTDFGRAK

SEQ ID NO: 85 - protein, 9 aa, Artificial Sequence
  Description of Artificial Sequence: Synthetic peptide
  Seed: KITDFGRAK (EGFR L858R)
KTTDFGRAK

SEQ ID NO: 86 - protein, 9 aa, Artificial Sequence
  Description of Artificial Sequence: Synthetic peptide
  Seed: KITDFGRAK (EGFR L858R)
KVTDFGRAR

SEQ ID NO: 87 - protein, 9 aa, Artificial Sequence
  Description of Artificial Sequence: Synthetic peptide
  Seed: FGRAKLLGA (EGFR L858R)
FPRAKLLGL

SEQ ID NO: 88 - protein, 9 aa, Artificial Sequence
  Description of Artificial Sequence: Synthetic peptide
  Seed: ITDFGRAKL (EGFR L858R)
IADFGRAKL

SEQ ID NO: 89 - protein, 9 aa, Artificial Sequence
  Description of Artificial Sequence: Synthetic peptide
  Seed: ITDFGRAKL (EGFR L858R)
ITDFGRAKW

SEQ ID NO: 90 - protein, 9 aa, Artificial Sequence
  Description of Artificial Sequence: Synthetic peptide
  Seed: ITDFGRAKL (EGFR L858R)
ITDFGRAKY

SEQ ID NO: 91 - protein, 10 aa, Artificial Sequence
  Description of Artificial Sequence: Synthetic peptide
  Seed: KITDFGRAKL (EGFR L858R)
KLTDFGRAKV

SEQ ID NO: 92 - protein, 9 aa, Artificial Sequence
  Description of Artificial Sequence: Synthetic peptide
  Seed: TDFGRAKLL (EGFR L858R)
TEFGRAKLV

SEQ ID NO: 93 - protein, 9 aa, Artificial Sequence
  Description of Artificial Sequence: Synthetic peptide
  Seed: TDFGRAKLL (EGFR L858R)
TQFGRAKLL

SEQ ID NO: 94 - protein, 9 aa, Artificial Sequence
  Description of Artificial Sequence: Synthetic peptide
  Seed: FGRAKLLGA (EGFR L858R)
FMRAKLLGL

SEQ ID NO: 95 - protein, 9 aa, Artificial Sequence
  Description of Artificial Sequence: Synthetic peptide
  Seed: KITDFGRAK (EGFR L858R)
KMTDFGRAR

SEQ ID NO: 96 - protein, 9 aa, Artificial Sequence
  Description of Artificial Sequence: Synthetic peptide
  Seed: ITDFGRAKL (EGFR L858R)
ISDFGRAKW

SEQ ID NO: 97 - protein, 9 aa, Artificial Sequence
  Description of Artificial Sequence: Synthetic peptide
  Seed: ITDFGRAKL (EGFR L858R)
ISDFGRAKY

SEQ ID NO: 98 - protein, 9 aa, Artificial Sequence
  Description of Artificial Sequence: Synthetic peptide
  Seed: TDFGRAKLL (EGFR L858R)
TEFGRAKLI

SEQ ID NO: 99 - protein, 9 aa, Artificial Sequence
  Description of Artificial Sequence: Synthetic peptide
  Seed: HAKERIRFV (GTF2I L424H)
HAKERIRFL

SEQ ID NO: 100 - protein, 9 aa, Artificial Sequence
  Description of Artificial Sequence: Synthetic peptide
  Seed: HAKERIRFV (GTF2I L424H)
HAKERIRFM

SEQ ID NO: 101 - protein, 9 aa, Artificial Sequence
  Description of Artificial Sequence: Synthetic peptide
  Seed: HAKERIRFV (GTF2I L424H)
HRKERIRFV

SEQ ID NO: 102 - protein, 10 aa, Artificial Sequence
  Description of Artificial Sequence: Synthetic peptide
  Seed: IPRLERILHA (GTF2I L424H)
IPRLERILHM

SEQ ID NO: 103 - protein, 9 aa, Artificial Sequence
  Description of Artificial Sequence: Synthetic peptide
  Seed: RLERILHAK (GTF2I L424H)
RMERILHAK

SEQ ID NO: 104 - protein, 9 aa, Artificial Sequence
  Description of Artificial Sequence: Synthetic peptide
  Seed: RILHAKERI (GTF2I L424H)
RMLHAKERW

SEQ ID NO: 105 - protein, 9 aa, Artificial Sequence
  Description of Artificial Sequence: Synthetic peptide
  Seed: RLERILHAK (GTF2I L424H)
RTERILHAK

SEQ ID NO: 106 - protein, 9 aa, Artificial Sequence
  Description of Artificial Sequence: Synthetic peptide
  Seed: RLERILHAK (GTF2I L424H)
RVERILHAK

SEQ ID NO: 107 - protein, 9 aa, Artificial Sequence
  Description of Artificial Sequence: Synthetic peptide
  Seed: HAKERIRFV (GTF2I L424H)
HPKERIRFL

SEQ ID NO: 108 - protein, 9 aa, Artificial Sequence
  Description of Artificial Sequence: Synthetic peptide
  Seed: HAKERIRFV (GTF2I L424H)
HQKERIRFL

SEQ ID NO: 109 - protein, 9 aa, Artificial Sequence
  Description of Artificial Sequence: Synthetic peptide
  Seed: HAKERIRFV (GTF2I L424H)
HYKERIRFM

SEQ ID NO: 110 - protein, 9 aa, Artificial Sequence
  Description of Artificial Sequence: Synthetic peptide
  Seed: RILHAKERI (GTF2I L424H)
RQLHAKERV

SEQ ID NO: 111 - protein, 9 aa, Artificial Sequence
  Description of Artificial Sequence: Synthetic peptide
  Seed: RLERILHAK (GTF2I L424H)
RTERILHAR

SEQ ID NO: 112 - protein, 9 aa, Artificial Sequence
  Description of Artificial Sequence: Synthetic peptide
  Seed: RILHAKERI (GTF2I L424H)
RTLHAKERY

SEQ ID NO: 113 - protein, 11 aa, Artificial Sequence
  Description of Artificial Sequence: Synthetic peptide
  Seed: RILHAKERIRF (GTF2I L424H)
RVLHAKERIRY

SEQ ID NO: 114 - protein, 9 aa, Artificial Sequence
  Description of Artificial Sequence: Synthetic peptide
  Seed: HAKERIRFV (GTF2I L424H)
HRKERIRFM

SEQ ID NO: 115 - protein, 10 aa, Artificial Sequence
  Description of Artificial Sequence: Synthetic peptide
  Seed: IPRLERILHA (GTF2I L424H)
IPRLERILHL

SEQ ID NO: 116 - protein, 9 aa, Artificial Sequence
  Description of Artificial Sequence: Synthetic peptide
  Seed: HAKERIRFV (GTF2I L424H)
HFKERIRFL

SEQ ID NO: 117 - protein, 9 aa, Artificial Sequence
  Description of Artificial Sequence: Synthetic peptide
  Seed: RILHAKERI (GTF2I L424H)
RMLHAKERL

SEQ ID NO: 118 - protein, 9 aa, Artificial Sequence
  Description of Artificial Sequence: Synthetic peptide
  Seed: RILHAKERI (GTF2I L424H)
RQLHAKERL

SEQ ID NO: 119 - protein, 10 aa, Artificial Sequence
  Description of Artificial Sequence: Synthetic peptide
  Seed: KPIIIGCHAY (IDH1 R132C)
KMIIIGCHAY

SEQ ID NO: 120 - protein, 9 aa, Artificial Sequence
  Description of Artificial Sequence: Synthetic peptide
  Seed: KPIIIGCHA (IDH1 R132C)
KPIIIGCHL

SEQ ID NO: 121 - protein, 10 aa, Artificial Sequence
  Description of Artificial Sequence: Synthetic peptide
  Seed: KPIIIGCHAY (IDH1 R132C)
KPIIIGCHAA

SEQ ID NO: 122 - protein, 10 aa, Artificial Sequence
  Description of Artificial Sequence: Synthetic peptide
  Seed: KPIIIGCHAY (IDH1 R132C)
KPIIIGCHAL

SEQ ID NO: 123 - protein, 10 aa, Artificial Sequence
  Description of Artificial Sequence: Synthetic peptide
  Seed: KPIIIGCHAY (IDH1 R132C)
KPIIIGCHAM

SEQ ID NO: 124 - protein, 10 aa, Artificial Sequence
  Description of Artificial Sequence: Synthetic peptide
  Seed: KPIIIGCHAY (IDH1 R132C)
KQIIIGCHAY

SEQ ID NO: 125 - protein, 10 aa, Artificial Sequence
  Description of Artificial Sequence: Synthetic peptide
  Seed: IGHHAYGDQY (IDH1 R132H)
IMHHAYGDQY

SEQ ID NO: 126 - protein, 11 aa, Artificial Sequence
  Description of Artificial Sequence: Synthetic peptide
  Seed: IGHHAYGDQYR (IDH1 R132H)
IMHHAYGDQYR

SEQ ID NO: 127 - protein, 10 aa, Artificial Sequence
  Description of Artificial Sequence: Synthetic peptide
  Seed: KPIIIGHHAY (IDH1 R132H)
KMIIIGHHAY

SEQ ID NO: 128 - protein, 9 aa, Artificial Sequence
  Description of Artificial Sequence: Synthetic peptide
  Seed: KPIIIGHHA (IDH1 R132H)
KPIIIGHHM

SEQ ID NO: 129 - protein, 10 aa, Artificial Sequence
  Description of Artificial Sequence: Synthetic peptide
  Seed: VKPIIIGHHA (IDH1 R132H)
VMPIIIGHHA

SEQ ID NO: 130 - protein, 10 aa, Artificial Sequence
  Description of Artificial Sequence: Synthetic peptide
  Seed: KPIIIGHHAY (IDH1 R132H)
KQIIIGHHAM

SEQ ID NO: 131 - protein, 8 aa, Artificial Sequence
  Description of Artificial Sequence: Synthetic peptide
  Seed: HHAYGDQY (IDH1 R132H)
HHAYGDQL

SEQ ID NO: 132 - protein, 9 aa, Artificial Sequence
  Description of Artificial Sequence: Synthetic peptide
  Seed: HHAYGDQYR (IDH1 R132H)
HYAYGDQYR

SEQ ID NO: 133 - protein, 8 aa, Artificial Sequence
  Description of Artificial Sequence: Synthetic peptide
  Seed: IIIGHHAY (IDH1 R132H)
IAIGHHAL

SEQ ID NO: 134 - protein, 8 aa, Artificial Sequence
  Description of Artificial Sequence: Synthetic peptide
  Seed: IIIGHHAY (IDH1 R132H)
IQIGHHAY

SEQ ID NO: 135 - protein, 9 aa, Artificial Sequence
  Description of Artificial Sequence: Synthetic peptide
  Seed: KPIIIGHHA (IDH1 R132H)
KHIIIGHHA

SEQ ID NO: 136 - protein, 9 aa, Artificial Sequence
  Description of Artificial Sequence: Synthetic peptide
  Seed: KPIIIGHHA (IDH1 R132H)
KPIIIGHHL

SEQ ID NO: 137 - protein, 9 aa, Artificial Sequence
  Description of Artificial Sequence: Synthetic peptide
  Seed: PIIIGHHAY (IDH1 R132H)
PPIIGHHAY

SEQ ID NO: 138 - protein, 8 aa, Artificial Sequence
  Description of Artificial Sequence: Synthetic peptide
  Seed: HHAYGDQY (IDH1 R132H)
HHAYGDQF

SEQ ID NO: 139 - protein, 9 aa, Artificial Sequence
  Description of Artificial Sequence: Synthetic peptide
  Seed: HHAYGDQYR (IDH1 R132H)
HTAYGDQYR

SEQ ID NO: 140 - protein, 9 aa, Artificial Sequence
  Description of Artificial Sequence: Synthetic peptide
  Seed: PIIIGHHAY (IDH1 R132H)
PAIIGHHAY

SEQ ID NO: 141 - protein, 9 aa, Artificial Sequence
  Description of Artificial Sequence: Synthetic peptide
  Seed: LVVVGAAGV (KRAS G12A)
LMVVGAAGV

SEQ ID NO: 142 - protein, 9 aa, Artificial Sequence
  Description of Artificial Sequence: Synthetic peptide
  Seed: LVVVGAAGV (KRAS G12A)
LQVVGAAGV

SEQ ID NO: 143 - protein, 9 aa, Artificial Sequence
  Description of Artificial Sequence: Synthetic peptide
  Seed: LVVVGAAGV (KRAS G12A)
LTVVGAAGV

SEQ ID NO: 144 - protein, 10 aa, Artificial Sequence
  Description of Artificial Sequence: Synthetic peptide
  Seed: VVVGAAGVGK (KRAS G12A)
VTVGAAGVGR

SEQ ID NO: 145 - protein, 9 aa, Artificial Sequence
  Description of Artificial Sequence: Synthetic peptide
  Seed: GAAGVGKSA (KRAS G12A)
GAAGVGKSL

SEQ ID NO: 146 - protein, 9 aa, Artificial Sequence
  Description of Artificial Sequence: Synthetic peptide
  Seed: GAAGVGKSA (KRAS G12A)
GAAGVGKSM

SEQ ID NO: 147 - protein, 9 aa, Artificial Sequence
  Description of Artificial Sequence: Synthetic peptide
  Seed: GAAGVGKSA (KRAS G12A)
GPAGVGKSA

SEQ ID NO: 148 - protein, 10 aa, Artificial Sequence
  Description of Artificial Sequence: Synthetic peptide
  Seed: GAAGVGKSAL (KRAS G12A)
GPAGVGKSAL

SEQ ID NO: 149 - protein, 10 aa, Artificial Sequence
  Description of Artificial Sequence: Synthetic peptide
  Seed: VVVGAAGVGK (KRAS G12A)
VTVGAAGVGK

SEQ ID NO: 150 - protein, 10 aa, Artificial Sequence
  Description of Artificial Sequence: Synthetic peptide
  Seed: VVVGAAGVGK (KRAS G12A)
VVVGAAGVGR

SEQ ID NO: 151 - protein, 9 aa, Artificial Sequence
  Description of Artificial Sequence: Synthetic peptide
  Seed: LVVVGAAGV (KRAS G12A)
LLVVGAAGV

SEQ ID NO: 152 - protein, 9 aa, Artificial Sequence
  Description of Artificial Sequence: Synthetic peptide
  Seed: GAAGVGKSA (KRAS G12A)
GPAGVGKSV

SEQ ID NO: 153 - protein, 10 aa, Artificial Sequence
  Description of Artificial Sequence: Synthetic peptide
  Seed: VVVGAAGVGK (KRAS G12A)
VMVGAAGVGK

SEQ ID NO: 154 - protein, 9 aa, Artificial Sequence
  Description of Artificial Sequence: Synthetic peptide
  Seed: LVVVGACGV (KRAS G12C)
LMVVGACGV

SEQ ID NO: 155 - protein, 9 aa, Artificial Sequence
  Description of Artificial Sequence: Synthetic peptide
  Seed: LVVVGACGV (KRAS G12C)
LQVVGACGV

SEQ ID NO: 156 - protein, 9 aa, Artificial Sequence
  Description of Artificial Sequence: Synthetic peptide
  Seed: LVVVGACGV (KRAS G12C)
LTVVGACGV

SEQ ID NO: 157 - protein, 9 aa, Artificial Sequence
  Description of Artificial Sequence: Synthetic peptide
  Seed: VVGACGVGK (KRAS G12C)
VMGACGVGR

SEQ ID NO: 158 - protein, 10 aa, Artificial Sequence
  Description of Artificial Sequence: Synthetic peptide
  Seed: VVVGACGVGK (KRAS G12C)
VVVGACGVGR

SEQ ID NO: 159 - protein, 9 aa, Artificial Sequence
  Description of Artificial Sequence: Synthetic peptide
  Seed: VVGACGVGK (KRAS G12C)
VMGACGVGK

SEQ ID NO: 160 - protein, 9 aa, Artificial Sequence
  Description of Artificial Sequence: Synthetic peptide
  Seed: GACGVGKSA (KRAS G12C)
GACGVGKSL

SEQ ID NO: 161 - protein, 9 aa, Artificial Sequence
  Description of Artificial Sequence: Synthetic peptide
  Seed: GACGVGKSA (KRAS G12C)
GPCGVGKSA

SEQ ID NO: 162 - protein, 10 aa, Artificial Sequence
  Description of Artificial Sequence: Synthetic peptide
  Seed: GACGVGKSAL (KRAS G12C)
GPCGVGKSAM

SEQ ID NO: 163 - protein, 10 aa, Artificial Sequence
  Description of Artificial Sequence: Synthetic peptide
  Seed: VVVGACGVGK (KRAS G12C)
VMVGACGVGK

SEQ ID NO: 164 - protein, 10 aa, Artificial Sequence
  Description of Artificial Sequence: Synthetic peptide
  Seed: VVVGACGVGK (KRAS G12C)
VTVGACGVGR

SEQ ID NO: 165 - protein, 10 aa, Artificial Sequence
  Description of Artificial Sequence: Synthetic peptide
  Seed: GACGVGKSAL (KRAS G12C)
GPCGVGKSAL

SEQ ID NO: 166 - protein, 10 aa, Artificial Sequence
  Description of Artificial Sequence: Synthetic peptide
  Seed: VVVGACGVGK (KRAS G12C)
VTVGACGVGK

SEQ ID NO: 167 - protein, 9 aa, Artificial Sequence
  Description of Artificial Sequence: Synthetic peptide
  Seed: LVVVGADGV (KRAS G12D)
LLVVGADGV

SEQ ID NO: 168 - protein, 9 aa, Artificial Sequence
  Description of Artificial Sequence: Synthetic peptide
  Seed: LVVVGADGV (KRAS G12D)
LMVVGADGV

SEQ ID NO: 169 - protein, 9 aa, Artificial Sequence
  Description of Artificial Sequence: Synthetic peptide
  Seed: LVVVGADGV (KRAS G12D)
LTVVGADGV

SEQ ID NO: 170 - protein, 10 aa, Artificial Sequence
  Description of Artificial Sequence: Synthetic peptide
  Seed: VVVGADGVGK (KRAS G12D)
VTVGADGVGR

SEQ ID NO: 171 - protein, 10 aa, Artificial Sequence
  Description of Artificial Sequence: Synthetic peptide
  Seed: VVVGADGVGK (KRAS G12D)
VVVGADGVGR

SEQ ID NO: 172 - protein, 9 aa, Artificial Sequence
  Description of Artificial Sequence: Synthetic peptide
  Seed: GADGVGKSA (KRAS G12D)
GFDGVGKSL

SEQ ID NO: 173 - protein, 11 aa, Artificial Sequence
  Description of Artificial Sequence: Synthetic peptide
  Seed: VGADGVGKSAL (KRAS G12D)
VAADGVGKSAF

SEQ ID NO: 174 - protein, 11 aa, Artificial Sequence
  Description of Artificial Sequence: Synthetic peptide
  Seed: VGADGVGKSAL (KRAS G12D)
VAADGVGKSAL

SEQ ID NO: 175 - protein, 11 aa, Artificial Sequence
  Description of Artificial Sequence: Synthetic peptide
  Seed: VGADGVGKSAL (KRAS G12D)
VRADGVGKSAF

SEQ ID NO: 176 - protein, 11 aa, Artificial Sequence
  Description of Artificial Sequence: Synthetic peptide
  Seed: VGADGVGKSAL (KRAS G12D)
VTADGVGKSAF

SEQ ID NO: 177 - protein, 11 aa, Artificial Sequence
  Description of Artificial Sequence: Synthetic peptide
  Seed: VGADGVGKSAL (KRAS G12D)
VSADGVGKSAF

SEQ ID NO: 178 - protein, 10 aa, Artificial Sequence
  Description of Artificial Sequence: Synthetic peptide
  Seed: VVVGADGVGK (KRAS G12D)
VTVGADGVGK

SEQ ID NO: 179 - protein, 10 aa, Artificial Sequence
  Description of Artificial Sequence: Synthetic peptide
  Seed: GARGVGKSAL (KRAS G12R)
GPRGVGKSAV

SEQ ID NO: 180 - protein, 9 aa, Artificial Sequence
  Description of Artificial Sequence: Synthetic peptide
  Seed: LVVVGARGV (KRAS G12R)
LLVVGARGV

SEQ ID NO: 181 - protein, 9 aa, Artificial Sequence
  Description of Artificial Sequence: Synthetic peptide
  Seed: LVVVGARGV (KRAS G12R)
LMVVGARGV

SEQ ID NO: 182 - protein, 9 aa, Artificial Sequence
  Description of Artificial Sequence: Synthetic peptide
  Seed: VVGARGVGK (KRAS G12R)
VMGARGVGK

SEQ ID NO: 183 - protein, 10 aa, Artificial Sequence
  Description of Artificial Sequence: Synthetic peptide
  Seed: VVVGARGVGK (KRAS G12R)
VVVGARGVGR

SEQ ID NO: 184 - protein, 9 aa, Artificial Sequence
  Description of Artificial Sequence: Synthetic peptide
  Seed: GARGVGKSA (KRAS G12R)
GARGVGKSY

SEQ ID NO: 185 - protein, 9 aa, Artificial Sequence
  Description of Artificial Sequence: Synthetic peptide
  Seed: GARGVGKSA (KRAS G12R)
GPRGVGKSA

SEQ ID NO: 186 - protein, 10 aa, Artificial Sequence
  Description of Artificial Sequence: Synthetic peptide
  Seed: GARGVGKSAL (KRAS G12R)
GPRGVGKSAL

SEQ ID NO: 187 - protein, 9 aa, Artificial Sequence
  Description of Artificial Sequence: Synthetic peptide
  Seed: VVGARGVGK (KRAS G12R)
VAGARGVGM

SEQ ID NO: 188 - protein, 10 aa, Artificial Sequence
  Description of Artificial Sequence: Synthetic peptide
  Seed: VVVGARGVGK (KRAS G12R)
VMVGARGVGK

SEQ ID NO: 189 - protein, 10 aa, Artificial Sequence
  Description of Artificial Sequence: Synthetic peptide
  Seed: VVVGARGVGK (KRAS G12R)
VTVGARGVGR

SEQ ID NO: 190 - protein, 9 aa, Artificial Sequence
  Description of Artificial Sequence: Synthetic peptide
  Seed: VVGARGVGK (KRAS G12R)
VAGARGVGL

SEQ ID NO: 191 - protein, 10 aa, Artificial Sequence
  Description of Artificial Sequence: Synthetic peptide
  Seed: VVVGARGVGK (KRAS G12R)
VTVGARGVGK

SEQ ID NO: 192 - protein, 9 aa, Artificial Sequence
  Description of Artificial Sequence: Synthetic peptide
  Seed: LVVVGASGV (KRAS G12S)
LMVVGASGV

SEQ ID NO: 193 - protein, 9 aa, Artificial Sequence
  Description of Artificial Sequence: Synthetic peptide
  Seed: LVVVGASGV (KRAS G12S)
LQVVGASGV

SEQ ID NO: 194 - protein, 9 aa, Artificial Sequence
  Description of Artificial Sequence: Synthetic peptide
  Seed: LVVVGASGV (KRAS G12S)
LTVVGASGV

SEQ ID NO: 195 - protein, 10 aa, Artificial Sequence
  Description of Artificial Sequence: Synthetic peptide
  Seed: VVVGASGVGK (KRAS G12S)
VTVGASGVGK

SEQ ID NO: 196 - protein, 10 aa, Artificial Sequence
  Description of Artificial Sequence: Synthetic peptide
  Seed: VVVGASGVGK (KRAS G12S)
VVVGASGVGR

SEQ ID NO: 197 - protein, 9 aa, Artificial Sequence
  Description of Artificial Sequence: Synthetic peptide
  Seed: GASGVGKSA (KRAS G12S)
GASGVGKSL

SEQ ID NO: 198 - protein, 10 aa, Artificial Sequence
  Description of Artificial Sequence: Synthetic peptide
  Seed: GASGVGKSAL (KRAS G12S)
GPSGVGKSAM

SEQ ID NO: 199 - protein, 10 aa, Artificial Sequence
  Description of Artificial Sequence: Synthetic peptide
  Seed: VVVGASGVGK (KRAS G12S)
VAVGASGVGY

SEQ ID NO: 200 - protein, 10 aa, Artificial Sequence
  Description of Artificial Sequence: Synthetic peptide
  Seed: VVVGASGVGK (KRAS G12S)
VTVGASGVGR

SEQ ID NO: 201 - protein, 10 aa, Artificial Sequence
  Description of Artificial Sequence: Synthetic peptide
  Seed: VVVGASGVGK (KRAS G12S)
VTVGASGVGY

SEQ ID NO: 202 - protein, 10 aa, Artificial Sequence
  Description of Artificial Sequence: Synthetic peptide
  Seed: GASGVGKSAL (KRAS G12S)
GPSGVGKSAL

SEQ ID NO: 203 - protein, 9 aa, Artificial Sequence
  Description of Artificial Sequence: Synthetic peptide
  Seed: LVVVGAVGV (KRAS G12V)
LMVVGAVGV

SEQ ID NO: 204 - protein, 9 aa, Artificial Sequence
  Description of Artificial Sequence: Synthetic peptide
  Seed: LVVVGAVGV (KRAS G12V)
LTVVGAVGV

SEQ ID NO: 205 - protein, 9 aa, Artificial Sequence
  Description of Artificial Sequence: Synthetic peptide
  Seed: VVGAVGVGK (KRAS G12V)
VMGAVGVGK

SEQ ID NO: 206 - protein, 9 aa, Artificial Sequence
  Description of Artificial Sequence: Synthetic peptide
  Seed: VVGAVGVGK (KRAS G12V)
VMGAVGVGR

SEQ ID NO: 207 - protein, 10 aa, Artificial Sequence
  Description of Artificial Sequence: Synthetic peptide
  Seed: VVVGAVGVGK (KRAS G12V)
VTVGAVGVGK

SEQ ID NO: 208 - protein, 9 aa, Artificial Sequence
  Description of Artificial Sequence: Synthetic peptide
  Seed: GAVGVGKSA (KRAS G12V)
GAVGVGKSL

SEQ ID NO: 209 - protein, 9 aa, Artificial Sequence
  Description of Artificial Sequence: Synthetic peptide
  Seed: GAVGVGKSA (KRAS G12V)
GPVGVGKSA

SEQ ID NO: 210 - protein, 10 aa, Artificial Sequence
  Description of Artificial Sequence: Synthetic peptide
  Seed: GAVGVGKSAL (KRAS G12V)
GPVGVGKSAL

SEQ ID NO: 211 - protein, 10 aa, Artificial Sequence
  Description of Artificial Sequence: Synthetic peptide
  Seed: VVVGAVGVGK (KRAS G12V)
VMVGAVGVGR

SEQ ID NO: 212 - protein, 10 aa, Artificial Sequence
  Description of Artificial Sequence: Synthetic peptide
  Seed: VVVGAVGVGK (KRAS G12V)
VVVGAVGVGR

SEQ ID NO: 213 - protein, 9 aa, Artificial Sequence
  Description of Artificial Sequence: Synthetic peptide
  Seed: GAVGVGKSA (KRAS G12V)
GPVGVGKSV

SEQ ID NO: 214 - protein, 9 aa, Artificial Sequence
  Description of Artificial Sequence: Synthetic peptide
  Seed: AGDVGKSAL (KRAS G13D)
ASDVGKSAL

SEQ ID NO: 215 - protein, 9 aa, Artificial Sequence
  Description of Artificial Sequence: Synthetic peptide
  Seed: AGDVGKSAL (KRAS G13D)
ASDVGKSAM

SEQ ID NO: 216 - protein, 10 aa, Artificial Sequence
  Description of Artificial Sequence: Synthetic peptide
  Seed: KLVVVGAGDV (KRAS G13D)
KMVVVGAGDV

SEQ ID NO: 217 - protein, 10 aa, Artificial Sequence
  Description of Artificial Sequence: Synthetic peptide
  Seed: VVVGAGDVGK (KRAS G13D)
VVVGAGDVGR

SEQ ID NO: 218 - protein, 9 aa, Artificial Sequence
  Description of Artificial Sequence: Synthetic peptide
  Seed: AGDVGKSAL (KRAS G13D)
AADVGKSAM

SEQ ID NO: 219 - protein, 9 aa, Artificial Sequence
  Description of Artificial Sequence: Synthetic peptide
  Seed: AGDVGKSAL (KRAS G13D)
AYDVGKSAM

SEQ ID NO: 220 - protein, 9 aa, Artificial Sequence
  Description of Artificial Sequence: Synthetic peptide
  Seed: DVGKSALTI (KRAS G13D)
DAGKSALTV

SEQ ID NO: 221 - protein, 9 aa, Artificial Sequence
  Description of Artificial Sequence: Synthetic peptide
  Seed: DVGKSALTI (KRAS G13D)
DVGKSALTY

SEQ ID NO: 222 - protein, 9 aa, Artificial Sequence
  Description of Artificial Sequence: Synthetic peptide
  Seed: GAGDVGKSA (KRAS G13D)
GAGDVGKSM

SEQ ID NO: 223 - protein, 10 aa, Artificial Sequence
  Description of Artificial Sequence: Synthetic peptide
  Seed: VVVGAGDVGK (KRAS G13D)
VTVGAGDVGK

SEQ ID NO: 224 - protein, 11 aa, Artificial Sequence
  Description of Artificial Sequence: Synthetic peptide
  Seed: VGAGDVGKSAL (KRAS G13D)
VVAGDVGKSAW

SEQ ID NO: 225 - protein, 9 aa, Artificial Sequence
  Description of Artificial Sequence: Synthetic peptide
  Seed: AGDVGKSAL (KRAS G13D)
AADVGKSAL

SEQ ID NO: 226 - protein, 10 aa, Artificial Sequence
  Description of Artificial Sequence: Synthetic peptide
  Seed: VVVGAGDVGK (KRAS G13D)
VTVGAGDVGR

SEQ ID NO: 227 - protein, 9 aa, Artificial Sequence
  Description of Artificial Sequence: Synthetic peptide
  Seed: AGDVGKSAL (KRAS G13D)
AYDVGKSAL

SEQ ID NO: 228 - protein, 9 aa, Artificial Sequence
  Description of Artificial Sequence: Synthetic peptide
  Seed: DVGKSALTI (KRAS G13D)
DVGKSALTF

SEQ ID NO: 229 - protein, 11 aa, Artificial Sequence
  Description of Artificial Sequence: Synthetic peptide
  Seed: VGAGDVGKSAL (KRAS G13D)
VSAGDVGKSAF

SEQ ID NO: 230 - protein, 10 aa, Artificial Sequence
  Description of Artificial Sequence: Synthetic peptide
  Seed: AGKEEYSAMR (NRAS Q61K)
ATKEEYSAMR

SEQ ID NO: 231 - protein, 10 aa, Artificial Sequence
  Description of Artificial Sequence: Synthetic peptide
  Seed: ILDTAGKEEY (NRAS Q61K)
ITDTAGKEEY

SEQ ID NO: 232 - protein, 9 aa, Artificial Sequence
  Description of Artificial Sequence: Synthetic peptide
  Seed: AGKEEYSAM (NRAS Q61K)
AAKEEYSAL

SEQ ID NO: 233 - protein, 9 aa, Artificial Sequence
  Description of Artificial Sequence: Synthetic peptide
  Seed: AGKEEYSAM (NRAS Q61K)
AAKEEYSAY

SEQ ID NO: 234 - protein, 9 aa, Artificial Sequence
  Description of Artificial Sequence: Synthetic peptide
  Seed: AGKEEYSAM (NRAS Q61K)
ARKEEYSAY

SEQ ID NO: 235 - protein, 10 aa, Artificial Sequence
  Description of Artificial Sequence: Synthetic peptide
  Seed: ILDTAGKEEY (NRAS Q61K)
ILDTAGKEEL

SEQ ID NO: 236 - protein, 10 aa, Artificial Sequence
  Description of Artificial Sequence: Synthetic peptide
  Seed: ILDTAGKEEY (NRAS Q61K)
IMDTAGKEEL

SEQ ID NO: 237 - protein, 9 aa, Artificial Sequence
  Description of Artificial Sequence: Synthetic peptide
  Seed: LDTAGKEEY (NRAS Q61K)
LETAGKEEM

SEQ ID NO: 238 - protein, 9 aa, Artificial Sequence
  Description of Artificial Sequence: Synthetic peptide
  Seed: LDTAGKEEY (NRAS Q61K)
LETAGKEEW

SEQ ID NO: 239 - protein, 9 aa, Artificial Sequence
  Description of Artificial Sequence: Synthetic peptide
  Seed: AGLEEYSAM (NRAS Q61L)
ATLEEYSAF

SEQ ID NO: 240 - protein, 10 aa, Artificial Sequence
  Description of Artificial Sequence: Synthetic peptide
  Seed: DTAGLEEYSA (NRAS Q61L)
DTAGLEEYSV

SEQ ID NO: 241 - protein, 10 aa, Artificial Sequence
  Description of Artificial Sequence: Synthetic peptide
  Seed: DTAGLEEYSA (NRAS Q61L)
DVAGLEEYSV

SEQ ID NO: 242 - protein, 10 aa, Artificial Sequence
  Description of Artificial Sequence: Synthetic peptide
  Seed: ILDTAGLEEY (NRAS Q61L)
ISDTAGLEEY

SEQ ID NO: 243 - protein, 10 aa, Artificial Sequence
  Description of Artificial Sequence: Synthetic peptide
  Seed: ILDTAGLEEY (NRAS Q61L)
ITDTAGLEEY

SEQ ID NO: 244 - protein, 9 aa, Artificial Sequence
  Description of Artificial Sequence: Synthetic peptide
  Seed: AGLEEYSAM (NRAS Q61L)
AALEEYSAL

SEQ ID NO: 245 - protein, 11 aa, Artificial Sequence
  Description of Artificial Sequence: Synthetic peptide
  Seed: DILDTAGLEEY (NRAS Q61L)
DVLDTAGLEER

SEQ ID NO: 246 - protein, 11 aa, Artificial Sequence
  Description of Artificial Sequence: Synthetic peptide
  Seed: DILDTAGLEEY (NRAS Q61L)
DVLDTAGLEEY

SEQ ID NO: 247 - protein, 10 aa, Artificial Sequence
  Description of Artificial Sequence: Synthetic peptide
  Seed: ILDTAGLEEY (NRAS Q61L)
IMDTAGLEEM

SEQ ID NO: 248 - protein, 10 aa, Artificial Sequence
  Description of Artificial Sequence: Synthetic peptide
  Seed: ILDTAGLEEY (NRAS Q61L)
IVDTAGLEEY

SEQ ID NO: 249 - protein, 9 aa, Artificial Sequence
  Description of Artificial Sequence: Synthetic peptide
  Seed: LDTAGLEEY (NRAS Q61L)
LETAGLEEM

SEQ ID NO: 250 - protein, 9 aa, Artificial Sequence
  Description of Artificial Sequence: Synthetic peptide
  Seed: LDTAGLEEY (NRAS Q61L)
LMTAGLEEY

SEQ ID NO: 251 - protein, 9 aa, Artificial Sequence
  Description of Artificial Sequence: Synthetic peptide
  Seed: AGLEEYSAM (NRAS Q61L)
AQLEEYSAF

SEQ ID NO: 252 - protein, 11 aa, Artificial Sequence
  Description of Artificial Sequence: Synthetic peptide
  Seed: DILDTAGLEEY (NRAS Q61L)
DTLDTAGLEEY

SEQ ID NO: 253 - protein, 11 aa, Artificial Sequence
  Description of Artificial Sequence: Synthetic peptide
  Seed: DILDTAGLEEY (NRAS Q61L)
DVLDTAGLEEK

SEQ ID NO: 254 - protein, 10 aa, Artificial Sequence
  Description of Artificial Sequence: Synthetic peptide
  Seed: ILDTAGLEEY (NRAS Q61L)
IMDTAGLEEY

SEQ ID NO: 255 - protein, 9 aa, Artificial Sequence
  Description of Artificial Sequence: Synthetic peptide
  Seed: LDTAGLEEY (NRAS Q61L)
LETAGLEEF

SEQ ID NO: 256 - protein, 9 aa, Artificial Sequence
  Description of Artificial Sequence: Synthetic peptide
  Seed: AGREEYSAM (NRAS Q61R)
ASREEYSAF

SEQ ID NO: 257 - protein, 10 aa, Artificial Sequence
  Description of Artificial Sequence: Synthetic peptide
  Seed: AGREEYSAMR (NRAS Q61R)
ATREEYSAMR

SEQ ID NO: 258 - protein, 9 aa, Artificial Sequence
  Description of Artificial Sequence: Synthetic peptide
  Seed: AGREEYSAM (NRAS Q61R)
AVREEYSAF

SEQ ID NO: 259 - protein, 10 aa, Artificial Sequence
  Description of Artificial Sequence: Synthetic peptide
  Seed: ILDTAGREEY (NRAS Q61R)
ISDTAGREEY

SEQ ID NO: 260 - protein, 10 aa, Artificial Sequence
  Description of Artificial Sequence: Synthetic peptide
  Seed: ILDTAGREEY (NRAS Q61R)
ITDTAGREEY

SEQ ID NO: 261 - protein, 9 aa, Artificial Sequence
  Description of Artificial Sequence: Synthetic peptide
  Seed: AGREEYSAM (NRAS Q61R)
AVREEYSAY

SEQ ID NO: 262 - protein, 10 aa, Artificial Sequence
  Description of Artificial Sequence: Synthetic peptide
  Seed: AGREEYSAMR (NRAS Q61R)
AYREEYSAMR

SEQ ID NO: 263 - protein, 9 aa, Artificial Sequence
  Description of Artificial Sequence: Synthetic peptide
  Seed: AGREEYSAM (NRAS Q61R)
AAREEYSAL

SEQ ID NO: 264 - protein, 9 aa, Artificial Sequence
  Description of Artificial Sequence: Synthetic peptide
  Seed: AGREEYSAM (NRAS Q61R)
AAREEYSAY

SEQ ID NO: 265 - protein, 9 aa, Artificial Sequence
  Description of Artificial Sequence: Synthetic peptide
  Seed: AGREEYSAM (NRAS Q61R)
ARREEYSAL

SEQ ID NO: 266 - protein, 11 aa, Artificial Sequence
  Description of Artificial Sequence: Synthetic peptide
  Seed: DILDTAGREEY (NRAS Q61R)
DVLDTAGREEW

SEQ ID NO: 267 - protein, 10 aa, Artificial Sequence
  Description of Artificial Sequence: Synthetic peptide
  Seed: ILDTAGREEY (NRAS Q61R)
IMDTAGREEL

SEQ ID NO: 268 - protein, 9 aa, Artificial Sequence
  Description of Artificial Sequence: Synthetic peptide
  Seed: LDTAGREEY (NRAS Q61R)
LETAGREEM

SEQ ID NO: 269 - protein, 11 aa, Artificial Sequence
  Description of Artificial Sequence: Synthetic peptide
  Seed: REEYSAMRDQY (NRAS Q61R)
REEYSAMRDQW

SEQ ID NO: 270 - protein, 10 aa, Artificial Sequence
  Description of Artificial Sequence: Synthetic peptide
  Seed: AGREEYSAMR (NRAS Q61R)
AMREEYSAMR

SEQ ID NO: 271 - protein, 9 aa, Artificial Sequence
  Description of Artificial Sequence: Synthetic peptide
  Seed: AGREEYSAM (NRAS Q61R)
AQREEYSAF

SEQ ID NO: 272 - protein, 9 aa, Artificial Sequence
  Description of Artificial Sequence: Synthetic peptide
  Seed: AGREEYSAM (NRAS Q61R)
ARREEYSAF

SEQ ID NO: 273 - protein, 11 aa, Artificial Sequence
  Description of Artificial Sequence: Synthetic peptide
  Seed: KITEQEKDFLW (PIK3CA E542K)
KSTEQEKDFLW

SEQ ID NO: 274 - protein, 11 aa, Artificial Sequence
  Description of Artificial Sequence: Synthetic peptide
  Seed: KITEQEKDFLW (PIK3CA E542K)
KTTEQEKDFLW

SEQ ID NO: 275 - protein, 9 aa, Artificial Sequence
  Description of Artificial Sequence: Synthetic peptide
  Seed: STRDPLSKI (PIK3CA E542K)
SARDPLSKF

SEQ ID NO: 276 - protein, 9 aa, Artificial Sequence
  Description of Artificial Sequence: Synthetic peptide
  Seed: STRDPLSKI (PIK3CA E542K)
STRDPLSKV

SEQ ID NO: 277 - protein, 9 aa, Artificial Sequence
  Description of Artificial Sequence: Synthetic peptide
  Seed: STRDPLSKI (PIK3CA E542K)
SVRDPLSKK

SEQ ID NO: 278 - protein, 9 aa, Artificial Sequence
  Description of Artificial Sequence: Synthetic peptide
  Seed: STRDPLSKI (PIK3CA E542K)
SARDPLSKL

SEQ ID NO: 279 - protein, 9 aa, Artificial Sequence
  Description of Artificial Sequence: Synthetic peptide
  Seed: STRDPLSKI (PIK3CA E542K)
SSRDPLSKL

SEQ ID NO: 280 - protein, 9 aa, Artificial Sequence
  Description of Artificial Sequence: Synthetic peptide
  Seed: STRDPLSKI (PIK3CA E542K)
SSRDPLSKY

SEQ ID NO: 281 - protein, 9 aa, Artificial Sequence
  Description of Artificial Sequence: Synthetic peptide
  Seed: STRDPLSKI (PIK3CA E542K)
STRDPLSKR

SEQ ID NO: 282 - protein, 9 aa, Artificial Sequence
  Description of Artificial Sequence: Synthetic peptide
  Seed: STRDPLSKI (PIK3CA E542K)
STRDPLSKW

SEQ ID NO: 283 - protein, 9 aa, Artificial Sequence
  Description of Artificial Sequence: Synthetic peptide
  Seed: STRDPLSKI (PIK3CA E542K)
SVRDPLSKV

SEQ ID NO: 284 - protein, 8 aa, Artificial Sequence
  Description of Artificial Sequence: Synthetic peptide
  Seed: TRDPLSKI (PIK3CA E542K)
TYDPLSKL

SEQ ID NO: 285 - protein, 10 aa, Artificial Sequence
  Description of Artificial Sequence: Synthetic peptide
  Seed: STRDPLSKIT (PIK3CA E542K)
STRDPLSKIK

SEQ ID NO: 286 - protein, 10 aa, Artificial Sequence
  Description of Artificial Sequence: Synthetic peptide
  Seed: ITKQEKDFLW (PIK3CA E545K)
IAKQEKDFLW

SEQ ID NO: 287 - protein, 10 aa, Artificial Sequence
  Description of Artificial Sequence: Synthetic peptide
  Seed: ITKQEKDFLW (PIK3CA E545K)
ISKQEKDFLW

SEQ ID NO: 288 - protein, 10 aa, Artificial Sequence
  Description of Artificial Sequence: Synthetic peptide
  Seed: SEITKQEKDF (PIK3CA E545K)
SEITKQEKDW

SEQ ID NO: 289 - protein, 9 aa, Artificial Sequence
  Description of Artificial Sequence: Synthetic peptide
  Seed: LSEITKQEK (PIK3CA E545K)
LSEITKQEY

SEQ ID NO: 290 - protein, 9 aa, Artificial Sequence
  Description of Artificial Sequence: Synthetic peptide
  Seed: LSEITKQEK (PIK3CA E545K)
LTEITKQEY

SEQ ID NO: 291 - protein, 11 aa, Artificial Sequence
  Description of Artificial Sequence: Synthetic peptide
  Seed: SEITKQEKDFL (PIK3CA E545K)
SEITKQEKDFW

SEQ ID NO: 292 - protein, 9 aa, Artificial Sequence
  Description of Artificial Sequence: Synthetic peptide
  Seed: SEITKQEKD (PIK3CA E545K)
SEITKQEKV

SEQ ID NO: 293 - protein, 9 aa, Artificial Sequence
  Description of Artificial Sequence: Synthetic peptide
  Seed: SEITKQEKD (PIK3CA E545K)
SEITKQEKA

SEQ ID NO: 294 - protein, 10 aa, Artificial Sequence
  Description of Artificial Sequence: Synthetic peptide
  Seed: DARHGGWTTK (PIK3CA H1047R)
DTRHGGWTTR

SEQ ID NO: 295 - protein, 9 aa, Artificial Sequence
  Description of Artificial Sequence: Synthetic peptide
  Seed: KQMNDARHG (PIK3CA H1047R)
KRMNDARHF

SEQ ID NO: 296 - protein, 9 aa, Artificial Sequence
  Description of Artificial Sequence: Synthetic peptide
  Seed: KQMNDARHG (PIK3CA H1047R)
KVMNDARHY

SEQ ID NO: 297 - protein, 9 aa, Artificial Sequence
  Description of Artificial Sequence: Synthetic peptide
  Seed: RHGGWTTKM (PIK3CA H1047R)
RMGGWTTKY

SEQ ID NO: 298 - protein, 9 aa, Artificial Sequence
  Description of Artificial Sequence: Synthetic peptide
  Seed: RHGGWTTKM (PIK3CA H1047R)
RQGGWTTKM

SEQ ID NO: 299 - protein, 10 aa, Artificial Sequence
  Description of Artificial Sequence: Synthetic peptide
  Seed: DARHGGWTTK (PIK3CA H1047R)
DVRHGGWTTK

SEQ ID NO: 300 - protein, 10 aa, Artificial Sequence
  Description of Artificial Sequence: Synthetic peptide
  Seed: DARHGGWTTK (PIK3CA H1047R)
DVRHGGWTTR

SEQ ID NO: 301 - protein, 11 aa, Artificial Sequence
  Description of Artificial Sequence: Synthetic peptide
  Seed: KQMNDARHGGW (PIK3CA H1047R)
KEMNDARHGGW

SEQ ID NO: 302 - protein, 11 aa, Artificial Sequence
  Description of Artificial Sequence: Synthetic peptide
  Seed: KQMNDARHGGW (PIK3CA H1047R)
KQMNDARHGGF

SEQ ID NO: 303 - protein, 11 aa, Artificial Sequence
  Description of Artificial Sequence: Synthetic peptide
  Seed: KQMNDARHGGW (PIK3CA H1047R)
KQMNDARHGGY

SEQ ID NO: 304 - protein, 11 aa, Artificial Sequence
  Description of Artificial Sequence: Synthetic peptide
  Seed: KQMNDARHGGW (PIK3CA H1047R)
KTMNDARHGGW

SEQ ID NO: 305 - protein, 9 aa, Artificial Sequence
  Description of Artificial Sequence: Synthetic peptide
  Seed: RHGGWTTKM (PIK3CA H1047R)
RRGGWTTKF

SEQ ID NO: 306 - protein, 9 aa, Artificial Sequence
  Description of Artificial Sequence: Synthetic peptide
  Seed: RHGGWTTKM (PIK3CA H1047R)
RRGGWTTKY

SEQ ID NO: 307 - protein, 9 aa, Artificial Sequence
  Description of Artificial Sequence: Synthetic peptide
  Seed: KQMNDARHG (PIK3CA H1047R)
KQMNDARHF

SEQ ID NO: 308 - protein, 11 aa, Artificial Sequence
  Description of Artificial Sequence: Synthetic peptide
  Seed: KQMNDARHGGW (PIK3CA H1047R)
KAMNDARHGGW

SEQ ID NO: 309 - protein, 9 aa, Artificial Sequence
  Description of Artificial Sequence: Synthetic peptide
  Seed: RHGGWTTKM (PIK3CA H1047R)
RRGGWTTKL

SEQ ID NO: 310 - protein, 9 aa, Artificial Sequence
  Description of Artificial Sequence: Synthetic peptide
  Seed: ETRQLCDLR (PIK3CA R88Q)
EMRQLCDLR

SEQ ID NO: 311 - protein, 9 aa, Artificial Sequence
  Description of Artificial Sequence: Synthetic peptide
  Seed: ETRQLCDLR (PIK3CA R88Q)
EVRQLCDLR

SEQ ID NO: 312 - protein, 8 aa, Artificial Sequence
  Description of Artificial Sequence: Synthetic peptide
  Seed: FFDETRQL (PIK3CA R88Q)
FYDETRQL

SEQ ID NO: 313 - protein, 8 aa, Artificial Sequence
  Description of Artificial Sequence: Synthetic peptide
  Seed: FFDETRQL (PIK3CA R88Q)
FYDETRQM

SEQ ID NO: 314 - protein, 9 aa, Artificial Sequence
  Description of Artificial Sequence: Synthetic peptide
  Seed: EFFDETRQL (PIK3CA R88Q)
EAFDETRQY

SEQ ID NO: 315 - protein, 9 aa, Artificial Sequence
  Description of Artificial Sequence: Synthetic peptide
  Seed: ETRQLCDLR (PIK3CA R88Q)
EIRQLCDLR

SEQ ID NO: 316 - protein, 8 aa, Artificial Sequence
  Description of Artificial Sequence: Synthetic peptide
  Seed: FFDETRQL (PIK3CA R88Q)
FADETRQL

SEQ ID NO: 317 - protein, 9 aa, Artificial Sequence
  Description of Artificial Sequence: Synthetic peptide
  Seed: FFDETRQLC (PIK3CA R88Q)
FFDETRQLL

SEQ ID NO: 318 - protein, 9 aa, Artificial Sequence
  Description of Artificial Sequence: Synthetic peptide
  Seed: FFDETRQLC (PIK3CA R88Q)
FFDETRQLM

SEQ ID NO: 319 - protein, 9 aa, Artificial Sequence
  Description of Artificial Sequence: Synthetic peptide
  Seed: FFDETRQLC (PIK3CA R88Q)
FYDETRQLM

SEQ ID NO: 320 - protein, 10 aa, Artificial Sequence
  Description of Artificial Sequence: Synthetic peptide
  Seed: DETRQLCDLR (PIK3CA R88Q)
DFTRQLCDLR

SEQ ID NO: 321 - protein, 9 aa, Artificial Sequence
  Description of Artificial Sequence: Synthetic peptide
  Seed: EFFDETRQL (PIK3CA R88Q)
EYFDETRQM

SEQ ID NO: 322 - protein, 9 aa, Artificial Sequence
  Description of Artificial Sequence: Synthetic peptide
  Seed: ETRQLCDLR (PIK3CA R88Q)
ESRQLCDLR

SEQ ID NO: 323 - protein, 10 aa, Artificial Sequence
  Description of Artificial Sequence: Synthetic peptide
  Seed: GTGVMICAYL (PTEN R130G)
GLGVMICAYV

SEQ ID NO: 324 - protein, 10 aa, Artificial Sequence
  Description of Artificial Sequence: Synthetic peptide
  Seed: GTGVMICAYL (PTEN R130G)
GMGVMICAYL

SEQ ID NO: 325 - protein, 10 aa, Artificial Sequence
  Description of Artificial Sequence: Synthetic peptide
  Seed: GTGVMICAYL (PTEN R130G)
GMGVMICAYV

SEQ ID NO: 326 - protein, 9 aa, Artificial Sequence
  Description of Artificial Sequence: Synthetic peptide
  Seed: GTGVMICAY (PTEN R130G)
GQGVMICAF

SEQ ID NO: 327 - protein, 9 aa, Artificial Sequence
  Description of Artificial Sequence: Synthetic peptide
  Seed: GTGVMICAY (PTEN R130G)
GQGVMICAY

SEQ ID NO: 328 - protein, 9 aa, Artificial Sequence
  Description of Artificial Sequence: Synthetic peptide
  Seed: AGKGGTGVM (PTEN R130G)
AAKGGTGVL

SEQ ID NO: 329 - protein, 9 aa, Artificial Sequence
  Description of Artificial Sequence: Synthetic peptide
  Seed: AGKGGTGVM (PTEN R130G)
AAKGGTGVY

SEQ ID NO: 330 - protein, 9 aa, Artificial Sequence
  Description of Artificial Sequence: Synthetic peptide
  Seed: AGKGGTGVM (PTEN R130G)
APKGGTGVM

SEQ ID NO: 331 - protein, 9 aa, Artificial Sequence
  Description of Artificial Sequence: Synthetic peptide
  Seed: AGKGGTGVM (PTEN R130G)
AYKGGTGVF

SEQ ID NO: 332 - protein, 9 aa, Artificial Sequence
  Description of Artificial Sequence: Synthetic peptide
  Seed: KAGKGGTGV (PTEN R130G)
KMGKGGTGV

SEQ ID NO: 333 - protein, 11 aa, Artificial Sequence
  Description of Artificial Sequence: Synthetic peptide
  Seed: KAGKGGTGVMI (PTEN R130G)
KSGKGGTGVMW

SEQ ID NO: 334 - protein, 11 aa, Artificial Sequence
  Description of Artificial Sequence: Synthetic peptide
  Seed: KAGKGGTGVMI (PTEN R130G)
KTGKGGTGVMW

SEQ ID NO: 335 - protein, 9 aa, Artificial Sequence
  Description of Artificial Sequence: Synthetic peptide
  Seed: AGKGGTGVM (PTEN R130G)
APKGGTGVL

SEQ ID NO: 336 - protein, 11 aa, Artificial Sequence
  Description of Artificial Sequence: Synthetic peptide
  Seed: KAGKGGTGVMI (PTEN R130G)
KAGKGGTGVMW

SEQ ID NO: 337 - protein, 9 aa, Artificial Sequence
  Description of Artificial Sequence: Synthetic peptide
  Seed: KAGKGGTGV (PTEN R130G)
KVGKGGTGV

SEQ ID NO: 338 - protein, 9 aa, Artificial Sequence
  Description of Artificial Sequence: Synthetic peptide
  Seed: QTGVMICAY (PTEN R130Q)
QQGVMICAF

SEQ ID NO: 339 - protein, 9 aa, Artificial Sequence
  Description of Artificial Sequence: Synthetic peptide
  Seed: QTGVMICAY (PTEN R130Q)
QQGVMICAY

SEQ ID NO: 340 - protein, 10 aa, Artificial Sequence
  Description of Artificial Sequence: Synthetic peptide
  Seed: QTGVMICAYL (PTEN R130Q)
QSGVMICAYV

SEQ ID NO: 341 - protein, 10 aa, Artificial Sequence
  Description of Artificial Sequence: Synthetic peptide
  Seed: QTGVMICAYL (PTEN R130Q)
QTGVMICAYI

SEQ ID NO: 342 - protein, 10 aa, Artificial Sequence
  Description of Artificial Sequence: Synthetic peptide
  Seed: QTGVMICAYL (PTEN R130Q)
QTGVMICAYV

SEQ ID NO: 343 - protein, 9 aa, Artificial Sequence
  Description of Artificial Sequence: Synthetic peptide
  Seed: AGKGQTGVM (PTEN R130Q)
AAKGQTGVF

SEQ ID NO: 344 - protein, 9 aa, Artificial Sequence
  Description of Artificial Sequence: Synthetic peptide
  Seed: AGKGQTGVM (PTEN R130Q)
AAKGQTGVL

SEQ ID NO: 345 - protein, 9 aa, Artificial Sequence
  Description of Artificial Sequence: Synthetic peptide
  Seed: AGKGQTGVM (PTEN R130Q)
AAKGQTGVY

SEQ ID NO: 346 - protein, 9 aa, Artificial Sequence
  Description of Artificial Sequence: Synthetic peptide
  Seed: AGKGQTGVM (PTEN R130Q)
AQKGQTGVY

SEQ ID NO: 347 - protein, 9 aa, Artificial Sequence
  Description of Artificial Sequence: Synthetic peptide
  Seed: KAGKGQTGV (PTEN R130Q)
KQGKGQTGV

SEQ ID NO: 348 - protein, 9 aa, Artificial Sequence
  Description of Artificial Sequence: Synthetic peptide
  Seed: KAGKGQTGV (PTEN R130Q)
KVGKGQTGV

SEQ ID NO: 349 - protein, 9 aa, Artificial Sequence
  Description of Artificial Sequence: Synthetic peptide
  Seed: QTGVMICAY (PTEN R130Q)
QVGVMICAK

SEQ ID NO: 350 - protein, 9 aa, Artificial Sequence
  Description of Artificial Sequence: Synthetic peptide
  Seed: QTGVMICAY (PTEN R130Q)
QVGVMICAR

SEQ ID NO: 351 - protein, 9 aa, Artificial Sequence
  Description of Artificial Sequence: Synthetic peptide
  Seed: QTGVMICAY (PTEN R130Q)
QMGVMICAY

SEQ ID NO: 352 - protein, 9 aa, Artificial Sequence
  Description of Artificial Sequence: Synthetic peptide
  Seed: QTGVMICAY (PTEN R130Q)
QTGVMICAK

SEQ ID NO: 353 - protein, 9 aa, Artificial Sequence
  Description of Artificial Sequence: Synthetic peptide
  Seed: QTGVMICAY (PTEN R130Q)
QTGVMICAR

SEQ ID NO: 354 - protein, 10 aa, Artificial Sequence
  Description of Artificial Sequence: Synthetic peptide
  Seed: VVRRCPHRER (TP53 H179R)
VMRRCPHRER

SEQ ID NO: 355 - protein, 11 aa, Artificial Sequence
  Description of Artificial Sequence: Synthetic peptide
  Seed: EVVRRCPHRER (TP53 H179R)
EFVRRCPHRER

SEQ ID NO: 356 - protein, 9 aa, Artificial Sequence
  Description of Artificial Sequence: Synthetic peptide
  Seed: RRCPHRERC (TP53 H179R)
RQCPHRERL

SEQ ID NO: 357 - protein, 9 aa, Artificial Sequence
  Description of Artificial Sequence: Synthetic peptide
  Seed: RRCPHRERC (TP53 H179R)
RRCPHRERY

SEQ ID NO: 358 - protein, 9 aa, Artificial Sequence
  Description of Artificial Sequence: Synthetic peptide
  Seed: RRCPHRERC (TP53 H179R)
RRCPHRERF

SEQ ID NO: 359 - protein, 10 aa, Artificial Sequence
  Description of Artificial Sequence: Synthetic peptide
  Seed: GTRVLAMAIY (TP53 R158L)
GQRVLAMAIY

SEQ ID NO: 360 - protein, 9 aa, Artificial Sequence
  Description of Artificial Sequence: Synthetic peptide
  Seed: GTRVLAMAI (TP53 R158L)
GTRVLAMAY

SEQ ID NO: 361 - protein, 8 aa, Artificial Sequence
  Description of Artificial Sequence: Synthetic peptide
  Seed: RVLAMAIY (TP53 R158L)
RMLAMAIF

SEQ ID NO: 362 - protein, 9 aa, Artificial Sequence
  Description of Artificial Sequence: Synthetic peptide
  Seed: RVLAMAIYK (TP53 R158L)
RMLAMAIYK

SEQ ID NO: 363 - protein, 10 aa, Artificial Sequence
  Description of Artificial Sequence: Synthetic peptide
  Seed: TRVLAMAIYK (TP53 R158L)
TMVLAMAIYK

SEQ ID NO: 364 - protein, 8 aa, Artificial Sequence
  Description of Artificial Sequence: Synthetic peptide
  Seed: RVLAMAIY (TP53 R158L)
RQLAMAIY

SEQ ID NO: 365 - protein, 9 aa, Artificial Sequence
  Description of Artificial Sequence: Synthetic peptide
  Seed: RVLAMAIYK (TP53 R158L)
RTLAMAIYR

SEQ ID NO: 366 - protein, 9 aa, Artificial Sequence
  Description of Artificial Sequence: Synthetic peptide
  Seed: RVLAMAIYK (TP53 R158L)
RYLAMAIYY

SEQ ID NO: 367 - protein, 8 aa, Artificial Sequence
  Description of Artificial Sequence: Synthetic peptide
  Seed: TRVLAMAI (TP53 R158L)
THVLAMAA

SEQ ID NO: 368 - protein, 10 aa, Artificial Sequence
  Description of Artificial Sequence: Synthetic peptide
  Seed: TPPPGTRVLA (TP53 R158L)
TPPPGTRVLL

SEQ ID NO: 369 - protein, 9 aa, Artificial Sequence
  Description of Artificial Sequence: Synthetic peptide
  Seed: TRVLAMAIY (TP53 R158L)
TQVLAMAIY

SEQ ID NO: 370 - protein, 11 aa, Artificial Sequence
  Description of Artificial Sequence: Synthetic peptide
  Seed: TPPPGTRVLAM (TP53 R158L)
TVPPGTRVLAM

SEQ ID NO: 371 - protein, 10 aa, Artificial Sequence
  Description of Artificial Sequence: Synthetic peptide
  Seed: GTRVLAMAIY (TP53 R158L)
GMRVLAMAIY

SEQ ID NO: 372 - protein, 9 aa, Artificial Sequence
  Description of Artificial Sequence: Synthetic peptide
  Seed: TRVLAMAIY (TP53 R158L)
TQVLAMAIF

SEQ ID NO: 373 - protein, 9 aa, Artificial Sequence
  Description of Artificial Sequence: Synthetic peptide
  Seed: RVLAMAIYK (TP53 R158L)
RTLAMAIYY

SEQ ID NO: 374 - protein, 11 aa, Artificial Sequence
  Description of Artificial Sequence: Synthetic peptide
  Seed: TPPPGTRVLAM (TP53 R158L)
TAPPGTRVLAL

SEQ ID NO: 375 - protein, 11 aa, Artificial Sequence
  Description of Artificial Sequence: Synthetic peptide
  Seed: EVVRHCPHHER (TP53 R175H)
ETVRHCPHHER

SEQ ID NO: 376 - protein, 10 aa, Artificial Sequence
  Description of Artificial Sequence: Synthetic peptide
  Seed: VVRHCPHHER (TP53 R175H)
VMRHCPHHER

SEQ ID NO: 377 - protein, 10 aa, Artificial Sequence
  Description of Artificial Sequence: Synthetic peptide
  Seed: VVRHCPHHER (TP53 R175H)
VTRHCPHHER

SEQ ID NO: 378 - protein, 9 aa, Artificial Sequence
  Description of Artificial Sequence: Synthetic peptide
  Seed: EVVRHCPHH (TP53 R175H)
EVVRHCPHR

SEQ ID NO: 379 - protein, 9 aa, Artificial Sequence
  Description of Artificial Sequence: Synthetic peptide
  Seed: HMTEVVRHC (TP53 R175H)
HQTEVVRHL

SEQ ID NO: 380 - protein, 9 aa, Artificial Sequence
  Description of Artificial Sequence: Synthetic peptide
  Seed: HMTEVVRHC (TP53 R175H)
HQTEVVRHV

SEQ ID NO: 381 - protein, 10 aa, Artificial Sequence
  Description of Artificial Sequence: Synthetic peptide
  Seed: QHMTEVVRHC (TP53 R175H)
QHMTEVVRHL

SEQ ID NO: 382 - protein, 9 aa, Artificial Sequence
  Description of Artificial Sequence: Synthetic peptide
  Seed: VRHCPHHER (TP53 R175H)
VRHCPHHEM

SEQ ID NO: 383 - protein, 9 aa, Artificial Sequence
  Description of Artificial Sequence: Synthetic peptide
  Seed: VRHCPHHER (TP53 R175H)
VRHCPHHEY

SEQ ID NO: 384 - protein, 9 aa, Artificial Sequence
  Description of Artificial Sequence: Synthetic peptide
  Seed: VRHCPHHER (TP53 R175H)
VTHCPHHER

SEQ ID NO: 385 - protein, 9 aa, Artificial Sequence
  Description of Artificial Sequence: Synthetic peptide
  Seed: VRHCPHHER (TP53 R175H)
VVHCPHHER

SEQ ID NO: 386 - protein, 9 aa, Artificial Sequence
  Description of Artificial Sequence: Synthetic peptide
  Seed: VRHCPHHER (TP53 R175H)
VRHCPHHEF

SEQ ID NO: 387 - protein, 10 aa, Artificial Sequence
  Description of Artificial Sequence: Synthetic peptide
  Seed: GMNQRPILTI (TP53 R248Q)
GMNQRPILTV

SEQ ID NO: 388 - protein, 10 aa, Artificial Sequence
  Description of Artificial Sequence: Synthetic peptide
  Seed: MNQRPILTII (TP53 R248Q)
MLQRPILTIY

SEQ ID NO: 389 - protein, 10 aa, Artificial Sequence
  Description of Artificial Sequence: Synthetic peptide
  Seed: SSCMGGMNQR (TP53 R248Q)
STCMGGMNQK

SEQ ID NO: 390 - protein, 9 aa, Artificial Sequence
  Description of Artificial Sequence: Synthetic peptide
  Seed: SCMGGMNQR (TP53 R248Q)
STMGGMNQR

SEQ ID NO: 391 - protein, 10 aa, Artificial Sequence
  Description of Artificial Sequence: Synthetic peptide
  Seed: SSCMGGMNQR (TP53 R248Q)
SVCMGGMNQK

SEQ ID NO: 392 - protein, 9 aa, Artificial Sequence
  Description of Artificial Sequence: Synthetic peptide
  Seed: MNQRPILTI (TP53 R248Q)
MAQRPILTL

SEQ ID NO: 393 - protein, 9 aa, Artificial Sequence
  Description of Artificial Sequence: Synthetic peptide
  Seed: MNQRPILTI (TP53 R248Q)
MQQRPILTV

SEQ ID NO: 394 - protein, 9 aa, Artificial Sequence
  Description of Artificial Sequence: Synthetic peptide
  Seed: MNQRPILTI (TP53 R248Q)
MRQRPILTL

SEQ ID NO: 395 - protein, 10 aa, Artificial Sequence
  Description of Artificial Sequence: Synthetic peptide
  Seed: SSCMGGMNQR (TP53 R248Q)
STCMGGMNQY

SEQ ID NO: 396 - protein, 9 aa, Artificial Sequence
  Description of Artificial Sequence: Synthetic peptide
  Seed: SCMGGMNQR (TP53 R248Q)
SVMGGMNQM

SEQ ID NO: 397 - protein, 9 aa, Artificial Sequence
  Description of Artificial Sequence: Synthetic peptide
  Seed: SCMGGMNQR (TP53 R248Q)
SVMGGMNQR

SEQ ID NO: 398 - protein, 10 aa, Artificial Sequence
  Description of Artificial Sequence: Synthetic peptide
  Seed: MNQRPILTII (TP53 R248Q)
MMQRPILTIM

SEQ ID NO: 399 - protein, 10 aa, Artificial Sequence
  Description of Artificial Sequence: Synthetic peptide
  Seed: GMNQRPILTI (TP53 R248Q)
GLNQRPILTV

SEQ ID NO: 400 - protein, 9 aa, Artificial Sequence
  Description of Artificial Sequence: Synthetic peptide
  Seed: MNQRPILTI (TP53 R248Q)
MQQRPILTL

SEQ ID NO: 401 - protein, 9 aa, Artificial Sequence
  Description of Artificial Sequence: Synthetic peptide
  Seed: SCMGGMNQR (TP53 R248Q)
STMGGMNQM

SEQ ID NO: 402 - protein, 10 aa, Artificial Sequence
  Description of Artificial Sequence: Synthetic peptide
  Seed: GMNWRPILTI (TP53 R248W)
GMNWRPILTV

SEQ ID NO: 403 - protein, 9 aa, Artificial Sequence
  Description of Artificial Sequence: Synthetic peptide
  Seed: MNWRPILTI (TP53 R248W)
MSWRPILTV

SEQ ID NO: 404 - protein, 9 aa, Artificial Sequence
  Description of Artificial Sequence: Synthetic peptide
  Seed: MNWRPILTI (TP53 R248W)
MVWRPILTY

SEQ ID NO: 405 - protein, 9 aa, Artificial Sequence
  Description of Artificial Sequence: Synthetic peptide
  Seed: SCMGGMNWR (TP53 R248W)
SAMGGMNWR

SEQ ID NO: 406 - protein, 10 aa, Artificial Sequence
  Description of Artificial Sequence: Synthetic peptide
  Seed: SSCMGGMNWR (TP53 R248W)
SVCMGGMNWK

SEQ ID NO: 407 - protein, 9 aa, Artificial Sequence
  Description of Artificial Sequence: Synthetic peptide
  Seed: MNWRPILTI (TP53 R248W)
MAWRPILTL

SEQ ID NO: 408 - protein, 9 aa, Artificial Sequence
  Description of Artificial Sequence: Synthetic peptide
  Seed: MNWRPILTI (TP53 R248W)
MQWRPILTL

SEQ ID NO: 409 - protein, 9 aa, Artificial Sequence
  Description of Artificial Sequence: Synthetic peptide
  Seed: MNWRPILTI (TP53 R248W)
MQWRPILTV

SEQ ID NO: 410 - protein, 9 aa, Artificial Sequence
  Description of Artificial Sequence: Synthetic peptide
  Seed: MNWRPILTI (TP53 R248W)
MRWRPILTM

SEQ ID NO: 411 - protein, 9 aa, Artificial Sequence
  Description of Artificial Sequence: Synthetic peptide
  Seed: MNWRPILTI (TP53 R248W)
MSWRPILTL

SEQ ID NO: 412 - protein, 9 aa, Artificial Sequence
  Description of Artificial Sequence: Synthetic peptide
  Seed: MNWRPILTI (TP53 R248W)
MTWRPILTL

SEQ ID NO: 413 - protein, 9 aa, Artificial Sequence
  Description of Artificial Sequence: Synthetic peptide
  Seed: SCMGGMNWR (TP53 R248W)
STMGGMNWR

SEQ ID NO: 414 - protein, 9 aa, Artificial Sequence
  Description of Artificial Sequence: Synthetic peptide
  Seed: SCMGGMNWR (TP53 R248W)
SVMGGMNWR

SEQ ID NO: 415 - protein, 9 aa, Artificial Sequence
  Description of Artificial Sequence: Synthetic peptide
  Seed: MNWRPILTI (TP53 R248W)
MSWRPILTF

SEQ ID NO: 416 - protein, 9 aa, Artificial Sequence
  Description of Artificial Sequence: Synthetic peptide
  Seed: MNWRPILTI (TP53 R248W)
MTWRPILTV

SEQ ID NO: 417 - protein, 10 aa, Artificial Sequence
  Description of Artificial Sequence: Synthetic peptide
  Seed: SSCMGGMNWR (TP53 R248W)
STCMGGMNWK

SEQ ID NO: 418 - protein, 9 aa, Artificial Sequence
  Description of Artificial Sequence: Synthetic peptide
  Seed: MNWRPILTI (TP53 R248W)
MEWRPILTV

SEQ ID NO: 419 - protein, 9 aa, Artificial Sequence
  Description of Artificial Sequence: Synthetic peptide
  Seed: MNWRPILTI (TP53 R248W)
MQWRPILTW

SEQ ID NO: 420 - protein, 9 aa, Artificial Sequence
  Description of Artificial Sequence: Synthetic peptide
  Seed: MNWRPILTI (TP53 R248W)
MRWRPILTY

SEQ ID NO: 421 - protein, 9 aa, Artificial Sequence
  Description of Artificial Sequence: Synthetic peptide
  Seed: SCMGGMNWR (TP53 R248W)
SSMGGMNWR

SEQ ID NO: 422 - protein, 10 aa, Artificial Sequence
  Description of Artificial Sequence: Synthetic peptide
  Seed: EVCVCACPGR (TP53 R273C)
ETCVCACPGR

SEQ ID NO: 423 - protein, 9 aa, Artificial Sequence
  Description of Artificial Sequence: Synthetic peptide
  Seed: NSFEVCVCA (TP53 R273C)
NVFEVCVCI

SEQ ID NO: 424 - protein, 9 aa, Artificial Sequence
  Description of Artificial Sequence: Synthetic peptide
  Seed: NSFEVCVCA (TP53 R273C)
NVFEVCVCV

SEQ ID NO: 425 - protein, 10 aa, Artificial Sequence
  Description of Artificial Sequence: Synthetic peptide
  Seed: SFEVCVCACP (TP53 R273C)
SEEVCVCACA

SEQ ID NO: 426 - protein, 10 aa, Artificial Sequence
  Description of Artificial Sequence: Synthetic peptide
  Seed: EVCVCACPGR (TP53 R273C)
ETCVCACPGK

SEQ ID NO: 427 - protein, 10 aa, Artificial Sequence
  Description of Artificial Sequence: Synthetic peptide
  Seed: EVCVCACPGR (TP53 R273C)
EYCVCACPGR

SEQ ID NO: 428 - protein, 9 aa, Artificial Sequence
  Description of Artificial Sequence: Synthetic peptide
  Seed: GRNSFEVCV (TP53 R273C)
GRNSFEVCL

SEQ ID NO: 429 - protein, 9 aa, Artificial Sequence
  Description of Artificial Sequence: Synthetic peptide
  Seed: GRNSFEVCV (TP53 R273C)
GRNSFEVCM

SEQ ID NO: 430 - protein, 9 aa, Artificial Sequence
  Description of Artificial Sequence: Synthetic peptide
  Seed: NSFEVCVCA (TP53 R273C)
NVFEVCVCL

SEQ ID NO: 431 - protein, 9 aa, Artificial Sequence
  Description of Artificial Sequence: Synthetic peptide
  Seed: SFEVCVCAC (TP53 R273C)
SFEVCVCAL

SEQ ID NO: 432 - protein, 9 aa, Artificial Sequence
  Description of Artificial Sequence: Synthetic peptide
  Seed: NSFEVCVCA (TP53 R273C)
NTFEVCVCV

SEQ ID NO: 433 - protein, 10 aa, Artificial Sequence
  Description of Artificial Sequence: Synthetic peptide
  Seed: EVHVCACPGR (TP53 R273H)
EFHVCACPGR

SEQ ID NO: 434 - protein, 11 aa, Artificial Sequence
  Description of Artificial Sequence: Synthetic peptide
  Seed: LLGRNSFEVHV (TP53 R273H)
LMGRNSFEVHV

SEQ ID NO: 435 - protein, 9 aa, Artificial Sequence
  Description of Artificial Sequence: Synthetic peptide
  Seed: NSFEVHVCA (TP53 R273H)
NPFEVHVCV

SEQ ID NO: 436 - protein, 9 aa, Artificial Sequence
  Description of Artificial Sequence: Synthetic peptide
  Seed: NSFEVHVCA (TP53 R273H)
NVFEVHVCV

SEQ ID NO: 437 - protein, 10 aa, Artificial Sequence
  Description of Artificial Sequence: Synthetic peptide
  Seed: EVHVCACPGR (TP53 R273H)
EVHVCACPGK

SEQ ID NO: 438 - protein, 10 aa, Artificial Sequence
  Description of Artificial Sequence: Synthetic peptide
  Seed: EVHVCACPGR (TP53 R273H)
EYHVCACPGR

SEQ ID NO: 439 - protein, 9 aa, Artificial Sequence
  Description of Artificial Sequence: Synthetic peptide
  Seed: GRNSFEVHV (TP53 R273H)
GRNSFEVHF

SEQ ID NO: 440 - protein, 9 aa, Artificial Sequence
  Description of Artificial Sequence: Synthetic peptide
  Seed: GRNSFEVHV (TP53 R273H)
GRNSFEVHY

SEQ ID NO: 441 - protein, 9 aa, Artificial Sequence
  Description of Artificial Sequence: Synthetic peptide
  Seed: NSFEVHVCA (TP53 R273H)
NPFEVHVCA

SEQ ID NO: 442 - protein, 9 aa, Artificial Sequence
  Description of Artificial Sequence: Synthetic peptide
  Seed: SFEVHVCAC (TP53 R273H)
SYEVHVCAL

SEQ ID NO: 443 - protein, 10 aa, Artificial Sequence
  Description of Artificial Sequence: Synthetic peptide
  Seed: EVHVCACPGR (TP53 R273H)
ETHVCACPGR

SEQ ID NO: 444 - protein, 9 aa, Artificial Sequence
  Description of Artificial Sequence: Synthetic peptide
  Seed: NSFEVHVCA (TP53 R273H)
NTFEVHVCV

SEQ ID NO: 445 - protein, 10 aa, Artificial Sequence
  Description of Artificial Sequence: Synthetic peptide
  Seed: EVHVCACPGR (TP53 R273H)
ETHVCACPGK

SEQ ID NO: 446 - protein, 9 aa, Artificial Sequence
  Description of Artificial Sequence: Synthetic peptide
  Seed: NSFEVHVCA (TP53 R273H)
NAFEVHVCV

SEQ ID NO: 447 - protein, 11 aa, Artificial Sequence
  Description of Artificial Sequence: Synthetic peptide
  Seed: RVCACPGRDWR (TP53 R282W)
RMCACPGRDWR

SEQ ID NO: 448 - protein, 9 aa, Artificial Sequence
  Description of Artificial Sequence: Synthetic peptide
  Seed: CACPGRDWR (TP53 R282W)
CTCPGRDWR

SEQ ID NO: 449 - protein, 10 aa, Artificial Sequence
  Description of Artificial Sequence: Synthetic peptide
  Seed: RDWRTEEENL (TP53 R282W)
REWRTEEENL

SEQ ID NO: 450 - protein, 9 aa, Artificial Sequence
  Description of Artificial Sequence: Synthetic peptide
  Seed: VVPCEPPEV (TP53 Y220C)
VMPCEPPEV

SEQ ID NO: 451 - protein, 9 aa, Artificial Sequence
  Description of Artificial Sequence: Synthetic peptide
  Seed: VVPCEPPEV (TP53 Y220C)
VAPCEPPEL

SEQ ID NO: 452 - protein, 9 aa, Artificial Sequence
  Description of Artificial Sequence: Synthetic peptide
  Seed: VVPCEPPEV (TP53 Y220C)
VAPCEPPEM

SEQ ID NO: 453 - protein, 9 aa, Artificial Sequence
  Description of Artificial Sequence: Synthetic peptide
  Seed: VVPCEPPEV (TP53 Y220C)
VFPCEPPEM

SEQ ID NO: 454 - protein, 9 aa, Artificial Sequence
  Description of Artificial Sequence: Synthetic peptide
  Seed: VVPCEPPEV (TP53 Y220C)
VLPCEPPEV

SEQ ID NO: 455 - protein, 9 aa, Artificial Sequence
  Description of Artificial Sequence: Synthetic peptide
  Seed: VPCEPPEVG (TP53 Y220C)
VPCEPPEVA

SEQ ID NO: 456 - protein, 9 aa, Artificial Sequence
  Description of Artificial Sequence: Synthetic peptide
  Seed: VPCEPPEVG (TP53 Y220C)
VPCEPPEVM

SEQ ID NO: 457 - protein, 9 aa, Artificial Sequence
  Description of Artificial Sequence: Synthetic peptide
  Seed: VVPCEPPEV (TP53 Y220C)
VYPCEPPEL

SEQ ID NO: 458 - protein, 9 aa, Artificial Sequence
  Description of Artificial Sequence: Synthetic peptide
  Seed: VVPCEPPEV (TP53 Y220C)
VLPCEPPEL

SEQ ID NO: 459 - protein, 11 aa, Homo sapiens
  Native (AKT1 E17K)
KYIKTWRPRYF

SEQ ID NO: 460 - protein, 9 aa, Homo sapiens
  Native (IDH1 R132C)
KPIIIGCHA

SEQ ID NO: 461 - protein, 9 aa, Homo sapiens
  Native (IDH1 R132H)
KPIIIGHHA

SEQ ID NO: 462 - protein, 9 aa, Homo sapiens
  Native (KRAS G12A)
LVVVGAAGV

SEQ ID NO: 463 - protein, 10 aa, Homo sapiens
  Native (KRAS G12C)
VVVGACGVGK

SEQ ID NO: 464 - protein, 10 aa, Homo sapiens
  Native (KRAS G12D)
VVVGADGVGK

SEQ ID NO: 465 - protein, 10 aa, Homo sapiens
  Native (KRAS G12R)
VVVGARGVGK

SEQ ID NO: 466 - protein, 10 aa, Homo sapiens
  Native (KRAS G13D)
KLVVVGAGDV

SEQ ID NO: 467 - protein, 10 aa, Homo sapiens
  Native (PIK3CA E545K)
ITKQEKDFLW

SEQ ID NO: 468 - protein, 9 aa, Homo sapiens
  Native (PIK3CA R88Q)
ETRQLCDLR

SEQ ID NO: 469 - protein, 9 aa, Homo sapiens
  Native (TP53 R158L)
RVLAMAIYK

SEQ ID NO: 470 - protein, 10 aa, Homo sapiens
  Native (TP53 R158L)
TPPPGTRVLA

SEQ ID NO: 471 - protein, 11 aa, Homo sapiens
  Native (TP53 R175H)
EVVRHCPHHER

SEQ ID NO: 472 - protein, 10 aa, Homo sapiens
  Native (TP53 R175H)
VVRHCPHHER

SEQ ID NO: 473 - protein, 10 aa, Homo sapiens
  Native (TP53 R273C)
EVCVCACPGR

SEQ ID NO: 474 - protein, 10 aa, Homo sapiens
  Native (TP53 R273H)
EVHVCACPGR

SEQ ID NO: 475 - protein, 25 aa, Artificial Sequence
  Description of Artificial Sequence: Synthetic peptide
  Seed: AIVKEGWLHKRGKYIKTWRPRYFLL (AKT1 E17K)
AIVKEGFLHARAKYVKTWRPRYFLL

SEQ ID NO: 476 - protein, 25 aa, Artificial Sequence
  Description of Artificial Sequence: Synthetic peptide
  Seed: AIVKEGWLHKRGKYIKTWRPRYFLL (AKT1 E17K)
AIVKEGFLHTRFKYIKTWRPRYFLL

SEQ ID NO: 477 - protein, 25 aa, Artificial Sequence
  Description of Artificial Sequence: Synthetic peptide
  Seed: DVAIVKEGWLHKRGKYIKTWRPRYF (AKT1 E17K)
DVAIVKEGFLHERFKYMKTWRPRYF

SEQ ID NO: 478 - protein, 25 aa, Artificial Sequence
  Description of Artificial Sequence: Synthetic peptide
  Seed: DVAIVKEGWLHKRGKYIKTWRPRYF (AKT1 E17K)
DVAIVKEGLLHNRNKYIKTWRPRYF

SEQ ID NO: 479 - protein, 20 aa, Artificial Sequence
  Description of Artificial Sequence: Synthetic peptide
  Seed: VKEGWLHKRGKYIKTWRPRY (AKT1 E17K)
VKEGFLHMRSKYIKTWRPRY

SEQ ID NO: 480 - protein, 25 aa, Artificial Sequence
  Description of Artificial Sequence: Synthetic peptide
  Seed: AIVKEGWLHKRGKYIKTWRPRYFLL (AKT1 E17K)
AIVKEGILHARAKYIKTWRPRYFLL

SEQ ID NO: 481 - protein, 25 aa, Artificial Sequence
  Description of Artificial Sequence: Synthetic peptide
  Seed: DVAIVKEGWLHKRGKYIKTWRPRYF (AKT1 E17K)
DVAIVKEGFLHTRFKYLKTWRPRYF

SEQ ID NO: 482 - protein, 25 aa, Artificial Sequence
  Description of Artificial Sequence: Synthetic peptide
  Seed: DVAIVKEGWLHKRGKYIKTWRPRYF (AKT1 E17K)
DVAIVKEGILHNRFKYIKTWRPRYF

SEQ ID NO: 483 - protein, 20 aa, Artificial Sequence
  Description of Artificial Sequence: Synthetic peptide
  Seed: VKEGWLHKRGKYIKTWRPRY (AKT1 E17K)
VKEGFLHIRSKYVKTWRPRY

SEQ ID NO: 484 - protein, 15 aa, Artificial Sequence
  Description of Artificial Sequence: Synthetic peptide
  Seed: FGLATEKSRWSGSHQ (BRAF V600E)
FGLLTEWSRWSRSHQ

SEQ ID NO: 485 - protein, 15 aa, Artificial Sequence
  Description of Artificial Sequence: Synthetic peptide
  Seed: KIGDFGLATEKSRWS (BRAF V600E)
KIGLFGFAVEKARWS

SEQ ID NO: 486 - protein, 15 aa, Artificial Sequence
  Description of Artificial Sequence: Synthetic peptide
  Seed: KIGDFGLATEKSRWS (BRAF V600E)
KIGLFGWAVEKVRWS

SEQ ID NO: 487 - protein, 15 aa, Artificial Sequence
  Description of Artificial Sequence: Synthetic peptide
  Seed: VKIGDFGLATEKSRW (BRAF V600E)
VKIGLFGIAIEKLRW

SEQ ID NO: 488 - protein, 15 aa, Artificial Sequence
  Description of Artificial Sequence: Synthetic peptide
  Seed: VKIGDFGLATEKSRW (BRAF V600E)
VKIGYFGWAAEKARW

SEQ ID NO: 489 - protein, 15 aa, Artificial Sequence
  Description of Artificial Sequence: Synthetic peptide
  Seed: VKIGDFGLATEKSRW (BRAF V600E)
VKIGLFGLAIEKMRW

SEQ ID NO: 490 - protein, 15 aa, Artificial Sequence
  Description of Artificial Sequence: Synthetic peptide
  Seed: FGLATEKSRWSGSHQ (BRAF V600E)
FGLITEMSRWSKSHQ

SEQ ID NO: 491 - protein, 15 aa, Artificial Sequence
  Description of Artificial Sequence: Synthetic peptide
  Seed: KIGDFGLATEKSRWS (BRAF V600E)
KIGFFGIAIEKARWS

SEQ ID NO: 492 - protein, 15 aa, Artificial Sequence
  Description of Artificial Sequence: Synthetic peptide
  Seed: KIGDFGLATEKSRWS (BRAF V600E)
KIGIFGYAIEKARWS

SEQ ID NO: 493 - protein, 15 aa, Artificial Sequence
  Description of Artificial Sequence: Synthetic peptide
  Seed: VKIGDFGLATEKSRW (BRAF V600E)
VKIGFFGLASEKVRW

SEQ ID NO: 494 - protein, 15 aa, Artificial Sequence
  Description of Artificial Sequence: Synthetic peptide
  Seed: VKIGDFGLATEKSRW (BRAF V600E)
VKIGVFGLAGEKLRW

SEQ ID NO: 495 - protein, 15 aa, Artificial Sequence
  Description of Artificial Sequence: Synthetic peptide
  Seed: GLATMKSRWSGSHQF (BRAF V600M)
GLLTMHSRWSKSHQF

SEQ ID NO: 496 - protein, 15 aa, Artificial Sequence
  Description of Artificial Sequence: Synthetic peptide
  Seed: KIGDFGLATMKSRWS (BRAF V600M)
KIGFFGAAVMKARWS

SEQ ID NO: 497 - protein, 15 aa, Artificial Sequence
  Description of Artificial Sequence: Synthetic peptide
  Seed: KIGDFGLATMKSRWS (BRAF V600M)
KIGIFGAASMKARWS

SEQ ID NO: 498 - protein, 15 aa, Artificial Sequence
  Description of Artificial Sequence: Synthetic peptide
  Seed: KIGDFGLATMKSRWS (BRAF V600M)
KIGMFGIANMKDRWS

SEQ ID NO: 499 - protein, 17 aa, Artificial Sequence
  Description of Artificial Sequence: Synthetic peptide
  Seed: TVKIGDFGLATMKSRWS (BRAF V600M)
TVKIGIFGIATMKHRWS

SEQ ID NO: 500 - protein, 15 aa, Artificial Sequence
  Description of Artificial Sequence: Synthetic peptide
  Seed: GLATMKSRWSGSHQF (BRAF V600M)
GLITMISRWSRSHQF

SEQ ID NO: 501 - protein, 15 aa, Artificial Sequence
  Description of Artificial Sequence: Synthetic peptide
  Seed: KIGDFGLATMKSRWS (BRAF V600M)
KIGFFGAAAMKARWS

SEQ ID NO: 502 - protein, 15 aa, Artificial Sequence
  Description of Artificial Sequence: Synthetic peptide
  Seed: KIGDFGLATMKSRWS (BRAF V600M)
KIGMFGIATMKDRWS

SEQ ID NO: 503 - protein, 15 aa, Artificial Sequence
  Description of Artificial Sequence: Synthetic peptide
  Seed: PEGKYSFGVTCVKKC (EGFR A289V)
PEGKWSFQVACVMKC

SEQ ID NO: 504 - protein, 15 aa, Artificial Sequence
  Description of Artificial Sequence: Synthetic peptide
  Seed: PEGKYSFGVTCVKKC (EGFR A289V)
PEGKYSFLVGCVNKC

SEQ ID NO: 505 - protein, 15 aa, Artificial Sequence
  Description of Artificial Sequence: Synthetic peptide
  Seed: PEGKYSFGVTCVKKC (EGFR A289V)
PEGKYSFLVPCVMKC

SEQ ID NO: 506 - protein, 15 aa, Artificial Sequence
  Description of Artificial Sequence: Synthetic peptide
  Seed: PEGKYSFGVTCVKKC (EGFR A289V)
PEGKYSFMVSCVRKC

SEQ ID NO: 507 - protein, 20 aa, Artificial Sequence
  Description of Artificial Sequence: Synthetic peptide
  Seed: PEGKYSFGVTCVKKCPRNYV (EGFR A289V)
PEGKYSYGVMCVKKLPRNYV

SEQ ID NO: 508 - protein, 20 aa, Artificial Sequence
  Description of Artificial Sequence: Synthetic peptide
  Seed: PEGKYSFGVTCVKKCPRNYV (EGFR A289V)
PEGKYSYGVMCVKKVPRNYV

SEQ ID NO: 509 - protein, 15 aa, Artificial Sequence
  Description of Artificial Sequence: Synthetic peptide
  Seed: PEGKYSFGVTCVKKC (EGFR A289V)
PEGKFSFMVPCVAKC

SEQ ID NO: 510 - protein, 15 aa, Artificial Sequence
  Description of Artificial Sequence: Synthetic peptide
  Seed: GPHCVKTCPAVVMGE (EGFR G598V)
GPHCYKTLPAVVAGE

SEQ ID NO: 511 - protein, 20 aa, Artificial Sequence
  Description of Artificial Sequence: Synthetic peptide
  Seed: PHCVKTCPAVVMGENNTLVW (EGFR G598V)
PHCFKTSPAVVVGENNTLVW

SEQ ID NO: 512 - protein, 20 aa, Artificial Sequence
  Description of Artificial Sequence: Synthetic peptide
  Seed: PHCVKTCPAVVMGENNTLVW (EGFR G598V)
PHCYKTSPAVVIGENNTLVW

SEQ ID NO: 513 - protein, 23 aa, Artificial Sequence
  Description of Artificial Sequence: Synthetic peptide
  Seed: YIDGPHCVKTCPAVVMGENNTLV (EGFR G598V)
YIDGPHCIKTNPVVVLGENNTLV

SEQ ID NO: 514 - protein, 23 aa, Artificial Sequence
  Description of Artificial Sequence: Synthetic peptide
  Seed: YIDGPHCVKTCPAVVMGENNTLV (EGFR G598V)
YIDGPHCVKTNPSVVIGENNTLV

SEQ ID NO: 515 - protein, 15 aa, Artificial Sequence
  Description of Artificial Sequence: Synthetic peptide
  Seed: GPHCVKTCPAVVMGE (EGFR G598V)
GPHCFKTMPAVVAGE

SEQ ID NO: 516 - protein, 15 aa, Artificial Sequence
  Description of Artificial Sequence: Synthetic peptide
  Seed: GPHCVKTCPAVVMGE (EGFR G598V)
GPHCMKTLPSVVAGE

SEQ ID NO: 517 - protein, 15 aa, Artificial Sequence
  Description of Artificial Sequence: Synthetic peptide
  Seed: GPHCVKTCPAVVMGE (EGFR G598V)
GPHFVKTCSAVIMGE

SEQ ID NO: 518 - protein, 20 aa, Artificial Sequence
  Description of Artificial Sequence: Synthetic peptide
  Seed: PHCVKTCPAVVMGENNTLVW (EGFR G598V)
PHCFKTAPAVVIGENNTLVW

SEQ ID NO: 519 - protein, 23 aa, Artificial Sequence
  Description of Artificial Sequence: Synthetic peptide
  Seed: YIDGPHCVKTCPAVVMGENNTLV (EGFR G598V)
YIDGPHCFKTNPAVVIGENNTLV

SEQ ID NO: 520 - protein, 20 aa, Artificial Sequence
  Description of Artificial Sequence: Synthetic peptide
  Seed: KTPQHVKITDFGRAKLLGAE (EGFR L858R)
KTPQHFKITDFGRVKLLGAE

SEQ ID NO: 521 - protein, 20 aa, Artificial Sequence
  Description of Artificial Sequence: Synthetic peptide
  Seed: KTPQHVKITDFGRAKLLGAE (EGFR L858R)
KTPQHYKIADSGRIKLLGAE

SEQ ID NO: 522 - protein, 20 aa, Artificial Sequence
  Description of Artificial Sequence: Synthetic peptide
  Seed: QHVKITDFGRAKLLGAEEKE (EGFR L858R)
QHVKITDYGRIKRLGIEEKE

SEQ ID NO: 523 - protein, 15 aa, Artificial Sequence
  Description of Artificial Sequence: Synthetic peptide
  Seed: VKITDFGRAKLLGAE (EGFR L858R)
VKIMDFMRGKLSGAE

SEQ ID NO: 524 - protein, 15 aa, Artificial Sequence
  Description of Artificial Sequence: Synthetic peptide
  Seed: VKITDFGRAKLLGAE (EGFR L858R)
VKITDFGRAKALGVE

SEQ ID NO: 525 - protein, 20 aa, Artificial Sequence
  Description of Artificial Sequence: Synthetic peptide
  Seed: KTPQHVKITDFGRAKLLGAE (EGFR L858R)
KTPQHFKITDIGRLKLLGAE

SEQ ID NO: 526 - protein, 20 aa, Artificial Sequence
  Description of Artificial Sequence: Synthetic peptide
  Seed: QHVKITDFGRAKLLGAEEKE (EGFR L858R)
QHVKITDFGRIKRLGVEEKE

SEQ ID NO: 527 - protein, 15 aa, Artificial Sequence
  Description of Artificial Sequence: Synthetic peptide
  Seed: VKITDFGRAKLLGAE (EGFR L858R)
VKIIDFMRAKLLGAE

SEQ ID NO: 528 - protein, 15 aa, Artificial Sequence
  Description of Artificial Sequence: Synthetic peptide
  Seed: LERILHAKERIRFVI (GTF2I L424H)
LERFLHMKSRIVFVI

SEQ ID NO: 529 - protein, 15 aa, Artificial Sequence
  Description of Artificial Sequence: Synthetic peptide
  Seed: LERILHAKERIRFVI (GTF2I L424H)
LERFLHTKFRILFVI

SEQ ID NO: 530 - protein, 15 aa, Artificial Sequence
  Description of Artificial Sequence: Synthetic peptide
  Seed: LERILHAKERIRFVI (GTF2I L424H)
LERIIHASERIRVVI

SEQ ID NO: 531 - protein, 20 aa, Artificial Sequence
  Description of Artificial Sequence: Synthetic peptide
  Seed: PRLERILHAKERIRFVIKKH (GTF2I L424H)
PRLERIFHANEFIRVVIKKH

SEQ ID NO: 532 - protein, 15 aa, Artificial Sequence
  Description of Artificial Sequence: Synthetic peptide
  Seed: YGIPRLERILHAKER (GTF2I L424H)
YGIFRLVRLLHTKER

SEQ ID NO: 533 - protein, 15 aa, Artificial Sequence
  Description of Artificial Sequence: Synthetic peptide
  Seed: LERILHAKERIRFVI (GTF2I L424H)
LERIIHASERIRLVI

SEQ ID NO: 534 - protein, 20 aa, Artificial Sequence
  Description of Artificial Sequence: Synthetic peptide
  Seed: PRLERILHAKERIRFVIKKH (GTF2I L424H)
PRLERILHAAEFIRVVIKKH

SEQ ID NO: 535 - protein, 15 aa, Artificial Sequence
  Description of Artificial Sequence: Synthetic peptide
  Seed: GWVKPIIIGCHAYGD (IDH1 R132C)
GWVKPLIIMCNAYRD

SEQ ID NO: 536 - protein, 15 aa, Artificial Sequence
  Description of Artificial Sequence: Synthetic peptide
  Seed: GWVKPIIIGCHAYGD (IDH1 R132C)
GWVKPMIILCRAYHD

SEQ ID NO: 537 - protein, 20 aa, Artificial Sequence
  Description of Artificial Sequence: Synthetic peptide
  Seed: PRLVSGWVKPIIIGCHAYGD (IDH1 R132C)
PRLVSGWVKPVIINCPAYID

SEQ ID NO: 538 - protein, 15 aa, Artificial Sequence
  Description of Artificial Sequence: Synthetic peptide
  Seed: VKPIIIGCHAYGDQY (IDH1 R132C)
VKPFIIMCKAYHDQY

SEQ ID NO: 539 - protein, 15 aa, Artificial Sequence
  Description of Artificial Sequence: Synthetic peptide
  Seed: VKPIIIGCHAYGDQY (IDH1 R132C)
VKPVIILCRAYHDQY

SEQ ID NO: 540 - protein, 15 aa, Artificial Sequence
  Description of Artificial Sequence: Synthetic peptide
  Seed: GWVKPIIIGCHAYGD (IDH1 R132C)
GWVKPIIIACRAYHD

SEQ ID NO: 541 - protein, 20 aa, Artificial Sequence
  Description of Artificial Sequence: Synthetic peptide
  Seed: PRLVSGWVKPIIIGCHAYGD (IDH1 R132C)
PRLVSGWVKPIIINCSAYID

SEQ ID NO: 542 - protein, 15 aa, Artificial Sequence
  Description of Artificial Sequence: Synthetic peptide
  Seed: VKPIIIGCHAYGDQY (IDH1 R132C)
VKPIIIACRAYHDQY

SEQ ID NO: 543 - protein, 15 aa, Artificial Sequence
  Description of Artificial Sequence: Synthetic peptide
  Seed: GWVKPIIIGHHAYGD (IDH1 R132H)
GWVKPFIIAHRAYSD

SEQ ID NO: 544 - protein, 15 aa, Artificial Sequence
  Description of Artificial Sequence: Synthetic peptide
  Seed: GWVKPIIIGHHAYGD (IDH1 R132H)
GWVKPFIIMHTAYRD

SEQ ID NO: 545 - protein, 20 aa, Artificial Sequence
  Description of Artificial Sequence: Synthetic peptide
  Seed: PRLVSGWVKPIIIGHHAYGD (IDH1 R132H)
PRLVSGWVKPFIINHSAYID

SEQ ID NO: 546 - protein, 20 aa, Artificial Sequence
  Description of Artificial Sequence: Synthetic peptide
  Seed: RLVSGWVKPIIIGHHAYGDQ (IDH1 R132H)
RLVSGWVKPFIIAHFAYNDQ

SEQ ID NO: 547 - protein, 20 aa, Artificial Sequence
  Description of Artificial Sequence: Synthetic peptide
  Seed: RLVSGWVKPIIIGHHAYGDQ (IDH1 R132H)
RLVSGWVKPFIIAHPAYVDQ

SEQ ID NO: 548 - protein, 15 aa, Artificial Sequence
  Description of Artificial Sequence: Synthetic peptide
  Seed: GWVKPIIIGHHAYGD (IDH1 R132H)
GWVKPIIIMHSAYRD

SEQ ID NO: 549 - protein, 20 aa, Artificial Sequence
  Description of Artificial Sequence: Synthetic peptide
  Seed: PRLVSGWVKPIIIGHHAYGD (IDH1 R132H)
PRLVSGWIKPAIVGHAAYGD

SEQ ID NO: 550 - protein, 20 aa, Artificial Sequence
  Description of Artificial Sequence: Synthetic peptide
  Seed: PRLVSGWVKPIIIGHHAYGD (IDH1 R132H)
PRLVSGWVKPFIINHFAYYD

SEQ ID NO: 551 - protein, 20 aa, Artificial Sequence
  Description of Artificial Sequence: Synthetic peptide
  Seed: RLVSGWVKPIIIGHHAYGDQ (IDH1 R132H)
RLVSGWVKPFIIAHPAYADQ

SEQ ID NO: 552 - protein, 20 aa, Artificial Sequence
  Description of Artificial Sequence: Synthetic peptide
  Seed: PRLVSGWVKPIIIGHHAYGD (IDH1 R132H)
PRLVSGWVKPFIINHAAYID

SEQ ID NO: 553 - protein, 20 aa, Artificial Sequence
  Description of Artificial Sequence: Synthetic peptide
  Seed: RLVSGWVKPIIIGHHAYGDQ (IDH1 R132H)
RLVSGWVKPFIINHFAYVDQ

SEQ ID NO: 554 - protein, 16 aa, Artificial Sequence
  Description of Artificial Sequence: Synthetic peptide
  Seed: EYKLVVVGAAGVGKSA (KRAS G12A)
EYKFVVIGNAGAGKSA

SEQ ID NO: 555 - protein, 15 aa, Artificial Sequence
  Description of Artificial Sequence: Synthetic peptide
  Seed: TEYKLVVVGAAGVGK (KRAS G12A)
TEYKFVVIGNAGVGK

SEQ ID NO: 556 - protein, 15 aa, Artificial Sequence
  Description of Artificial Sequence: Synthetic peptide
  Seed: TEYKLVVVGAAGVGK (KRAS G12A)
TEYKIVVIGRAGHGK

SEQ ID NO: 557 - protein, 15 aa, Artificial Sequence
  Description of Artificial Sequence: Synthetic peptide
  Seed: TEYKLVVVGAAGVGK (KRAS G12A)
TEYKLVVLGNAGYGK

SEQ ID NO: 558 - protein, 15 aa, Artificial Sequence
  Description of Artificial Sequence: Synthetic peptide
  Seed: TEYKLVVVGAAGVGK (KRAS G12A)
TEYKMVVYGNAGLGK

SEQ ID NO: 559 - protein, 15 aa, Artificial Sequence
  Description of Artificial Sequence: Synthetic peptide
  Seed: TEYKLVVVGAAGVGK (KRAS G12A)
TEYKIVVLGNAGYGK

SEQ ID NO: 560 - protein, 15 aa, Artificial Sequence
  Description of Artificial Sequence: Synthetic peptide
  Seed: TEYKLVVVGAAGVGK (KRAS G12A)
TEYKIVVWGNAGVGK

SEQ ID NO: 561 - protein, 15 aa, Artificial Sequence
  Description of Artificial Sequence: Synthetic peptide
  Seed: EYKLVVVGACGVGKS (KRAS G12C)
EYKFVVFGNCGAGKS

SEQ ID NO: 562 - protein, 15 aa, Artificial Sequence
  Description of Artificial Sequence: Synthetic peptide
  Seed: EYKLVVVGACGVGKS (KRAS G12C)
EYKFVVSGACGVGKS

SEQ ID NO: 563 - protein, 15 aa, Artificial Sequence
  Description of Artificial Sequence: Synthetic peptide
  Seed: EYKLVVVGACGVGKS (KRAS G12C)
EYKFVVSGNCGLGKS

SEQ ID NO: 564 - protein, 15 aa, Artificial Sequence
  Description of Artificial Sequence: Synthetic peptide
  Seed: EYKLVVVGACGVGKS (KRAS G12C)
EYKLVVMGPCGAGKS

SEQ ID NO: 565 - protein, 15 aa, Artificial Sequence
  Description of Artificial Sequence: Synthetic peptide
  Seed: KLVVVGACGVGKSAL (KRAS G12C)
KLVIVGMCRVGHSAL

SEQ ID NO: 566 - protein, 15 aa, Artificial Sequence
  Description of Artificial Sequence: Synthetic peptide
  Seed: EYKLVVVGACGVGKS (KRAS G12C)
EYKFVVSGACGIGKS

SEQ ID NO: 567 - protein, 15 aa, Artificial Sequence
  Description of Artificial Sequence: Synthetic peptide
  Seed: EYKLVVVGACGVGKS (KRAS G12C)
EYKLVVLGSCGAGKS

SEQ ID NO: 568 - protein, 15 aa, Artificial Sequence
  Description of Artificial Sequence: Synthetic peptide
  Seed: KLVVVGACGVGKSAL (KRAS G12C)
KLVIVGICRVGHSAL

SEQ ID NO: 569 - protein, 15 aa, Artificial Sequence
  Description of Artificial Sequence: Synthetic peptide
  Seed: EYKLVVVGADGVGKS (KRAS G12D)
EYKFVVFGSDGAGKS

SEQ ID NO: 570 - protein, 24 aa, Artificial Sequence
  Description of Artificial Sequence: Synthetic peptide
  Seed: EYKLVVVGADGVGKSALTIQLIQN (KRAS G12D)
EYKFVVIGNDGAGKSALTIQLIQN

SEQ ID NO: 571 - protein, 15 aa, Artificial Sequence
  Description of Artificial Sequence: Synthetic peptide
  Seed: EYKLVVVGADGVGKS (KRAS G12D)
EYKFVVLGADGAGKS

SEQ ID NO: 572 - protein, 20 aa, Artificial Sequence
  Description of Artificial Sequence: Synthetic peptide
  Seed: MTEYKLVVVGADGVGKSALT (KRAS G12D)
MTEYKFVVSGADGIGKSALT

SEQ ID NO: 573 - protein, 20 aa, Artificial Sequence
  Description of Artificial Sequence: Synthetic peptide
  Seed: MTEYKLVVVGADGVGKSALT (KRAS G12D)
MTEYKFVVYGSDGIGKSALT

SEQ ID NO: 574 - protein, 20 aa, Artificial Sequence
  Description of Artificial Sequence: Synthetic peptide
  Seed: MTEYKLVVVGADGVGKSALT (KRAS G12D)
MTEYKIVVMGIDGAGKSALT

SEQ ID NO: 575 - protein, 15 aa, Artificial Sequence
  Description of Artificial Sequence: Synthetic peptide
  Seed: EYKLVVVGADGVGKS (KRAS G12D)
EYKFVVSGADGIGKS

SEQ ID NO: 576 - protein, 15 aa, Artificial Sequence
  Description of Artificial Sequence: Synthetic peptide
  Seed: EYKLVVVGADGVGKS (KRAS G12D)
EYKIVVMGADGLGKS

SEQ ID NO: 577 - protein, 20 aa, Artificial Sequence
  Description of Artificial Sequence: Synthetic peptide
  Seed: MTEYKLVVVGADGVGKSALT (KRAS G12D)
MTEYKFVVYGNDGVGKSALT

SEQ ID NO: 578 - protein, 15 aa, Artificial Sequence
  Description of Artificial Sequence: Synthetic peptide
  Seed: TEYKLVVVGARGVGK (KRAS G12R)
TEYKFVVIGNRGLGK

SEQ ID NO: 579 - protein, 20 aa, Artificial Sequence
  Description of Artificial Sequence: Synthetic peptide
  Seed: TEYKLVVVGARGVGKSALTI (KRAS G12R)
TEYKFVVTGFRGLGKSALTI

SEQ ID NO: 580 - protein, 15 aa, Artificial Sequence
  Description of Artificial Sequence: Synthetic peptide
  Seed: TEYKLVVVGARGVGK (KRAS G12R)
TEYKIVVAGARGSGK

SEQ ID NO: 581 - protein, 20 aa, Artificial Sequence
  Description of Artificial Sequence: Synthetic peptide
  Seed: TEYKLVVVGARGVGKSALTI (KRAS G12R)
TEYKLVVIGTRGAGKSALTI

SEQ ID NO: 582 - protein, 20 aa, Artificial Sequence
  Description of Artificial Sequence: Synthetic peptide
  Seed: TEYKLVVVGARGVGKSALTI (KRAS G12R)
TEYRLVSVFARSVGKSALTI

SEQ ID NO: 583 - protein, 15 aa, Artificial Sequence
  Description of Artificial Sequence: Synthetic peptide
  Seed: TEYKLVVVGARGVGK (KRAS G12R)
TEYKFVVIGRRGSGK

SEQ ID NO: 584 - protein, 15 aa, Artificial Sequence
  Description of Artificial Sequence: Synthetic peptide
  Seed: TEYKLVVVGARGVGK (KRAS G12R)
TEYKLVVLGMRGYGK

SEQ ID NO: 585 - protein, 20 aa, Artificial Sequence
  Description of Artificial Sequence: Synthetic peptide
  Seed: TEYKLVVVGARGVGKSALTI (KRAS G12R)
TEYKFVVIGTRGAGKSALTI

SEQ ID NO: 586 - protein, 15 aa, Artificial Sequence
  Description of Artificial Sequence: Synthetic peptide
  Seed: TEYKLVVVGARGVGK (KRAS G12R)
TEYKIVVAGARGAGK

SEQ ID NO: 587 - protein, 20 aa, Artificial Sequence
  Description of Artificial Sequence: Synthetic peptide
  Seed: TEYKLVVVGARGVGKSALTI (KRAS G12R)
TEYRLVSVLAREVGKSALTI

SEQ ID NO: 588 - protein, 15 aa, Artificial Sequence
  Description of Artificial Sequence: Synthetic peptide
  Seed: EYKLVVVGASGVGKS (KRAS G12S)
EYKFVVIGSSGLGKS

SEQ ID NO: 589 - protein, 15 aa, Artificial Sequence
  Description of Artificial Sequence: Synthetic peptide
  Seed: EYKLVVVGASGVGKS (KRAS G12S)
EYKFVVMGASGIGKS

SEQ ID NO: 590 - protein, 15 aa, Artificial Sequence
  Description of Artificial Sequence: Synthetic peptide
  Seed: EYKLVVVGASGVGKS (KRAS G12S)
EYKIVVFGNSGAGKS

SEQ ID NO: 591 - protein, 15 aa, Artificial Sequence
  Description of Artificial Sequence: Synthetic peptide
  Seed: EYKLVVVGASGVGKS (KRAS G12S)
EYKIVVMGRSGMGKS

SEQ ID NO: 592 - protein, 15 aa, Artificial Sequence
  Description of Artificial Sequence: Synthetic peptide
  Seed: YKLVVVGASGVGKSA (KRAS G12S)
YKIVVLGASGYGKSA

SEQ ID NO: 593 - protein, 15 aa, Artificial Sequence
  Description of Artificial Sequence: Synthetic peptide
  Seed: EYKLVVVGASGVGKS (KRAS G12S)
EYKIVVFGSSGAGKS

SEQ ID NO: 594 - protein, 15 aa, Artificial Sequence
  Description of Artificial Sequence: Synthetic peptide
  Seed: EYKLVVVGASGVGKS (KRAS G12S)
EYKIVVMGRSGLGKS

SEQ ID NO: 595 - protein, 15 aa, Artificial Sequence
  Description of Artificial Sequence: Synthetic peptide
  Seed: YKLVVVGASGVGKSA (KRAS G12S)
YKIVVLGASGFGKSA

SEQ ID NO: 596 - protein, 15 aa, Artificial Sequence
  Description of Artificial Sequence: Synthetic peptide
  Seed: EYKLVVVGAVGVGKS (KRAS G12V)
EYKFVVIGRVGHGKS

SEQ ID NO: 597 - protein, 15 aa, Artificial Sequence
  Description of Artificial Sequence: Synthetic peptide
  Seed: EYKLVVVGAVGVGKS (KRAS G12V)
EYKFVVLGTVGHGKS

SEQ ID NO: 598 - protein, 15 aa, Artificial Sequence
  Description of Artificial Sequence: Synthetic peptide
  Seed: EYKLVVVGAVGVGKS (KRAS G12V)
EYKFVVYGNVGVGKS

SEQ ID NO: 599 - protein, 15 aa, Artificial Sequence
  Description of Artificial Sequence: Synthetic peptide
  Seed: EYKLVVVGAVGVGKS (KRAS G12V)
EYKIVVAGNVGIGKS

SEQ ID NO: 600 - protein, 15 aa, Artificial Sequence
  Description of Artificial Sequence: Synthetic peptide
  Seed: TEYKLVVVGAVGVGK (KRAS G12V)
TEYKIVVMGNVGYGK

SEQ ID NO: 601 - protein, 15 aa, Artificial Sequence
  Description of Artificial Sequence: Synthetic peptide
  Seed: EYKLVVVGAVGVGKS (KRAS G12V)
EYKFVVNGAVGVGKS

SEQ ID NO: 602 - protein, 15 aa, Artificial Sequence
  Description of Artificial Sequence: Synthetic peptide
  Seed: EYKLVVVGAVGVGKS (KRAS G12V)
EYKIVVMGNVGYGKS

SEQ ID NO: 603 - protein, 15 aa, Artificial Sequence
  Description of Artificial Sequence: Synthetic peptide
  Seed: EYKLVVVGAVGVGKS (KRAS G12V)
EYKLVVLGRVGHGKS

SEQ ID NO: 604 - protein, 15 aa, Artificial Sequence
  Description of Artificial Sequence: Synthetic peptide
  Seed: EYKLVVVGAVGVGKS (KRAS G12V)
EYKFVVIGSVGAGKS

SEQ ID NO: 605 - protein, 15 aa, Artificial Sequence
  Description of Artificial Sequence: Synthetic peptide
  Seed: EYKLVVVGAVGVGKS (KRAS G12V)
EYKFVVWGNVGLGKS

SEQ ID NO: 606 - protein, 15 aa, Artificial Sequence
  Description of Artificial Sequence: Synthetic peptide
  Seed: EYKLVVVGAGDVGKS (KRAS G13D)
EYKFVVMGNGDSGKS

SEQ ID NO: 607 - protein, 15 aa, Artificial Sequence
  Description of Artificial Sequence: Synthetic peptide
  Seed: EYKLVVVGAGDVGKS (KRAS G13D)
EYKFVVSGSGDVGKS

SEQ ID NO: 608 - protein, 15 aa, Artificial Sequence
  Description of Artificial Sequence: Synthetic peptide
  Seed: EYKLVVVGAGDVGKS (KRAS G13D)
EYKFVVYGSGDLGKS

SEQ ID NO: 609 - protein, 15 aa, Artificial Sequence
  Description of Artificial Sequence: Synthetic peptide
  Seed: EYKLVVVGAGDVGKS (KRAS G13D)
EYKIVVMGRGDMGKS

SEQ ID NO: 610 - protein, 15 aa, Artificial Sequence
  Description of Artificial Sequence: Synthetic peptide
  Seed: EYKLVVVGAGDVGKS (KRAS G13D)
EYKLIVVSANDVAKS

SEQ ID NO: 611 - protein, 15 aa, Artificial Sequence
  Description of Artificial Sequence: Synthetic peptide
  Seed: EYKLVVVGAGDVGKS (KRAS G13D)
EYKLVVLGAGDAGKS

SEQ ID NO: 612 - protein, 25 aa, Artificial Sequence
  Description of Artificial Sequence: Synthetic peptide
  Seed: TEYKLVVVGAGDVGKSALTIQLIQN (KRAS G13D)
TEYKFVVVGFGDLGKSALTIQLIQN

SEQ ID NO: 613 - protein, 15 aa, Artificial Sequence
  Description of Artificial Sequence: Synthetic peptide
  Seed: EYKLVVVGAGDVGKS (KRAS G13D)
EYKFVVAGNGDIGKS

SEQ ID NO: 614 - protein, 15 aa, Artificial Sequence
  Description of Artificial Sequence: Synthetic peptide
  Seed: EYKLVVVGAGDVGKS (KRAS G13D)
EYKFVVFGNGDVGKS

SEQ ID NO: 615 - protein, 15 aa, Artificial Sequence
  Description of Artificial Sequence: Synthetic peptide
  Seed: EYKLVVVGAGDVGKS (KRAS G13D)
EYKIVVIGRGDMGKS

SEQ ID NO: 616 - protein, 20 aa, Artificial Sequence
  Description of Artificial Sequence: Synthetic peptide
  Seed: LDILDTAGKEEYSAMRDQYM (NRAS Q61K)
LDILNTAGKVEYAAMRDQYM

SEQ ID NO: 617 - protein, 20 aa, Artificial Sequence
  Description of Artificial Sequence: Synthetic peptide
  Seed: LDILDTAGKEEYSAMRDQYM (NRAS Q61K)
LDILNTASKIEYAAMRDQYM

SEQ ID NO: 618 - protein, 15 aa, Artificial Sequence
  Description of Artificial Sequence: Synthetic peptide
  Seed: LLDILDTAGKEEYSA (NRAS Q61K)
LLDFLDIAGKEVYSA

SEQ ID NO: 619 - protein, 15 aa, Artificial Sequence
  Description of Artificial Sequence: Synthetic peptide
  Seed: LLDILDTAGKEEYSA (NRAS Q61K)
LLDYLDMATKELYSA

SEQ ID NO: 620 - protein, 25 aa, Artificial Sequence
  Description of Artificial Sequence: Synthetic peptide
  Seed: QVVIDGETCLLDILDTAGKEEYSAM (NRAS Q61K)
QVVIDGETCLLDFLDTAFKELYSAM

SEQ ID NO: 621 - protein, 20 aa, Artificial Sequence
  Description of Artificial Sequence: Synthetic peptide
  Seed: LDILDTAGKEEYSAMRDQYM (NRAS Q61K)
LDILNTAAKIEYAAMRDQYM

SEQ ID NO: 622 - protein, 15 aa, Artificial Sequence
  Description of Artificial Sequence: Synthetic peptide
  Seed: LLDILDTAGKEEYSA (NRAS Q61K)
LLDFLDAAAKELYSA

SEQ ID NO: 623 - protein, 25 aa, Artificial Sequence
  Description of Artificial Sequence: Synthetic peptide
  Seed: QVVIDGETCLLDILDTAGKEEYSAM (NRAS Q61K)
QVVIDGETCLLDFLDSAFKELYSAM

SEQ ID NO: 624 - protein, 25 aa, Artificial Sequence
  Description of Artificial Sequence: Synthetic peptide
  Seed: QVVIDGETCLLDILDTAGKEEYSAM (NRAS Q61K)
QVVIDGETCLLDFLDTAFKEIYSAM

SEQ ID NO: 625 - protein, 16 aa, Artificial Sequence
  Description of Artificial Sequence: Synthetic peptide
  Seed: GETCLLDILDTAGLEE (NRAS Q61L)
GETCLLDFLDTAFLEY

SEQ ID NO: 626 - protein, 15 aa, Artificial Sequence
  Description of Artificial Sequence: Synthetic peptide
  Seed: LLDILDTAGLEEYSA (NRAS Q61L)
LLDFLDVATLEDYSA

SEQ ID NO: 627 - protein, 15 aa, Artificial Sequence
  Description of Artificial Sequence: Synthetic peptide
  Seed: LLDILDTAGLEEYSA (NRAS Q61L)
LLDLLDMANLEAYSA

SEQ ID NO: 628 - protein, 20 aa, Artificial Sequence
  Description of Artificial Sequence: Synthetic peptide
  Seed: TCLLDILDTAGLEEYSAMRD (NRAS Q61L)
TCLLDILNTAALAEYAAMRD

SEQ ID NO: 629 - protein, 20 aa, Artificial Sequence
  Description of Artificial Sequence: Synthetic peptide
  Seed: TCLLDILDTAGLEEYSAMRD (NRAS Q61L)
TCLLDILNTAALAEYSAMRD

SEQ ID NO: 630 - protein, 16 aa, Artificial Sequence
  Description of Artificial Sequence: Synthetic peptide
  Seed: GETCLLDILDTAGLEE (NRAS Q61L)
GETCLLDFLDHAFLEL

SEQ ID NO: 631 - protein, 15 aa, Artificial Sequence
  Description of Artificial Sequence: Synthetic peptide
  Seed: LLDILDTAGLEEYSA (NRAS Q61L)
LLDFLDIANLEDYSA

SEQ ID NO: 632 - protein, 15 aa, Artificial Sequence
  Description of Artificial Sequence: Synthetic peptide
  Seed: LLDILDTAGLEEYSA (NRAS Q61L)
LLDILDIANLESYSA

SEQ ID NO: 633 - protein, 20 aa, Artificial Sequence
  Description of Artificial Sequence: Synthetic peptide
  Seed: TCLLDILDTAGLEEYSAMRD (NRAS Q61L)
TCLLDILNTAALVEYAAMRD

SEQ ID NO: 634 - protein, 20 aa, Artificial Sequence
  Description of Artificial Sequence: Synthetic peptide
  Seed: LDILDTAGREEYSAMRDQYM (NRAS Q61R)
LDILVTAARIEYAAMRDQYM

SEQ ID NO: 635 - protein, 20 aa, Artificial Sequence
  Description of Artificial Sequence: Synthetic peptide
  Seed: LDILDTAGREEYSAMRDQYM (NRAS Q61R)
LDILVTASRIEYAAMRDQYM

SEQ ID NO: 636 - protein, 15 aa, Artificial Sequence
  Description of Artificial Sequence: Synthetic peptide
  Seed: LLDILDTAGREEYSA (NRAS Q61R)
LLDFLDAAVREVYSA

SEQ ID NO: 637 - protein, 15 aa, Artificial Sequence
  Description of Artificial Sequence: Synthetic peptide
  Seed: LLDILDTAGREEYSA (NRAS Q61R)
LLDFLDFAAREVYSA

SEQ ID NO: 638 - protein, 20 aa, Artificial Sequence
  Description of Artificial Sequence: Synthetic peptide
  Seed: TCLLDILDTAGREEYSAMRD (NRAS Q61R)
TCLLDFLDEAFREIYSAMRD

SEQ ID NO: 639 - protein, 15 aa, Artificial Sequence
  Description of Artificial Sequence: Synthetic peptide
  Seed: LLDILDTAGREEYSA (NRAS Q61R)
LLDFLDFAAREIYSA

SEQ ID NO: 640 - protein, 20 aa, Artificial Sequence
  Description of Artificial Sequence: Synthetic peptide
  Seed: TCLLDILDTAGREEYSAMRD (NRAS Q61R)
TCLLDFLDTAFREVYSAMRD

SEQ ID NO: 641 - protein, 20 aa, Artificial Sequence
  Description of Artificial Sequence: Synthetic peptide
  Seed: LDILDTAGREEYSAMRDQYM (NRAS Q61R)
LDILNTAARIEYAAMRDQYM

SEQ ID NO: 642 - protein, 15 aa, Artificial Sequence
  Description of Artificial Sequence: Synthetic peptide
  Seed: LLDILDTAGREEYSA (NRAS Q61R)
LLDFLDAAIREIYSA

SEQ ID NO: 643 - protein, 15 aa, Artificial Sequence
  Description of Artificial Sequence: Synthetic peptide
  Seed: LLDILDTAGREEYSA (NRAS Q61R)
LLDFLDFAARELYSA

SEQ ID NO: 644 - protein, 15 aa, Artificial Sequence
  Description of Artificial Sequence: Synthetic peptide
  Seed: LLDILDTAGREEYSA (NRAS Q61R)
LLDYLDAAGRELYSA

SEQ ID NO: 645 - protein, 20 aa, Artificial Sequence
  Description of Artificial Sequence: Synthetic peptide
  Seed: TCLLDILDTAGREEYSAMRD (NRAS Q61R)
TCLLDFLDTAFRELYSAMRD

SEQ ID NO: 646 - protein, 25 aa, Artificial Sequence
  Description of Artificial Sequence: Synthetic peptide
  Seed: RDPLSKITEQEKDFLWSHRHYCVTI (PIK3CA E542K)
RDPFSKSTFQEVDFLWSHRHYCVTI

SEQ ID NO: 647 - protein, 25 aa, Artificial Sequence
  Description of Artificial Sequence: Synthetic peptide
  Seed: RDPLSKITEQEKDFLWSHRHYCVTI (PIK3CA E542K)
RDPFSKTTFQEIDFLWSHRHYCVTI

SEQ ID NO: 648 - protein, 25 aa, Artificial Sequence
  Description of Artificial Sequence: Synthetic peptide
  Seed: RDPLSKITEQEKDFLWSHRHYCVTI (PIK3CA E542K)
RDPFSKTTFQELDFLWSHRHYCVTI

SEQ ID NO: 649 - protein, 25 aa, Artificial Sequence
  Description of Artificial Sequence: Synthetic peptide
  Seed: RDPLSKITEQEKDFLWSHRHYCVTI (PIK3CA E542K)
RDPFSKTTFQETDFLWSHRHYCVTI

SEQ ID NO: 650 - protein, 25 aa, Artificial Sequence
  Description of Artificial Sequence: Synthetic peptide
  Seed: RDPLSKITEQEKDFLWSHRHYCVTI (PIK3CA E542K)
RDPFSKTTFQEVDFLWSHRHYCVTI

SEQ ID NO: 651 - protein, 20 aa, Artificial Sequence
  Description of Artificial Sequence: Synthetic peptide
  Seed: LSEITKQEKDFLWSHRHYCV (PIK3CA E545K)
LSEIIKQWKAFLVSHRHYCV

SEQ ID NO: 652 - protein, 20 aa, Artificial Sequence
  Description of Artificial Sequence: Synthetic peptide
  Seed: LSEITKQEKDFLWSHRHYCV (PIK3CA E545K)
LSEIIKQYKIFLASHRHYCV

SEQ ID NO: 653 - protein, 20 aa, Artificial Sequence
  Description of Artificial Sequence: Synthetic peptide
  Seed: LSEITKQEKDFLWSHRHYCV (PIK3CA E545K)
LSEILKQMKAFLISHRHYCV

SEQ ID NO: 654 - protein, 20 aa, Artificial Sequence
  Description of Artificial Sequence: Synthetic peptide
  Seed: LSEITKQEKDFLWSHRHYCV (PIK3CA E545K)
LSEIVKQFKDFLASHRHYCV

SEQ ID NO: 655 - protein, 20 aa, Artificial Sequence
  Description of Artificial Sequence: Synthetic peptide
  Seed: LSEITKQEKDFLWSHRHYCV (PIK3CA E545K)
LSEIVKQFKDFLLSHRHYCV

SEQ ID NO: 656 - protein, 20 aa, Artificial Sequence
  Description of Artificial Sequence: Synthetic peptide
  Seed: LSEITKQEKDFLWSHRHYCV (PIK3CA E545K)
LSEIVKQMKAFLISHRHYCV

SEQ ID NO: 657 - protein, 20 aa, Artificial Sequence
  Description of Artificial Sequence: Synthetic peptide
  Seed: LSEITKQEKDFLWSHRHYCV (PIK3CA E545K)
LSEIIKQFKDFLISHRHYCV

SEQ ID NO: 658 - protein, 15 aa, Artificial Sequence
  Description of Artificial Sequence: Synthetic peptide
  Seed: ALEYFMKQMNDARHG (PIK3CA H1047R)
ALEYFFKQMNTARAG

SEQ ID NO: 659 - protein, 20 aa, Artificial Sequence
  Description of Artificial Sequence: Synthetic peptide
  Seed: ALEYFMKQMNDARHGGWTTK (PIK3CA H1047R)
ALEYFIKQMNRARLGGWTTK

SEQ ID NO: 660 - protein, 15 aa, Artificial Sequence
  Description of Artificial Sequence: Synthetic peptide
  Seed: ALEYFMKQMNDARHG (PIK3CA H1047R)
ALEYFLKQANRARSG

SEQ ID NO: 661 - protein, 20 aa, Artificial Sequence
  Description of Artificial Sequence: Synthetic peptide
  Seed: ALEYFMKQMNDARHGGWTTK (PIK3CA H1047R)
ALEYFLKQMNIARVGGWTTK

SEQ ID NO: 662 - protein, 15 aa, Artificial Sequence
  Description of Artificial Sequence: Synthetic peptide
  Seed: YFMKQMNDARHGGWT (PIK3CA H1047R)
YFFKQMNNARDGGWT

SEQ ID NO: 663 - protein, 15 aa, Artificial Sequence
  Description of Artificial Sequence: Synthetic peptide
  Seed: ALEYFMKQMNDARHG (PIK3CA H1047R)
ALEYFFKQINTARAG

SEQ ID NO: 664 - protein, 15 aa, Artificial Sequence
  Description of Artificial Sequence: Synthetic peptide
  Seed: ALEYFMKQMNDARHG (PIK3CA H1047R)
ALEYFIKQANRARHG

SEQ ID NO: 665 - protein, 20 aa, Artificial Sequence
  Description of Artificial Sequence: Synthetic peptide
  Seed: ALEYFMKQMNDARHGGWTTK (PIK3CA H1047R)
ALEYFIKQINRARVGGWTTK

SEQ ID NO: 666 - protein, 20 aa, Artificial Sequence
  Description of Artificial Sequence: Synthetic peptide
  Seed: ALEYFMKQMNDARHGGWTTK (PIK3CA H1047R)
ALEYFIKQMNAARVGGWTTK

SEQ ID NO: 667 - protein, 15 aa, Artificial Sequence
  Description of Artificial Sequence: Synthetic peptide
  Seed: YFMKQMNDARHGGWT (PIK3CA H1047R)
YFFKQMNSARDGGWT

SEQ ID NO: 668 - protein, 25 aa, Artificial Sequence
  Description of Artificial Sequence: Synthetic peptide
  Seed: AEREEFFDETRQLCDLRLFQPFLKV (PIK3CA R88Q)
AEREEFFDHTFQLVDLRLFQPFLKV

SEQ ID NO: 669 - protein, 25 aa, Artificial Sequence
  Description of Artificial Sequence: Synthetic peptide
  Seed: AEREEFFDETRQLCDLRLFQPFLKV (PIK3CA R88Q)
AEREEYFDLTPQLIDLRLFQPFLKV

SEQ ID NO: 670 - protein, 20 aa, Artificial Sequence
  Description of Artificial Sequence: Synthetic peptide
  Seed: EFFDETRQLCDLRLFQPFLK (PIK3CA R88Q)
EFFDEFRQFCALRIFQPFLK

SEQ ID NO: 671 - protein, 20 aa, Artificial Sequence
  Description of Artificial Sequence: Synthetic peptide
  Seed: EFFDETRQLCDLRLFQPFLK (PIK3CA R88Q)
EFFDETFQLTDFRLVQPFLK

SEQ ID NO: 672 - protein, 20 aa, Artificial Sequence
  Description of Artificial Sequence: Synthetic peptide
  Seed: FFDETRQLCDLRLFQPFLKV (PIK3CA R88Q)
FFDETFQLTDFRLLQPFLKV

SEQ ID NO: 673 - protein, 25 aa, Artificial Sequence
  Description of Artificial Sequence: Synthetic peptide
  Seed: AEREEFFDETRQLCDLRLFQPFLKV (PIK3CA R88Q)
AEREEFFDLTPQLIDLRLFQPFLKV

SEQ ID NO: 674 - protein, 25 aa, Artificial Sequence
  Description of Artificial Sequence: Synthetic peptide
  Seed: AEREEFFDETRQLCDLRLFQPFLKV (PIK3CA R88Q)
AEREEFFDSTFQLVDLRLFQPFLKV

SEQ ID NO: 675 - protein, 20 aa, Artificial Sequence
  Description of Artificial Sequence: Synthetic peptide
  Seed: FFDETRQLCDLRLFQPFLKV (PIK3CA R88Q)
FFDETFQLTDFRLVQPFLKV

SEQ ID NO: 676 - protein, 15 aa, Artificial Sequence
  Description of Artificial Sequence: Synthetic peptide
  Seed: KAGKGGTGVMICAYL (PTEN R130G)
KAGIGGAGAMIAAYL

SEQ ID NO: 677 - protein, 15 aa, Artificial Sequence
  Description of Artificial Sequence: Synthetic peptide
  Seed: KAGKGGTGVMICAYL (PTEN R130G)
KAGIGGAGAMISAYL

SEQ ID NO: 678 - protein, 15 aa, Artificial Sequence
  Description of Artificial Sequence: Synthetic peptide
  Seed: KAGKGGTGVMICAYL (PTEN R130G)
KAGMGGAGAMIAAYL

SEQ ID NO: 679 - protein, 15 aa, Artificial Sequence
  Description of Artificial Sequence: Synthetic peptide
  Seed: KAGKGGTGVMICAYL (PTEN R130G)
KAGMGGAGAMISAYL

SEQ ID NO: 680 - protein, 15 aa, Artificial Sequence
  Description of Artificial Sequence: Synthetic peptide
  Seed: KAGKGGTGVMICAYL (PTEN R130G)
KAGVGGAGAMIAAYL

SEQ ID NO: 681 - protein, 23 aa, Artificial Sequence
  Description of Artificial Sequence: Synthetic peptide
  Seed: AAIHCKAGKGQTGVMICAYLLHR (PTEN R130Q)
AAIHWKAAKPQTAVMICAYLLHR

SEQ ID NO: 682 - protein, 23 aa, Artificial Sequence
  Description of Artificial Sequence: Synthetic peptide
  Seed: AAIHCKAGKGQTGVMICAYLLHR (PTEN R130Q)
AAIHYKAGKAQTIVMICAYLLHR

SEQ ID NO: 683 - protein, 20 aa, Artificial Sequence
  Description of Artificial Sequence: Synthetic peptide
  Seed: AIHCKAGKGQTGVMICAYLL (PTEN R130Q)
AIHLKAAKPQTAVMICAYLL

SEQ ID NO: 684 - protein, 20 aa, Artificial Sequence
  Description of Artificial Sequence: Synthetic peptide
  Seed: AIHCKAGKGQTGVMICAYLL (PTEN R130Q)
AIHVKAAKAQTAVMICAYLL

SEQ ID NO: 685 - protein, 20 aa, Artificial Sequence
  Description of Artificial Sequence: Synthetic peptide
  Seed: AIHCKAGKGQTGVMICAYLL (PTEN R130Q)
AIHVKAAKPQTAVMICAYLL

SEQ ID NO: 686 - protein, 23 aa, Artificial Sequence
  Description of Artificial Sequence: Synthetic peptide
  Seed: AAIHCKAGKGQTGVMICAYLLHR (PTEN R130Q)
AAIHIKAAKAQTAVMICAYLLHR

SEQ ID NO: 687 - protein, 23 aa, Artificial Sequence
  Description of Artificial Sequence: Synthetic peptide
  Seed: AAIHCKAGKGQTGVMICAYLLHR (PTEN R130Q)
AAIHIKAAKPQTAVMICAYLLHR

SEQ ID NO: 688 - protein, 23 aa, Artificial Sequence
  Description of Artificial Sequence: Synthetic peptide
  Seed: AAIHCKAGKGQTGVMICAYLLHR (PTEN R130Q)
AAIHNKAAKIQTVVMICAYLLHR

SEQ ID NO: 689 - protein, 15 aa, Artificial Sequence
  Description of Artificial Sequence: Synthetic peptide
  Seed: AIHCKAGKGQTGVMI (PTEN R130Q)
AIHIKAAKAQTAVMI

SEQ ID NO: 690 - protein, 20 aa, Artificial Sequence
  Description of Artificial Sequence: Synthetic peptide
  Seed: AIHCKAGKGQTGVMICAYLL (PTEN R130Q)
AIHIKAAKAQTAVMICAYLL

SEQ ID NO: 691 - protein, 20 aa, Artificial Sequence
  Description of Artificial Sequence: Synthetic peptide
  Seed: KQSQHMTEVVRRCPHRERCS (TP53 H179R)
KQSQHMTEVIRRIPRRERCS

SEQ ID NO: 692 - protein, 20 aa, Artificial Sequence
  Description of Artificial Sequence: Synthetic peptide
  Seed: KQSQHMTEVVRRCPHRERCS (TP53 H179R)
KQSQHMTEVIRRMPRRERCS

SEQ ID NO: 693 - protein, 25 aa, Artificial Sequence
  Description of Artificial Sequence: Synthetic peptide
  Seed: MAIYKQSQHMTEVVRRCPHRERCSD (TP53 H179R)
MAIYKQSQHMTEVIRRMPRREVCSD

SEQ ID NO: 694 - protein, 15 aa, Artificial Sequence
  Description of Artificial Sequence: Synthetic peptide
  Seed: QHMTEVVRRCPHRER (TP53 H179R)
QHMTELVRICKHRAR

SEQ ID NO: 695 - protein, 15 aa, Artificial Sequence
  Description of Artificial Sequence: Synthetic peptide
  Seed: QHMTEVVRRCPHRER (TP53 H179R)
QHMTEMVRLCRHRAR

SEQ ID NO: 696 - protein, 20 aa, Artificial Sequence
  Description of Artificial Sequence: Synthetic peptide
  Seed: KQSQHMTEVVRRCPHRERCS (TP53 H179R)
KQSQHMTEVIRRFPRREICS

SEQ ID NO: 697 - protein, 20 aa, Artificial Sequence
  Description of Artificial Sequence: Synthetic peptide
  Seed: KQSQHMTEVVRRCPHRERCS (TP53 H179R)
KQSQHMTEVIRRMPRREVCS

SEQ ID NO: 698 - protein, 15 aa, Artificial Sequence
  Description of Artificial Sequence: Synthetic peptide
  Seed: QHMTEVVRRCPHRER (TP53 H179R)
QHMTEIVRICRHRAR

SEQ ID NO: 699 - protein, 15 aa, Artificial Sequence
  Description of Artificial Sequence: Synthetic peptide
  Seed: QHMTEVVRRCPHRER (TP53 H179R)
QHMTELVRLCSHRSR

SEQ ID NO: 700 - protein, 15 aa, Artificial Sequence
  Description of Artificial Sequence: Synthetic peptide
  Seed: PGTRVLAMAIYKQSQ (TP53 R158L)
PGTFVLSMSIYEQSQ

SEQ ID NO: 701 - protein, 15 aa, Artificial Sequence
  Description of Artificial Sequence: Synthetic peptide
  Seed: PGTRVLAMAIYKQSQ (TP53 R158L)
PGTRFLAIASYKVSQ

SEQ ID NO: 702 - protein, 16 aa, Artificial Sequence
  Description of Artificial Sequence: Synthetic peptide
  Seed: PGTRVLAMAIYKQSQH (TP53 R158L)
PGTRFLATAFYKLSQH

SEQ ID NO: 703 - protein, 15 aa, Artificial Sequence
  Description of Artificial Sequence: Synthetic peptide
  Seed: PGTRVLAMAIYKQSQ (TP53 R158L)
PGTRILALAKYKFSQ

SEQ ID NO: 704 - protein, 14 aa, Artificial Sequence
  Description of Artificial Sequence: Synthetic peptide
  Seed: PGTRVLAMAIYKQS (TP53 R158L)
PGTRILATAFYKLS

SEQ ID NO: 705 - protein, 15 aa, Artificial Sequence
  Description of Artificial Sequence: Synthetic peptide
  Seed: PGTRVLAMAIYKQSQ (TP53 R158L)
PGTRILAAATYKASQ

SEQ ID NO: 706 - protein, 15 aa, Artificial Sequence
  Description of Artificial Sequence: Synthetic peptide
  Seed: PGTRVLAMAIYKQSQ (TP53 R158L)
PGTFVLAMPIYNQSQ

SEQ ID NO: 707 - protein, 14 aa, Artificial Sequence
  Description of Artificial Sequence: Synthetic peptide
  Seed: PGTRVLAMAIYKQS (TP53 R158L)
PGTRFLAAAFYKFS

SEQ ID NO: 708 - protein, 20 aa, Artificial Sequence
  Description of Artificial Sequence: Synthetic peptide
  Seed: AIYKQSQHMTEVVRHCPHHE (TP53 R175H)
AIYKQSQYMTLVVRHVPHHE

SEQ ID NO: 709 - protein, 20 aa, Artificial Sequence
  Description of Artificial Sequence: Synthetic peptide
  Seed: AIYKQSQHMTEVVRHCPHHE (TP53 R175H)
AIYKQSQYMTVVLRHAPHHE

SEQ ID NO: 710 - protein, 20 aa, Artificial Sequence
  Description of Artificial Sequence: Synthetic peptide
  Seed: MAIYKQSQHMTEVVRHCPHH (TP53 R175H)
MAIYKQSQFMTAVMRHIPHH

SEQ ID NO: 711 - protein, 20 aa, Artificial Sequence
  Description of Artificial Sequence: Synthetic peptide
  Seed: MAIYKQSQHMTEVVRHCPHH (TP53 R175H)
MAIYKQSQFMTTVVRHVPHH

SEQ ID NO: 712 - protein, 20 aa, Artificial Sequence
  Description of Artificial Sequence: Synthetic peptide
  Seed: MAIYKQSQHMTEVVRHCPHH (TP53 R175H)
MAIYKQSQYMTLVMRHVPHH

SEQ ID NO: 713 - protein, 20 aa, Artificial Sequence
  Description of Artificial Sequence: Synthetic peptide
  Seed: AIYKQSQHMTEVVRHCPHHE (TP53 R175H)
AIYKQSQFMTLVARHAPHHE

SEQ ID NO: 714 - protein, 20 aa, Artificial Sequence
  Description of Artificial Sequence: Synthetic peptide
  Seed: AIYKQSQHMTEVVRHCPHHE (TP53 R175H)
AIYKQSQFMTMVARHNPHHE

SEQ ID NO: 715 - protein, 20 aa, Artificial Sequence
  Description of Artificial Sequence: Synthetic peptide
  Seed: MAIYKQSQHMTEVVRHCPHH (TP53 R175H)
MAIYKQSQFMTIVARHVPHH

SEQ ID NO: 716 - protein, 20 aa, Artificial Sequence
  Description of Artificial Sequence: Synthetic peptide
  Seed: MAIYKQSQHMTEVVRHCPHH (TP53 R175H)
MAIYKQSQFMTLVARHVPHH

SEQ ID NO: 717 - protein, 20 aa, Artificial Sequence
  Description of Artificial Sequence: Synthetic peptide
  Seed: MAIYKQSQHMTEVVRHCPHH (TP53 R175H)
MAIYKQSQFMTMVIRHLPHH

SEQ ID NO: 718 - protein, 15 aa, Artificial Sequence
  Description of Artificial Sequence: Synthetic peptide
  Seed: MGGMNQRPILTIITL (TP53 R248Q)
MGGINQFPDLTIITL

SEQ ID NO: 719 - protein, 15 aa, Artificial Sequence
  Description of Artificial Sequence: Synthetic peptide
  Seed: MGGMNQRPILTIITL (TP53 R248Q)
MGGINQIPALTRITL

SEQ ID NO: 720 - protein, 15 aa, Artificial Sequence
  Description of Artificial Sequence: Synthetic peptide
  Seed: MGGMNQRPILTIITL (TP53 R248Q)
MGGINQLPRLTSITL

SEQ ID NO: 721 - protein, 25 aa, Artificial Sequence
  Description of Artificial Sequence: Synthetic peptide
  Seed: YMCNSSCMGGMNQRPILTIITLEDS (TP53 R248Q)
YMCNSSCMGGFNQTPFLTVITLEDS

SEQ ID NO: 722 - protein, 20 aa, Artificial Sequence
  Description of Artificial Sequence: Synthetic peptide
  Seed: YMCNSSCMGGMNQRPILTII (TP53 R248Q)
YMCNSSNMGSMAQRSILTII

SEQ ID NO: 723 - protein, 20 aa, Artificial Sequence
  Description of Artificial Sequence: Synthetic peptide
  Seed: YMCNSSCMGGMNQRPILTII (TP53 R248Q)
YMCNSSNMGAMVQRAILTII

SEQ ID NO: 724 - protein, 15 aa, Artificial Sequence
  Description of Artificial Sequence: Synthetic peptide
  Seed: CMGGMNWRPILTIIT (TP53 R248W)
CMGGFNWTPFLTVIT

SEQ ID NO: 725 - protein, 15 aa, Artificial Sequence
  Description of Artificial Sequence: Synthetic peptide
  Seed: MGGMNWRPILTIITL (TP53 R248W)
MGGINWHPSLTIITL

SEQ ID NO: 726 - protein, 15 aa, Artificial Sequence
  Description of Artificial Sequence: Synthetic peptide
  Seed: MGGMNWRPILTIITL (TP53 R248W)
MGGINWVPKLTVITL

SEQ ID NO: 727 - protein, 15 aa, Artificial Sequence
  Description of Artificial Sequence: Synthetic peptide
  Seed: MGGMNWRPILTIITL (TP53 R248W)
MGGLNWFPALTRITL

SEQ ID NO: 728 - protein, 15 aa, Artificial Sequence
  Description of Artificial Sequence: Synthetic peptide
  Seed: SCMGGMNWRPILTII (TP53 R248W)
SCMGGFNWMPALTII

SEQ ID NO: 729 - protein, 15 aa, Artificial Sequence
  Description of Artificial Sequence: Synthetic peptide
  Seed: MGGMNWRPILTIITL (TP53 R248W)
MGGINWFPALTRITL

SEQ ID NO: 730 - protein, 15 aa, Artificial Sequence
  Description of Artificial Sequence: Synthetic peptide
  Seed: MGGMNWRPILTIITL (TP53 R248W)
MGGINWHPALTLITL

SEQ ID NO: 731 - protein, 15 aa, Artificial Sequence
  Description of Artificial Sequence: Synthetic peptide
  Seed: MGGMNWRPILTIITL (TP53 R248W)
MGGINWIPKLTLITL

SEQ ID NO: 732 - protein, 15 aa, Artificial Sequence
  Description of Artificial Sequence: Synthetic peptide
  Seed: SCMGGMNWRPILTII (TP53 R248W)
SCMGGINWLPALTII

SEQ ID NO: 733 - protein, 15 aa, Artificial Sequence
  Description of Artificial Sequence: Synthetic peptide
  Seed: SFEVCVCACPGRDRR (TP53 R273C)
SFFVCVCACPTRDRR

SEQ ID NO: 734 - protein, 15 aa, Artificial Sequence
  Description of Artificial Sequence: Synthetic peptide
  Seed: SFEVCVCACPGRDRR (TP53 R273C)
SFFVCVCSCPLRDRR

SEQ ID NO: 735 - protein, 15 aa, Artificial Sequence
  Description of Artificial Sequence: Synthetic peptide
  Seed: SFEVCVCACPGRDRR (TP53 R273C)
SFYVCFCACPMRDRR

SEQ ID NO: 736 - protein, 15 aa, Artificial Sequence
  Description of Artificial Sequence: Synthetic peptide
  Seed: SFEVCVCACPGRDRR (TP53 R273C)
SFYVCICTCPVRDRR

SEQ ID NO: 737 - protein, 15 aa, Artificial Sequence
  Description of Artificial Sequence: Synthetic peptide
  Seed: SFEVCVCACPGRDRR (TP53 R273C)
SFYVCVCTCPARDRR

SEQ ID NO: 738 - protein, 15 aa, Artificial Sequence
  Description of Artificial Sequence: Synthetic peptide
  Seed: SFEVCVCACPGRDRR (TP53 R273C)
SFYVCVCTCPLRDRR

SEQ ID NO: 739 - protein, 15 aa, Artificial Sequence
  Description of Artificial Sequence: Synthetic peptide
  Seed: SFEVCVCACPGRDRR (TP53 R273C)
SFFVCLCACPARDRR

SEQ ID NO: 740 - protein, 15 aa, Artificial Sequence
  Description of Artificial Sequence: Synthetic peptide
  Seed: LLGRNSFEVHVCACP (TP53 R273H)
LLGFNSLEIHVLACP

SEQ ID NO: 741 - protein, 15 aa, Artificial Sequence
  Description of Artificial Sequence: Synthetic peptide
  Seed: LLGRNSFEVHVCACP (TP53 R273H)
LLGINSFEDHVAACP

SEQ ID NO: 742 - protein, 20 aa, Artificial Sequence
  Description of Artificial Sequence: Synthetic peptide
  Seed: SGNLLGRNSFEVHVCACPGR (TP53 R273H)
SGNLLGFNSLEFHVVACPGR

SEQ ID NO: 743 - protein, 25 aa, Artificial Sequence
  Description of Artificial Sequence: Synthetic peptide
  Seed: SGNLLGRNSFEVHVCACPGRDRRTE (TP53 R273H)
SGNLLGRNSFYVHLCPCPARDRRTE

SEQ ID NO: 744 - protein, 25 aa, Artificial Sequence
  Description of Artificial Sequence: Synthetic peptide
  Seed: SGNLLGRNSFEVHVCACPGRDRRTE (TP53 R273H)
SGNLLGRNSFYVHVCTCPVRDRRTE

SEQ ID NO: 745 - protein, 15 aa, Artificial Sequence
  Description of Artificial Sequence: Synthetic peptide
  Seed: LLGRNSFEVHVCACP (TP53 R273H)
LLGFNSFEAHVLACP

SEQ ID NO: 746 - protein, 15 aa, Artificial Sequence
  Description of Artificial Sequence: Synthetic peptide
  Seed: LLGRNSFEVHVCACP (TP53 R273H)
LLGFNSLEIHVIACP

SEQ ID NO: 747 - protein, 15 aa, Artificial Sequence
  Description of Artificial Sequence: Synthetic peptide
  Seed: LLGRNSFEVHVCACP (TP53 R273H)
LLGINSFEAHVLACP

SEQ ID NO: 748 - protein, 25 aa, Artificial Sequence
  Description of Artificial Sequence: Synthetic peptide
  Seed: SGNLLGRNSFEVHVCACPGRDRRTE (TP53 R273H)
SGNLLGRNSFFVHMCACPVRDRRTE

SEQ ID NO: 749 - protein, 17 aa, Artificial Sequence
  Description of Artificial Sequence: Synthetic peptide
  Seed: FEVRVCACPGRDWRTEE (TP53 R282W)
FEVRVCICPARIWRAEE

SEQ ID NO: 750 - protein, 17 aa, Artificial Sequence
  Description of Artificial Sequence: Synthetic peptide
  Seed: FEVRVCACPGRDWRTEE (TP53 R282W)
FEVRVCICPARVWRAEE

SEQ ID NO: 751 - protein, 16 aa, Artificial Sequence
  Description of Artificial Sequence: Synthetic peptide
  Seed: RNTFRHSVVVPCEPPE (TP53 Y220C)
RNTFFHSLVFPCLPPE

SEQ ID NO: 752 - protein, 16 aa, Artificial Sequence
  Description of Artificial Sequence: Synthetic peptide
  Seed: RNTFRHSVVVPCEPPE (TP53 Y220C)
RNTFRHSIVAPCAPPE

SEQ ID NO: 753 - protein, 16 aa, Artificial Sequence
  Description of Artificial Sequence: Synthetic peptide
  Seed: RNTFRHSVVVPCEPPE (TP53 Y220C)
RNTFRHSIVAPCVPPE

SEQ ID NO: 754 - protein, 16 aa, Artificial Sequence
  Description of Artificial Sequence: Synthetic peptide
  Seed: TFRHSVVVPCEPPEVG (TP53 Y220C)
TFFHSSVFPCIPPEVG

SEQ ID NO: 755 - protein, 16 aa, Artificial Sequence
  Description of Artificial Sequence: Synthetic peptide
  Seed: TFRHSVVVPCEPPEVG (TP53 Y220C)
TFFHSTVFPCIPPEVG

SEQ ID NO: 756 - protein, 16 aa, Artificial Sequence
  Description of Artificial Sequence: Synthetic peptide
  Seed: RNTFRHSVVVPCEPPE (TP53 Y220C)
RNTFRHSLVAPCVPPE

SEQ ID NO: 757 - protein, 16 aa, Artificial Sequence
  Description of Artificial Sequence: Synthetic peptide
  Seed: TFRHSVVVPCEPPEVG (TP53 Y220C)
TFFHSLVFPCLPPEVG

SEQ ID NO: 758 - protein, 16 aa, Artificial Sequence
  Description of Artificial Sequence: Synthetic peptide
  Seed: TFRHSVVVPCEPPEVG (TP53 Y220C)
TFFHSTVFPCLPPEVG

SEQ ID NO: 759 - protein, 15 aa, Homo sapiens
  Native (KRAS G13D)
YKLVVVGAGDVGKSA

SEQ ID NO: 760 - protein, 10 aa, Artificial Sequence
  Description of Artificial Sequence: Synthetic peptide
  Seed: KRGKYIKTWR (AKT1 E17K)
KAGKYIKTWK

SEQ ID NO: 761 - protein, 10 aa, Artificial Sequence
  Description of Artificial Sequence: Synthetic peptide
  Seed: KRGKYIKTWR (AKT1 E17K)
KAGKYIKTWR

SEQ ID NO: 762 - protein, 9 aa, Artificial Sequence
  Description of Artificial Sequence: Synthetic peptide
  Seed: KYIKTWRPR (AKT1 E17K)
KAIKTWRPA

SEQ ID NO: 763 - protein, 9 aa, Artificial Sequence
  Description of Artificial Sequence: Synthetic peptide
  Seed: KYIKTWRPR (AKT1 E17K)
KAIKTWRPC

SEQ ID NO: 764 - protein, 9 aa, Artificial Sequence
  Description of Artificial Sequence: Synthetic peptide
  Seed: KYIKTWRPR (AKT1 E17K)
KAIKTWRPF

SEQ ID NO: 765 - protein, 9 aa, Artificial Sequence
  Description of Artificial Sequence: Synthetic peptide
  Seed: KYIKTWRPR (AKT1 E17K)
KAIKTWRPG

SEQ ID NO: 766 - protein, 9 aa, Artificial Sequence
  Description of Artificial Sequence: Synthetic peptide
  Seed: KYIKTWRPR (AKT1 E17K)
KAIKTWRPH

SEQ ID NO: 767 - protein, 9 aa, Artificial Sequence
  Description of Artificial Sequence: Synthetic peptide
  Seed: KYIKTWRPR (AKT1 E17K)
KAIKTWRPI

SEQ ID NO: 768 - protein, 9 aa, Artificial Sequence
  Description of Artificial Sequence: Synthetic peptide
  Seed: KYIKTWRPR (AKT1 E17K)
KAIKTWRPK

SEQ ID NO: 769 - protein, 9 aa, Artificial Sequence
  Description of Artificial Sequence: Synthetic peptide
  Seed: KYIKTWRPR (AKT1 E17K)
KAIKTWRPL

SEQ ID NO: 770 - protein, 9 aa, Artificial Sequence
  Description of Artificial Sequence: Synthetic peptide
  Seed: KYIKTWRPR (AKT1 E17K)
KAIKTWRPM

SEQ ID NO: 771 - protein, 9 aa, Artificial Sequence
  Description of Artificial Sequence: Synthetic peptide
  Seed: KYIKTWRPR (AKT1 E17K)
KAIKTWRPP

SEQ ID NO: 772 - protein, 9 aa, Artificial Sequence
  Description of Artificial Sequence: Synthetic peptide
  Seed: KYIKTWRPR (AKT1 E17K)
KAIKTWRPQ

SEQ ID NO: 773 - protein, 9 aa, Artificial Sequence
  Description of Artificial Sequence: Synthetic peptide
  Seed: KYIKTWRPR (AKT1 E17K)
KAIKTWRPR

SEQ ID NO: 774 - protein, 10 aa, Artificial Sequence
  Description of Artificial Sequence: Synthetic peptide
  Seed: KYIKTWRPRY (AKT1 E17K)
KAIKTWRPRA

SEQ ID NO: 775 - protein, 10 aa, Artificial Sequence
  Description of Artificial Sequence: Synthetic peptide
  Seed: KYIKTWRPRY (AKT1 E17K)
KAIKTWRPRC

SEQ ID NO: 776 - protein, 10 aa, Artificial Sequence
  Description of Artificial Sequence: Synthetic peptide
  Seed: KYIKTWRPRY (AKT1 E17K)
KAIKTWRPRD

SEQ ID NO: 777 - protein, 10 aa, Artificial Sequence
  Description of Artificial Sequence: Synthetic peptide
  Seed: KYIKTWRPRY (AKT1 E17K)
KAIKTWRPRE

SEQ ID NO: 778 - protein, 10 aa, Artificial Sequence
  Description of Artificial Sequence: Synthetic peptide
  Seed: KYIKTWRPRY (AKT1 E17K)
KAIKTWRPRF

SEQ ID NO: 779 - protein, 10 aa, Artificial Sequence
  Description of Artificial Sequence: Synthetic peptide
  Seed: KYIKTWRPRY (AKT1 E17K)
KAIKTWRPRG

SEQ ID NO: 780 - protein, 10 aa, Artificial Sequence
  Description of Artificial Sequence: Synthetic peptide
  Seed: KYIKTWRPRY (AKT1 E17K)
KAIKTWRPRH

SEQ ID NO: 781 - protein, 10 aa, Artificial Sequence
  Description of Artificial Sequence: Synthetic peptide
  Seed: KYIKTWRPRY (AKT1 E17K)
KAIKTWRPRI

SEQ ID NO: 782 - protein, 10 aa, Artificial Sequence
  Description of Artificial Sequence: Synthetic peptide
  Seed: KYIKTWRPRY (AKT1 E17K)
KAIKTWRPRK

SEQ ID NO: 783 - protein, 10 aa, Artificial Sequence
  Description of Artificial Sequence: Synthetic peptide
  Seed: KYIKTWRPRY (AKT1 E17K)
KAIKTWRPRL

SEQ ID NO: 784 - protein, 10 aa, Artificial Sequence
  Description of Artificial Sequence: Synthetic peptide
  Seed: KYIKTWRPRY (AKT1 E17K)
KAIKTWRPRM

SEQ ID NO: 785 - protein, 10 aa, Artificial Sequence
  Description of Artificial Sequence: Synthetic peptide
  Seed: KYIKTWRPRY (AKT1 E17K)
KAIKTWRPRN

SEQ ID NO: 786 - protein, 10 aa, Artificial Sequence
  Description of Artificial Sequence: Synthetic peptide
  Seed: KYIKTWRPRY (AKT1 E17K)
KAIKTWRPRP

SEQ ID NO: 787 - protein, 10 aa, Artificial Sequence
  Description of Artificial Sequence: Synthetic peptide
  Seed: KYIKTWRPRY (AKT1 E17K)
KAIKTWRPRQ

SEQ ID NO: 788 - protein, 10 aa, Artificial Sequence
  Description of Artificial Sequence: Synthetic peptide
  Seed: KYIKTWRPRY (AKT1 E17K)
KAIKTWRPRR

SEQ ID NO: 789 - protein, 10 aa, Artificial Sequence
  Description of Artificial Sequence: Synthetic peptide
  Seed: KYIKTWRPRY (AKT1 E17K)
KAIKTWRPRS

SEQ ID NO: 790 - protein, 10 aa, Artificial Sequence
  Description of Artificial Sequence: Synthetic peptide
  Seed: KYIKTWRPRY (AKT1 E17K)
KAIKTWRPRT

SEQ ID NO: 791 - protein, 10 aa, Artificial Sequence
  Description of Artificial Sequence: Synthetic peptide
  Seed: KYIKTWRPRY (AKT1 E17K)
KAIKTWRPRV

SEQ ID NO: 792 - protein, 10 aa, Artificial Sequence
  Description of Artificial Sequence: Synthetic peptide
  Seed: KYIKTWRPRY (AKT1 E17K)
KAIKTWRPRW

SEQ ID NO: 793 - protein, 10 aa, Artificial Sequence
  Description of Artificial Sequence: Synthetic peptide
  Seed: KYIKTWRPRY (AKT1 E17K)
KAIKTWRPRY

SEQ ID NO: 794 - protein, 9 aa, Artificial Sequence
  Description of Artificial Sequence: Synthetic peptide
  Seed: KYIKTWRPR (AKT1 E17K)
KAIKTWRPS

SEQ ID NO: 795 - protein, 9 aa, Artificial Sequence
  Description of Artificial Sequence: Synthetic peptide
  Seed: KYIKTWRPR (AKT1 E17K)
KAIKTWRPT

SEQ ID NO: 796 - protein, 9 aa, Artificial Sequence
  Description of Artificial Sequence: Synthetic peptide
  Seed: KYIKTWRPR (AKT1 E17K)
KAIKTWRPV

SEQ ID NO: 797 - protein, 9 aa, Artificial Sequence
  Description of Artificial Sequence: Synthetic peptide
  Seed: KYIKTWRPR (AKT1 E17K)
KAIKTWRPY

SEQ ID NO: 798 - protein, 10 aa, Artificial Sequence
  Description of Artificial Sequence: Synthetic peptide
  Seed: KRGKYIKTWR (AKT1 E17K)
KCGKYIKTWR

SEQ ID NO: 799 - protein, 9 aa, Artificial Sequence
  Description of Artificial Sequence: Synthetic peptide
  Seed: KYIKTWRPR (AKT1 E17K)
KCIKTWRPA

SEQ ID NO: 800 - protein, 9 aa, Artificial Sequence
  Description of Artificial Sequence: Synthetic peptide
  Seed: KYIKTWRPR (AKT1 E17K)
KCIKTWRPK

SEQ ID NO: 801 - protein, 9 aa, Artificial Sequence
  Description of Artificial Sequence: Synthetic peptide
  Seed: KYIKTWRPR (AKT1 E17K)
KCIKTWRPR

SEQ ID NO: 802 - protein, 10 aa, Artificial Sequence
  Description of Artificial Sequence: Synthetic peptide
  Seed: KYIKTWRPRY (AKT1 E17K)
KCIKTWRPRA

SEQ ID NO: 803 - protein, 10 aa, Artificial Sequence
  Description of Artificial Sequence: Synthetic peptide
  Seed: KYIKTWRPRY (AKT1 E17K)
KCIKTWRPRI

SEQ ID NO: 804 - protein, 10 aa, Artificial Sequence
  Description of Artificial Sequence: Synthetic peptide
  Seed: KYIKTWRPRY (AKT1 E17K)
KCIKTWRPRK

SEQ ID NO: 805 - protein, 10 aa, Artificial Sequence
  Description of Artificial Sequence: Synthetic peptide
  Seed: KYIKTWRPRY (AKT1 E17K)
KCIKTWRPRL

SEQ ID NO: 806 - protein, 10 aa, Artificial Sequence
  Description of Artificial Sequence: Synthetic peptide
  Seed: KYIKTWRPRY (AKT1 E17K)
KCIKTWRPRM

SEQ ID NO: 807 - protein, 10 aa, Artificial Sequence
  Description of Artificial Sequence: Synthetic peptide
  Seed: KYIKTWRPRY (AKT1 E17K)
KCIKTWRPRR

SEQ ID NO: 808 - protein, 10 aa, Artificial Sequence
  Description of Artificial Sequence: Synthetic peptide
  Seed: KYIKTWRPRY (AKT1 E17K)
KCIKTWRPRV

SEQ ID NO: 809 - protein, 10 aa, Artificial Sequence
  Description of Artificial Sequence: Synthetic peptide
  Seed: KYIKTWRPRY (AKT1 E17K)
KCIKTWRPRY

SEQ ID NO: 810 - protein, 10 aa, Artificial Sequence
  Description of Artificial Sequence: Synthetic peptide
  Seed: KRGKYIKTWR (AKT1 E17K)
KDGKYIKTWR

SEQ ID NO: 811 - protein, 9 aa, Artificial Sequence
  Description of Artificial Sequence: Synthetic peptide
  Seed: KYIKTWRPR (AKT1 E17K)
KDIKTWRPR

SEQ ID NO: 812 - protein, 10 aa, Artificial Sequence
  Description of Artificial Sequence: Synthetic peptide
  Seed: KYIKTWRPRY (AKT1 E17K)
KDIKTWRPRA

SEQ ID NO: 813 - protein, 10 aa, Artificial Sequence
  Description of Artificial Sequence: Synthetic peptide
  Seed: KYIKTWRPRY (AKT1 E17K)
KDIKTWRPRI

SEQ ID NO: 814 - protein, 10 aa, Artificial Sequence
  Description of Artificial Sequence: Synthetic peptide
  Seed: KYIKTWRPRY (AKT1 E17K)
KDIKTWRPRK

SEQ ID NO: 815 - protein, 10 aa, Artificial Sequence
  Description of Artificial Sequence: Synthetic peptide
  Seed: KYIKTWRPRY (AKT1 E17K)
KDIKTWRPRL

SEQ ID NO: 816 - protein, 10 aa, Artificial Sequence
  Description of Artificial Sequence: Synthetic peptide
  Seed: KYIKTWRPRY (AKT1 E17K)
KDIKTWRPRM

SEQ ID NO: 817 - protein, 10 aa, Artificial Sequence
  Description of Artificial Sequence: Synthetic peptide
  Seed: KYIKTWRPRY (AKT1 E17K)
KDIKTWRPRR

SEQ ID NO: 818 - protein, 10 aa, Artificial Sequence
  Description of Artificial Sequence: Synthetic peptide
  Seed: KYIKTWRPRY (AKT1 E17K)
KDIKTWRPRV

SEQ ID NO: 819 - protein, 10 aa, Artificial Sequence
  Description of Artificial Sequence: Synthetic peptide
  Seed: KYIKTWRPRY (AKT1 E17K)
KDIKTWRPRY

SEQ ID NO: 820 - protein, 10 aa, Artificial Sequence
  Description of Artificial Sequence: Synthetic peptide
  Seed: KRGKYIKTWR (AKT1 E17K)
KEGKYIKTWR

SEQ ID NO: 821 - protein, 9 aa, Artificial Sequence
  Description of Artificial Sequence: Synthetic peptide
  Seed: KYIKTWRPR (AKT1 E17K)
KEIKTWRPR

SEQ ID NO: 822 - protein, 10 aa, Artificial Sequence
  Description of Artificial Sequence: Synthetic peptide
  Seed: KYIKTWRPRY (AKT1 E17K)
KEIKTWRPRA

SEQ ID NO: 823 - protein, 10 aa, Artificial Sequence
  Description of Artificial Sequence: Synthetic peptide
  Seed: KYIKTWRPRY (AKT1 E17K)
KEIKTWRPRI

SEQ ID NO: 824 - protein, 10 aa, Artificial Sequence
  Description of Artificial Sequence: Synthetic peptide
  Seed: KYIKTWRPRY (AKT1 E17K)
KEIKTWRPRK

SEQ ID NO: 825 - protein, 10 aa, Artificial Sequence
  Description of Artificial Sequence: Synthetic peptide
  Seed: KYIKTWRPRY (AKT1 E17K)
KEIKTWRPRL

SEQ ID NO: 826 - protein, 10 aa, Artificial Sequence
  Description of Artificial Sequence: Synthetic peptide
  Seed: KYIKTWRPRY (AKT1 E17K)
KEIKTWRPRM

SEQ ID NO: 827 - protein, 10 aa, Artificial Sequence
  Description of Artificial Sequence: Synthetic peptide
  Seed: KYIKTWRPRY (AKT1 E17K)
KEIKTWRPRR

SEQ ID NO: 828 - protein, 10 aa, Artificial Sequence
  Description of Artificial Sequence: Synthetic peptide
  Seed: KYIKTWRPRY (AKT1 E17K)
KEIKTWRPRV

SEQ ID NO: 829 - protein, 10 aa, Artificial Sequence
  Description of Artificial Sequence: Synthetic peptide
  Seed: KYIKTWRPRY (AKT1 E17K)
KEIKTWRPRY

SEQ ID NO: 830 - protein, 10 aa, Artificial Sequence
  Description of Artificial Sequence: Synthetic peptide
  Seed: KRGKYIKTWR (AKT1 E17K)
KFGKYIKTWK

SEQ ID NO: 831 - protein, 10 aa, Artificial Sequence
  Description of Artificial Sequence: Synthetic peptide
  Seed: KRGKYIKTWR (AKT1 E17K)
KFGKYIKTWR

SEQ ID NO: 832 - protein, 9 aa, Artificial Sequence
  Description of Artificial Sequence: Synthetic peptide
  Seed: KYIKTWRPR (AKT1 E17K)
KFIKTWRPA

SEQ ID NO: 833 - protein, 9 aa, Artificial Sequence
  Description of Artificial Sequence: Synthetic peptide
  Seed: KYIKTWRPR (AKT1 E17K)
KFIKTWRPG

SEQ ID NO: 834 - protein, 9 aa, Artificial Sequence
  Description of Artificial Sequence: Synthetic peptide
  Seed: KYIKTWRPR (AKT1 E17K)
KFIKTWRPH

SEQ ID NO: 835 - protein, 9 aa, Artificial Sequence
  Description of Artificial Sequence: Synthetic peptide
  Seed: KYIKTWRPR (AKT1 E17K)
KFIKTWRPI

SEQ ID NO: 836 - protein, 9 aa, Artificial Sequence
  Description of Artificial Sequence: Synthetic peptide
  Seed: KYIKTWRPR (AKT1 E17K)
KFIKTWRPK

SEQ ID NO: 837 - protein, 9 aa, Artificial Sequence
  Description of Artificial Sequence: Synthetic peptide
  Seed: KYIKTWRPR (AKT1 E17K)
KFIKTWRPL

SEQ ID NO: 838 - protein, 9 aa, Artificial Sequence
  Description of Artificial Sequence: Synthetic peptide
  Seed: KYIKTWRPR (AKT1 E17K)
KFIKTWRPM

SEQ ID NO: 839 - protein, 9 aa, Artificial Sequence
  Description of Artificial Sequence: Synthetic peptide
  Seed: KYIKTWRPR (AKT1 E17K)
KFIKTWRPP

SEQ ID NO: 840 - protein, 9 aa, Artificial Sequence
  Description of Artificial Sequence: Synthetic peptide
  Seed: KYIKTWRPR (AKT1 E17K)
KFIKTWRPR

SEQ ID NO: 841 - protein, 10 aa, Artificial Sequence
  Description of Artificial Sequence: Synthetic peptide
  Seed: KYIKTWRPRY (AKT1 E17K)
KFIKTWRPRA

SEQ ID NO: 842 - protein, 10 aa, Artificial Sequence
  Description of Artificial Sequence: Synthetic peptide
  Seed: KYIKTWRPRY (AKT1 E17K)
KFIKTWRPRC

SEQ ID NO: 843 - protein, 10 aa, Artificial Sequence
  Description of Artificial Sequence: Synthetic peptide
  Seed: KYIKTWRPRY (AKT1 E17K)
KFIKTWRPRD

SEQ ID NO: 844 - protein, 10 aa, Artificial Sequence
  Description of Artificial Sequence: Synthetic peptide
  Seed: KYIKTWRPRY (AKT1 E17K)
KFIKTWRPRE

SEQ ID NO: 845 - protein, 10 aa, Artificial Sequence
  Description of Artificial Sequence: Synthetic peptide
  Seed: KYIKTWRPRY (AKT1 E17K)
KFIKTWRPRF

SEQ ID NO: 846 - protein, 10 aa, Artificial Sequence
  Description of Artificial Sequence: Synthetic peptide
  Seed: KYIKTWRPRY (AKT1 E17K)
KFIKTWRPRG

SEQ ID NO: 847 - protein, 10 aa, Artificial Sequence
  Description of Artificial Sequence: Synthetic peptide
  Seed: KYIKTWRPRY (AKT1 E17K)
KFIKTWRPRH

SEQ ID NO: 848 - protein, 10 aa, Artificial Sequence
  Description of Artificial Sequence: Synthetic peptide
  Seed: KYIKTWRPRY (AKT1 E17K)
KFIKTWRPRI

SEQ ID NO: 849 - protein, 10 aa, Artificial Sequence
  Description of Artificial Sequence: Synthetic peptide
  Seed: KYIKTWRPRY (AKT1 E17K)
KFIKTWRPRL

SEQ ID NO: 850 - protein, 10 aa, Artificial Sequence
  Description of Artificial Sequence: Synthetic peptide
  Seed: KYIKTWRPRY (AKT1 E17K)
KFIKTWRPRM

SEQ ID NO: 851 - protein, 10 aa, Artificial Sequence
  Description of Artificial Sequence: Synthetic peptide
  Seed: KYIKTWRPRY (AKT1 E17K)
KFIKTWRPRN

SEQ ID NO: 852 - protein, 10 aa, Artificial Sequence
  Description of Artificial Sequence: Synthetic peptide
  Seed: KYIKTWRPRY (AKT1 E17K)
KFIKTWRPRP

SEQ ID NO: 853 - protein, 10 aa, Artificial Sequence
  Description of Artificial Sequence: Synthetic peptide
  Seed: KYIKTWRPRY (AKT1 E17K)
KFIKTWRPRQ

SEQ ID NO: 854 - protein, 10 aa, Artificial Sequence
  Description of Artificial Sequence: Synthetic peptide
  Seed: KYIKTWRPRY (AKT1 E17K)
KFIKTWRPRR

SEQ ID NO: 855 - protein, 10 aa, Artificial Sequence
  Description of Artificial Sequence: Synthetic peptide
  Seed: KYIKTWRPRY (AKT1 E17K)
KFIKTWRPRS

SEQ ID NO: 856 - protein, 10 aa, Artificial Sequence
  Description of Artificial Sequence: Synthetic peptide
  Seed: KYIKTWRPRY (AKT1 E17K)
KFIKTWRPRT

SEQ ID NO: 857 - protein, 10 aa, Artificial Sequence
  Description of Artificial Sequence: Synthetic peptide
  Seed: KYIKTWRPRY (AKT1 E17K)
KFIKTWRPRV

SEQ ID NO: 858 - protein, 10 aa, Artificial Sequence
  Description of Artificial Sequence: Synthetic peptide
  Seed: KYIKTWRPRY (AKT1 E17K)
KFIKTWRPRW

SEQ ID NO: 859 - protein, 10 aa, Artificial Sequence
  Description of Artificial Sequence: Synthetic peptide
  Seed: KYIKTWRPRY (AKT1 E17K)
KFIKTWRPRY

SEQ ID NO: 860 - protein, 11 aa, Artificial Sequence
  Description of Artificial Sequence: Synthetic peptide
  Seed: KYIKTWRPRYF (AKT1 E17K)
KFIKTWRPRYF

SEQ ID NO: 861 - protein, 11 aa, Artificial Sequence
  Description of Artificial Sequence: Synthetic peptide
  Seed: KYIKTWRPRYF (AKT1 E17K)
KFIKTWRPRYL

SEQ ID NO: 862 - protein, 11 aa, Artificial Sequence
  Description of Artificial Sequence: Synthetic peptide
  Seed: KYIKTWRPRYF (AKT1 E17K)
KFIKTWRPRYW

SEQ ID NO: 863 - protein, 9 aa, Artificial Sequence
  Description of Artificial Sequence: Synthetic peptide
  Seed: KYIKTWRPR (AKT1 E17K)
KFIKTWRPS

SEQ ID NO: 864 - protein, 9 aa, Artificial Sequence
  Description of Artificial Sequence: Synthetic peptide
  Seed: KYIKTWRPR (AKT1 E17K)
KFIKTWRPT

SEQ ID NO: 865 - protein, 9 aa, Artificial Sequence
  Description of Artificial Sequence: Synthetic peptide
  Seed: KYIKTWRPR (AKT1 E17K)
KFIKTWRPV

SEQ ID NO: 866 - protein, 9 aa, Artificial Sequence
  Description of Artificial Sequence: Synthetic peptide
  Seed: KYIKTWRPR (AKT1 E17K)
KFIKTWRPY

SEQ ID NO: 867 - protein, 10 aa, Artificial Sequence
  Description of Artificial Sequence: Synthetic peptide
  Seed: KRGKYIKTWR (AKT1 E17K)
KGGKYIKTWR

SEQ ID NO: 868 - protein, 9 aa, Artificial Sequence
  Description of Artificial Sequence: Synthetic peptide
  Seed: KYIKTWRPR (AKT1 E17K)
KGIKTWRPA

SEQ ID NO: 869 - protein, 9 aa, Artificial Sequence
  Description of Artificial Sequence: Synthetic peptide
  Seed: KYIKTWRPR (AKT1 E17K)
KGIKTWRPI

SEQ ID NO: 870 - protein, 9 aa, Artificial Sequence
  Description of Artificial Sequence: Synthetic peptide
  Seed: KYIKTWRPR (AKT1 E17K)
KGIKTWRPK

SEQ ID NO: 871 - protein, 9 aa, Artificial Sequence
  Description of Artificial Sequence: Synthetic peptide
  Seed: KYIKTWRPR (AKT1 E17K)
KGIKTWRPL

SEQ ID NO: 872 - protein, 9 aa, Artificial Sequence
  Description of Artificial Sequence: Synthetic peptide
  Seed: KYIKTWRPR (AKT1 E17K)
KGIKTWRPM

SEQ ID NO: 873 - protein, 9 aa, Artificial Sequence
  Description of Artificial Sequence: Synthetic peptide
  Seed: KYIKTWRPR (AKT1 E17K)
KGIKTWRPR

SEQ ID NO: 874 - protein, 10 aa, Artificial Sequence
  Description of Artificial Sequence: Synthetic peptide
  Seed: KYIKTWRPRY (AKT1 E17K)
KGIKTWRPRA

SEQ ID NO: 875 - protein, 10 aa, Artificial Sequence
  Description of Artificial Sequence: Synthetic peptide
  Seed: KYIKTWRPRY (AKT1 E17K)
KGIKTWRPRI

SEQ ID NO: 876 - protein, 10 aa, Artificial Sequence
  Description of Artificial Sequence: Synthetic peptide
  Seed: KYIKTWRPRY (AKT1 E17K)
KGIKTWRPRK

SEQ ID NO: 877 - protein, 10 aa, Artificial Sequence
  Description of Artificial Sequence: Synthetic peptide
  Seed: KYIKTWRPRY (AKT1 E17K)
KGIKTWRPRL

SEQ ID NO: 878 - protein, 10 aa, Artificial Sequence
  Description of Artificial Sequence: Synthetic peptide
  Seed: KYIKTWRPRY (AKT1 E17K)
KGIKTWRPRM

SEQ ID NO: 879 - protein, 10 aa, Artificial Sequence
  Description of Artificial Sequence: Synthetic peptide
  Seed: KYIKTWRPRY (AKT1 E17K)
KGIKTWRPRR

SEQ ID NO: 880 - protein, 10 aa, Artificial Sequence
  Description of Artificial Sequence: Synthetic peptide
  Seed: KYIKTWRPRY (AKT1 E17K)
KGIKTWRPRV

SEQ ID NO: 881 - protein, 10 aa, Artificial Sequence
  Description of Artificial Sequence: Synthetic peptide
  Seed: KYIKTWRPRY (AKT1 E17K)
KGIKTWRPRY

SEQ ID NO: 882 - protein, 9 aa, Artificial Sequence
  Description of Artificial Sequence: Synthetic peptide
  Seed: KYIKTWRPR (AKT1 E17K)
KGIKTWRPS

SEQ ID NO: 883 - protein, 9 aa, Artificial Sequence
  Description of Artificial Sequence: Synthetic peptide
  Seed: KYIKTWRPR (AKT1 E17K)
KGIKTWRPV

SEQ ID NO: 884 - protein, 10 aa, Artificial Sequence
  Description of Artificial Sequence: Synthetic peptide
  Seed: KRGKYIKTWR (AKT1 E17K)
KHGKYIKTWR

SEQ ID NO: 885 - protein, 9 aa, Artificial Sequence
  Description of Artificial Sequence: Synthetic peptide
  Seed: KYIKTWRPR (AKT1 E17K)
KHIKTWRPK

SEQ ID NO: 886 - protein, 9 aa, Artificial Sequence
  Description of Artificial Sequence: Synthetic peptide
  Seed: KYIKTWRPR (AKT1 E17K)
KHIKTWRPR

SEQ ID NO: 887 - protein, 10 aa, Artificial Sequence
  Description of Artificial Sequence: Synthetic peptide
  Seed: KYIKTWRPRY (AKT1 E17K)
KHIKTWRPRA

SEQ ID NO: 888 - protein, 10 aa, Artificial Sequence
  Description of Artificial Sequence: Synthetic peptide
  Seed: KYIKTWRPRY (AKT1 E17K)
KHIKTWRPRI

SEQ ID NO: 889 - protein, 10 aa, Artificial Sequence
  Description of Artificial Sequence: Synthetic peptide
  Seed: KYIKTWRPRY (AKT1 E17K)
KHIKTWRPRK

SEQ ID NO: 890 - protein, 10 aa, Artificial Sequence
  Description of Artificial Sequence: Synthetic peptide
  Seed: KYIKTWRPRY (AKT1 E17K)
KHIKTWRPRL

SEQ ID NO: 891 - protein, 10 aa, Artificial Sequence
  Description of Artificial Sequence: Synthetic peptide
  Seed: KYIKTWRPRY (AKT1 E17K)
KHIKTWRPRM

SEQ ID NO: 892 - protein, 10 aa, Artificial Sequence
  Description of Artificial Sequence: Synthetic peptide
  Seed: KYIKTWRPRY (AKT1 E17K)
KHIKTWRPRR

SEQ ID NO: 893 - protein, 10 aa, Artificial Sequence
  Description of Artificial Sequence: Synthetic peptide
  Seed: KYIKTWRPRY (AKT1 E17K)
KHIKTWRPRV

SEQ ID NO: 894 - protein, 10 aa, Artificial Sequence
  Description of Artificial Sequence: Synthetic peptide
  Seed: KYIKTWRPRY (AKT1 E17K)
KHIKTWRPRY

SEQ ID NO: 895 - protein, 10 aa, Artificial Sequence
  Description of Artificial Sequence: Synthetic peptide
  Seed: KRGKYIKTWR (AKT1 E17K)
KIGKYIKTWK

SEQ ID NO: 896 - protein, 10 aa, Artificial Sequence
  Description of Artificial Sequence: Synthetic peptide
  Seed: KRGKYIKTWR (AKT1 E17K)
KIGKYIKTWR

SEQ ID NO: 897 - protein, 9 aa, Artificial Sequence
  Description of Artificial Sequence: Synthetic peptide
  Seed: KYIKTWRPR (AKT1 E17K)
KIIKTWRPA

SEQ ID NO: 898 - protein, 9 aa, Artificial Sequence
  Description of Artificial Sequence: Synthetic peptide
  Seed: KYIKTWRPR (AKT1 E17K)
KIIKTWRPC

SEQ ID NO: 899 - protein, 9 aa, Artificial Sequence
  Description of Artificial Sequence: Synthetic peptide
  Seed: KYIKTWRPR (AKT1 E17K)
KIIKTWRPF

SEQ ID NO: 900 - protein, 9 aa, Artificial Sequence
  Description of Artificial Sequence: Synthetic peptide
  Seed: KYIKTWRPR (AKT1 E17K)
KIIKTWRPG

SEQ ID NO: 901 - protein, 9 aa, Artificial Sequence
  Description of Artificial Sequence: Synthetic peptide
  Seed: KYIKTWRPR (AKT1 E17K)
KIIKTWRPH

SEQ ID NO: 902 - protein, 9 aa, Artificial Sequence
  Description of Artificial Sequence: Synthetic peptide
  Seed: KYIKTWRPR (AKT1 E17K)
KIIKTWRPI

SEQ ID NO: 903 - protein, 9 aa, Artificial Sequence
  Description of Artificial Sequence: Synthetic peptide
  Seed: KYIKTWRPR (AKT1 E17K)
KIIKTWRPK

SEQ ID NO: 904 - protein, 9 aa, Artificial Sequence
  Description of Artificial Sequence: Synthetic peptide
  Seed: KYIKTWRPR (AKT1 E17K)
KIIKTWRPL

SEQ ID NO: 905 - protein, 9 aa, Artificial Sequence
  Description of Artificial Sequence: Synthetic peptide
  Seed: KYIKTWRPR (AKT1 E17K)
KIIKTWRPM

SEQ ID NO: 906 - protein, 9 aa, Artificial Sequence
  Description of Artificial Sequence: Synthetic peptide
  Seed: KYIKTWRPR (AKT1 E17K)
KIIKTWRPN

SEQ ID NO: 907 - protein, 9 aa, Artificial Sequence
  Description of Artificial Sequence: Synthetic peptide
  Seed: KYIKTWRPR (AKT1 E17K)
KIIKTWRPP

SEQ ID NO: 908 - protein, 9 aa, Artificial Sequence
  Description of Artificial Sequence: Synthetic peptide
  Seed: KYIKTWRPR (AKT1 E17K)
KIIKTWRPQ

SEQ ID NO: 909 - protein, 9 aa, Artificial Sequence
  Description of Artificial Sequence: Synthetic peptide
  Seed: KYIKTWRPR (AKT1 E17K)
KIIKTWRPR

SEQ ID NO: 910 - protein, 10 aa, Artificial Sequence
  Description of Artificial Sequence: Synthetic peptide
  Seed: KYIKTWRPRY (AKT1 E17K)
KIIKTWRPRA

SEQ ID NO: 911 - protein, 10 aa, Artificial Sequence
  Description of Artificial Sequence: Synthetic peptide
  Seed: KYIKTWRPRY (AKT1 E17K)
KIIKTWRPRC

SEQ ID NO: 912 - protein, 10 aa, Artificial Sequence
  Description of Artificial Sequence: Synthetic peptide
  Seed: KYIKTWRPRY (AKT1 E17K)
KIIKTWRPRD

SEQ ID NO: 913 - protein, 10 aa, Artificial Sequence
  Description of Artificial Sequence: Synthetic peptide
  Seed: KYIKTWRPRY (AKT1 E17K)
KIIKTWRPRE

SEQ ID NO: 914 - protein, 10 aa, Artificial Sequence
  Description of Artificial Sequence: Synthetic peptide
  Seed: KYIKTWRPRY (AKT1 E17K)
KIIKTWRPRF

SEQ ID NO: 915 - protein, 10 aa, Artificial Sequence
  Description of Artificial Sequence: Synthetic peptide
  Seed: KYIKTWRPRY (AKT1 E17K)
KIIKTWRPRG

SEQ ID NO: 916 - protein, 10 aa, Artificial Sequence
  Description of Artificial Sequence: Synthetic peptide
  Seed: KYIKTWRPRY (AKT1 E17K)
KIIKTWRPRH

SEQ ID NO: 917 - protein, 10 aa, Artificial Sequence
  Description of Artificial Sequence: Synthetic peptide
  Seed: KYIKTWRPRY (AKT1 E17K)
KIIKTWRPRI

SEQ ID NO: 918 - protein, 10 aa, Artificial Sequence
  Description of Artificial Sequence: Synthetic peptide
  Seed: KYIKTWRPRY (AKT1 E17K)
KIIKTWRPRK

SEQ ID NO: 919 - protein, 10 aa, Artificial Sequence
  Description of Artificial Sequence: Synthetic peptide
  Seed: KYIKTWRPRY (AKT1 E17K)
KIIKTWRPRL

SEQ ID NO: 920 - protein, 10 aa, Artificial Sequence
  Description of Artificial Sequence: Synthetic peptide
  Seed: KYIKTWRPRY (AKT1 E17K)
KIIKTWRPRM

SEQ ID NO: 921 - protein, 10 aa, Artificial Sequence
  Description of Artificial Sequence: Synthetic peptide
  Seed: KYIKTWRPRY (AKT1 E17K)
KIIKTWRPRN

SEQ ID NO: 922 - protein, 10 aa, Artificial Sequence
  Description of Artificial Sequence: Synthetic peptide
  Seed: KYIKTWRPRY (AKT1 E17K)
KIIKTWRPRP

SEQ ID NO: 923 - protein, 10 aa, Artificial Sequence
  Description of Artificial Sequence: Synthetic peptide
  Seed: KYIKTWRPRY (AKT1 E17K)
KIIKTWRPRQ

SEQ ID NO: 924 - protein, 10 aa, Artificial Sequence
  Description of Artificial Sequence: Synthetic peptide
  Seed: KYIKTWRPRY (AKT1 E17K)
KIIKTWRPRR

SEQ ID NO: 925 - protein, 10 aa, Artificial Sequence
  Description of Artificial Sequence: Synthetic peptide
  Seed: KYIKTWRPRY (AKT1 E17K)
KIIKTWRPRS

SEQ ID NO: 926 - protein, 10 aa, Artificial Sequence
  Description of Artificial Sequence: Synthetic peptide
  Seed: KYIKTWRPRY (AKT1 E17K)
KIIKTWRPRT

SEQ ID NO: 927 - protein, 10 aa, Artificial Sequence
  Description of Artificial Sequence: Synthetic peptide
  Seed: KYIKTWRPRY (AKT1 E17K)
KIIKTWRPRV

SEQ ID NO: 928 - protein, 10 aa, Artificial Sequence
  Description of Artificial Sequence: Synthetic peptide
  Seed: KYIKTWRPRY (AKT1 E17K)
KIIKTWRPRW

SEQ ID NO: 929 - protein, 10 aa, Artificial Sequence
  Description of Artificial Sequence: Synthetic peptide
  Seed: KYIKTWRPRY (AKT1 E17K)
KIIKTWRPRY

SEQ ID NO: 930 - protein, 9 aa, Artificial Sequence
  Description of Artificial Sequence: Synthetic peptide
  Seed: KYIKTWRPR (AKT1 E17K)
KIIKTWRPS

SEQ ID NO: 931 - protein, 9 aa, Artificial Sequence
  Description of Artificial Sequence: Synthetic peptide
  Seed: KYIKTWRPR (AKT1 E17K)
KIIKTWRPT

SEQ ID NO: 932 - protein, 9 aa, Artificial Sequence
  Description of Artificial Sequence: Synthetic peptide
  Seed: KYIKTWRPR (AKT1 E17K)
KIIKTWRPV

SEQ ID NO: 933 - protein, 9 aa, Artificial Sequence
  Description of Artificial Sequence: Synthetic peptide
  Seed: KYIKTWRPR (AKT1 E17K)
KIIKTWRPY

SEQ ID NO: 934 - protein, 10 aa, Artificial Sequence
  Description of Artificial Sequence: Synthetic peptide
  Seed: KRGKYIKTWR (AKT1 E17K)
KKGKYIKTWR

SEQ ID NO: 935 - protein, 9 aa, Artificial Sequence
  Description of Artificial Sequence: Synthetic peptide
  Seed: KYIKTWRPR (AKT1 E17K)
KKIKTWRPK

SEQ ID NO: 936 - protein, 9 aa, Artificial Sequence
  Description of Artificial Sequence: Synthetic peptide
  Seed: KYIKTWRPR (AKT1 E17K)
KKIKTWRPR

SEQ ID NO: 937 - protein, 10 aa, Artificial Sequence
  Description of Artificial Sequence: Synthetic peptide
  Seed: KYIKTWRPRY (AKT1 E17K)
KKIKTWRPRA

SEQ ID NO: 938 - protein, 10 aa, Artificial Sequence
  Description of Artificial Sequence: Synthetic peptide
  Seed: KYIKTWRPRY (AKT1 E17K)
KKIKTWRPRI

SEQ ID NO: 939 - protein, 10 aa, Artificial Sequence
  Description of Artificial Sequence: Synthetic peptide
  Seed: KYIKTWRPRY (AKT1 E17K)
KKIKTWRPRK

SEQ ID NO: 940 - protein, 10 aa, Artificial Sequence
  Description of Artificial Sequence: Synthetic peptide
  Seed: KYIKTWRPRY (AKT1 E17K)
KKIKTWRPRL

SEQ ID NO: 941 - protein, 10 aa, Artificial Sequence
  Description of Artificial Sequence: Synthetic peptide
  Seed: KYIKTWRPRY (AKT1 E17K)
KKIKTWRPRM

SEQ ID NO: 942 - protein, 10 aa, Artificial Sequence
  Description of Artificial Sequence: Synthetic peptide
  Seed: KYIKTWRPRY (AKT1 E17K)
KKIKTWRPRR

SEQ ID NO: 943 - protein, 10 aa, Artificial Sequence
  Description of Artificial Sequence: Synthetic peptide
  Seed: KYIKTWRPRY (AKT1 E17K)
KKIKTWRPRV

SEQ ID NO: 944 - protein, 10 aa, Artificial Sequence
  Description of Artificial Sequence: Synthetic peptide
  Seed: KYIKTWRPRY (AKT1 E17K)
KKIKTWRPRY

SEQ ID NO: 945 - protein, 10 aa, Artificial Sequence
  Description of Artificial Sequence: Synthetic peptide
  Seed: KRGKYIKTWR (AKT1 E17K)
KLGKYIKTWK

SEQ ID NO: 946 - protein, 10 aa, Artificial Sequence
  Description of Artificial Sequence: Synthetic peptide
  Seed: KRGKYIKTWR (AKT1 E17K)
KLGKYIKTWR

SEQ ID NO: 947 - protein, 9 aa, Artificial Sequence
  Description of Artificial Sequence: Synthetic peptide
  Seed: KYIKTWRPR (AKT1 E17K)
KLIKTWRPA

SEQ ID NO: 948 - protein, 9 aa, Artificial Sequence
  Description of Artificial Sequence: Synthetic peptide
  Seed: KYIKTWRPR (AKT1 E17K)
KLIKTWRPG

SEQ ID NO: 949 - protein, 9 aa, Artificial Sequence
  Description of Artificial Sequence: Synthetic peptide
  Seed: KYIKTWRPR (AKT1 E17K)
KLIKTWRPH

SEQ ID NO: 950 - protein, 9 aa, Artificial Sequence
  Description of Artificial Sequence: Synthetic peptide
  Seed: KYIKTWRPR (AKT1 E17K)
KLIKTWRPI

SEQ ID NO: 951 - protein, 9 aa, Artificial Sequence
  Description of Artificial Sequence: Synthetic peptide
  Seed: KYIKTWRPR (AKT1 E17K)
KLIKTWRPK

SEQ ID NO: 952 - protein, 9 aa, Artificial Sequence
  Description of Artificial Sequence: Synthetic peptide
  Seed: KYIKTWRPR (AKT1 E17K)
KLIKTWRPL

SEQ ID NO: 953 - protein, 9 aa, Artificial Sequence
  Description of Artificial Sequence: Synthetic peptide
  Seed: KYIKTWRPR (AKT1 E17K)
KLIKTWRPM

SEQ ID NO: 954 - protein, 9 aa, Artificial Sequence
  Description of Artificial Sequence: Synthetic peptide
  Seed: KYIKTWRPR (AKT1 E17K)
KLIKTWRPR

SEQ ID NO: 955 - protein, 10 aa, Artificial Sequence
  Description of Artificial Sequence: Synthetic peptide
  Seed: KYIKTWRPRY (AKT1 E17K)
KLIKTWRPRA

SEQ ID NO: 956 - protein, 10 aa, Artificial Sequence
  Description of Artificial Sequence: Synthetic peptide
  Seed: KYIKTWRPRY (AKT1 E17K)
KLIKTWRPRC

SEQ ID NO: 957 - protein, 10 aa, Artificial Sequence
  Description of Artificial Sequence: Synthetic peptide
  Seed: KYIKTWRPRY (AKT1 E17K)
KLIKTWRPRD

SEQ ID NO: 958 - protein, 10 aa, Artificial Sequence
  Description of Artificial Sequence: Synthetic peptide
  Seed: KYIKTWRPRY (AKT1 E17K)
KLIKTWRPRE

SEQ ID NO: 959 - protein, 10 aa, Artificial Sequence
  Description of Artificial Sequence: Synthetic peptide
  Seed: KYIKTWRPRY (AKT1 E17K)
KLIKTWRPRF

SEQ ID NO: 960 - protein, 10 aa, Artificial Sequence
  Description of Artificial Sequence: Synthetic peptide
  Seed: KYIKTWRPRY (AKT1 E17K)
KLIKTWRPRG

SEQ ID NO: 961 - protein, 10 aa, Artificial Sequence
  Description of Artificial Sequence: Synthetic peptide
  Seed: KYIKTWRPRY (AKT1 E17K)
KLIKTWRPRH

SEQ ID NO: 962 - protein, 10 aa, Artificial Sequence
  Description of Artificial Sequence: Synthetic peptide
  Seed: KYIKTWRPRY (AKT1 E17K)
KLIKTWRPRI

SEQ ID NO: 963 - protein, 10 aa, Artificial Sequence
  Description of Artificial Sequence: Synthetic peptide
  Seed: KYIKTWRPRY (AKT1 E17K)
KLIKTWRPRK

SEQ ID NO: 964 - protein, 10 aa, Artificial Sequence
  Description of Artificial Sequence: Synthetic peptide
  Seed: KYIKTWRPRY (AKT1 E17K)
KLIKTWRPRL

SEQ ID NO: 965 - protein, 10 aa, Artificial Sequence
  Description of Artificial Sequence: Synthetic peptide
  Seed: KYIKTWRPRY (AKT1 E17K)
KLIKTWRPRM

SEQ ID NO: 966 - protein, 10 aa, Artificial Sequence
  Description of Artificial Sequence: Synthetic peptide
  Seed: KYIKTWRPRY (AKT1 E17K)
KLIKTWRPRN

SEQ ID NO: 967 - protein, 10 aa, Artificial Sequence
  Description of Artificial Sequence: Synthetic peptide
  Seed: KYIKTWRPRY (AKT1 E17K)
KLIKTWRPRP

SEQ ID NO: 968 - protein, 10 aa, Artificial Sequence
  Description of Artificial Sequence: Synthetic peptide
  Seed: KYIKTWRPRY (AKT1 E17K)
KLIKTWRPRQ

SEQ ID NO: 969 - protein, 10 aa, Artificial Sequence
  Description of Artificial Sequence: Synthetic peptide
  Seed: KYIKTWRPRY (AKT1 E17K)
KLIKTWRPRR

SEQ ID NO: 970 - protein, 10 aa, Artificial Sequence
  Description of Artificial Sequence: Synthetic peptide
  Seed: KYIKTWRPRY (AKT1 E17K)
KLIKTWRPRS

SEQ ID NO: 971 - protein, 10 aa, Artificial Sequence
  Description of Artificial Sequence: Synthetic peptide
  Seed: KYIKTWRPRY (AKT1 E17K)
KLIKTWRPRT

SEQ ID NO: 972 - protein, 10 aa, Artificial Sequence
  Description of Artificial Sequence: Synthetic peptide
  Seed: KYIKTWRPRY (AKT1 E17K)
KLIKTWRPRV

SEQ ID NO: 973 - protein, 10 aa, Artificial Sequence
  Description of Artificial Sequence: Synthetic peptide
  Seed: KYIKTWRPRY (AKT1 E17K)
KLIKTWRPRW

SEQ ID NO: 974 - protein, 10 aa, Artificial Sequence
  Description of Artificial Sequence: Synthetic peptide
  Seed: KYIKTWRPRY (AKT1 E17K)
KLIKTWRPRY

SEQ ID NO: 975 - protein, 9 aa, Artificial Sequence
  Description of Artificial Sequence: Synthetic peptide
  Seed: KYIKTWRPR (AKT1 E17K)
KLIKTWRPS

SEQ ID NO: 976 - protein, 9 aa, Artificial Sequence
  Description of Artificial Sequence: Synthetic peptide
  Seed: KYIKTWRPR (AKT1 E17K)
KLIKTWRPT

SEQ ID NO: 977 - protein, 9 aa, Artificial Sequence
  Description of Artificial Sequence: Synthetic peptide
  Seed: KYIKTWRPR (AKT1 E17K)
KLIKTWRPV

SEQ ID NO: 978 - protein, 9 aa, Artificial Sequence
  Description of Artificial Sequence: Synthetic peptide
  Seed: KYIKTWRPR (AKT1 E17K)
KLIKTWRPY

SEQ ID NO: 979 - protein, 10 aa, Artificial Sequence
  Description of Artificial Sequence: Synthetic peptide
  Seed: KRGKYIKTWR (AKT1 E17K)
KMGKYIKTWK

SEQ ID NO: 980 - protein, 10 aa, Artificial Sequence
  Description of Artificial Sequence: Synthetic peptide
  Seed: KRGKYIKTWR (AKT1 E17K)
KMGKYIKTWR

SEQ ID NO: 981 - protein, 9 aa, Artificial Sequence
  Description of Artificial Sequence: Synthetic peptide
  Seed: KYIKTWRPR (AKT1 E17K)
KMIKTWRPA

SEQ ID NO: 982 - protein, 9 aa, Artificial Sequence
  Description of Artificial Sequence: Synthetic peptide
  Seed: KYIKTWRPR (AKT1 E17K)
KMIKTWRPC

SEQ ID NO: 983 - protein, 9 aa, Artificial Sequence
  Description of Artificial Sequence: Synthetic peptide
  Seed: KYIKTWRPR (AKT1 E17K)
KMIKTWRPE

SEQ ID NO: 984 - protein, 9 aa, Artificial Sequence
  Description of Artificial Sequence: Synthetic peptide
  Seed: KYIKTWRPR (AKT1 E17K)
KMIKTWRPF

SEQ ID NO: 985 - protein, 9 aa, Artificial Sequence
  Description of Artificial Sequence: Synthetic peptide
  Seed: KYIKTWRPR (AKT1 E17K)
KMIKTWRPG

SEQ ID NO: 986 - protein, 9 aa, Artificial Sequence
  Description of Artificial Sequence: Synthetic peptide
  Seed: KYIKTWRPR (AKT1 E17K)
KMIKTWRPH

SEQ ID NO: 987 - protein, 9 aa, Artificial Sequence
  Description of Artificial Sequence: Synthetic peptide
  Seed: KYIKTWRPR (AKT1 E17K)
KMIKTWRPI

SEQ ID NO: 988 - protein, 9 aa, Artificial Sequence
  Description of Artificial Sequence: Synthetic peptide
  Seed: KYIKTWRPR (AKT1 E17K)
KMIKTWRPK

SEQ ID NO: 989 - protein, 9 aa, Artificial Sequence
  Description of Artificial Sequence: Synthetic peptide
  Seed: KYIKTWRPR (AKT1 E17K)
KMIKTWRPL

SEQ ID NO: 990 - protein, 9 aa, Artificial Sequence
  Description of Artificial Sequence: Synthetic peptide
  Seed: KYIKTWRPR (AKT1 E17K)
KMIKTWRPM

SEQ ID NO: 991 - protein, 9 aa, Artificial Sequence
  Description of Artificial Sequence: Synthetic peptide
  Seed: KYIKTWRPR (AKT1 E17K)
KMIKTWRPN

SEQ ID NO: 992 - protein, 9 aa, Artificial Sequence
  Description of Artificial Sequence: Synthetic peptide
  Seed: KYIKTWRPR (AKT1 E17K)
KMIKTWRPP

SEQ ID NO: 993 - protein, 9 aa, Artificial Sequence
  Description of Artificial Sequence: Synthetic peptide
  Seed: KYIKTWRPR (AKT1 E17K)
KMIKTWRPQ

SEQ ID NO: 994 - protein, 9 aa, Artificial Sequence
  Description of Artificial Sequence: Synthetic peptide
  Seed: KYIKTWRPR (AKT1 E17K)
KMIKTWRPR

SEQ ID NO: 995 - protein, 10 aa, Artificial Sequence
  Description of Artificial Sequence: Synthetic peptide
  Seed: KYIKTWRPRY (AKT1 E17K)
KMIKTWRPRA

SEQ ID NO: 996 - protein, 10 aa, Artificial Sequence
  Description of Artificial Sequence: Synthetic peptide
  Seed: KYIKTWRPRY (AKT1 E17K)
KMIKTWRPRC

SEQ ID NO: 997 - protein, 10 aa, Artificial Sequence
  Description of Artificial Sequence: Synthetic peptide
  Seed: KYIKTWRPRY (AKT1 E17K)
KMIKTWRPRD

SEQ ID NO: 998 - protein, 10 aa, Artificial Sequence
  Description of Artificial Sequence: Synthetic peptide
  Seed: KYIKTWRPRY (AKT1 E17K)
KMIKTWRPRE

SEQ ID NO: 999 - protein, 10 aa, Artificial Sequence
  Description of Artificial Sequence: Synthetic peptide
  Seed: KYIKTWRPRY (AKT1 E17K)
KMIKTWRPRF

SEQ ID NO: 1000 - protein, 10 aa, Artificial Sequence
  Description of Artificial Sequence: Synthetic peptide
  Seed: KYIKTWRPRY (AKT1 E17K)
KMIKTWRPRG

SEQ ID NO: 1001 - protein, 10 aa, Artificial Sequence
  Description of Artificial Sequence: Synthetic peptide
  Seed: KYIKTWRPRY (AKT1 E17K)
KMIKTWRPRH

SEQ ID NO: 1002 - protein, 10 aa, Artificial Sequence
  Description of Artificial Sequence: Synthetic peptide
  Seed: KYIKTWRPRY (AKT1 E17K)
KMIKTWRPRI

SEQ ID NO: 1003 - protein, 10 aa, Artificial Sequence
  Description of Artificial Sequence: Synthetic peptide
  Seed: KYIKTWRPRY (AKT1 E17K)
KMIKTWRPRK

SEQ ID NO: 1004 - protein, 10 aa, Artificial Sequence
  Description of Artificial Sequence: Synthetic peptide
  Seed: KYIKTWRPRY (AKT1 E17K)
KMIKTWRPRL

SEQ ID NO: 1005 - protein, 10 aa, Artificial Sequence
  Description of Artificial Sequence: Synthetic peptide
  Seed: KYIKTWRPRY (AKT1 E17K)
KMIKTWRPRM

SEQ ID NO: 1006 - protein, 10 aa, Artificial Sequence
  Description of Artificial Sequence: Synthetic peptide
  Seed: KYIKTWRPRY (AKT1 E17K)
KMIKTWRPRN

SEQ ID NO: 1007 - protein, 10 aa, Artificial Sequence
  Description of Artificial Sequence: Synthetic peptide
  Seed: KYIKTWRPRY (AKT1 E17K)
KMIKTWRPRP

SEQ ID NO: 1008 - protein, 10 aa, Artificial Sequence
  Description of Artificial Sequence: Synthetic peptide
  Seed: KYIKTWRPRY (AKT1 E17K)
KMIKTWRPRQ

SEQ ID NO: 1009 - protein, 10 aa, Artificial Sequence
  Description of Artificial Sequence: Synthetic peptide
  Seed: KYIKTWRPRY (AKT1 E17K)
KMIKTWRPRR

SEQ ID NO: 1010 - protein, 10 aa, Artificial Sequence
  Description of Artificial Sequence: Synthetic peptide
  Seed: KYIKTWRPRY (AKT1 E17K)
KMIKTWRPRS

SEQ ID NO: 1011 - protein, 10 aa, Artificial Sequence
  Description of Artificial Sequence: Synthetic peptide
  Seed: KYIKTWRPRY (AKT1 E17K)
KMIKTWRPRT

SEQ ID NO: 1012 - protein, 10 aa, Artificial Sequence
  Description of Artificial Sequence: Synthetic peptide
  Seed: KYIKTWRPRY (AKT1 E17K)
KMIKTWRPRV

SEQ ID NO: 1013 - protein, 10 aa, Artificial Sequence
  Description of Artificial Sequence: Synthetic peptide
  Seed: KYIKTWRPRY (AKT1 E17K)
KMIKTWRPRW

SEQ ID NO: 1014 - protein, 9 aa, Artificial Sequence
  Description of Artificial Sequence: Synthetic peptide
  Seed: KYIKTWRPR (AKT1 E17K)
KMIKTWRPS

SEQ ID NO: 1015 - protein, 9 aa, Artificial Sequence
  Description of Artificial Sequence: Synthetic peptide
  Seed: KYIKTWRPR (AKT1 E17K)
KMIKTWRPT

SEQ ID NO: 1016 - protein, 9 aa, Artificial Sequence
  Description of Artificial Sequence: Synthetic peptide
  Seed: KYIKTWRPR (AKT1 E17K)
KMIKTWRPV

SEQ ID NO: 1017 - protein, 9 aa, Artificial Sequence
  Description of Artificial Sequence: Synthetic peptide
  Seed: KYIKTWRPR (AKT1 E17K)
KMIKTWRPY

SEQ ID NO: 1018 - protein, 10 aa, Artificial Sequence
  Description of Artificial Sequence: Synthetic peptide
  Seed: KRGKYIKTWR (AKT1 E17K)
KNGKYIKTWR

SEQ ID NO: 1019 - protein, 9 aa, Artificial Sequence
  Description of Artificial Sequence: Synthetic peptide
  Seed: KYIKTWRPR (AKT1 E17K)
KNIKTWRPA

SEQ ID NO: 1020 - protein, 9 aa, Artificial Sequence
  Description of Artificial Sequence: Synthetic peptide
  Seed: KYIKTWRPR (AKT1 E17K)
KNIKTWRPI

SEQ ID NO: 1021 - protein, 9 aa, Artificial Sequence
  Description of Artificial Sequence: Synthetic peptide
  Seed: KYIKTWRPR (AKT1 E17K)
KNIKTWRPK

SEQ ID NO: 1022 - protein, 9 aa, Artificial Sequence
  Description of Artificial Sequence: Synthetic peptide
  Seed: KYIKTWRPR (AKT1 E17K)
KNIKTWRPR

SEQ ID NO: 1023 - protein, 10 aa, Artificial Sequence
  Description of Artificial Sequence: Synthetic peptide
  Seed: KYIKTWRPRY (AKT1 E17K)
KNIKTWRPRA

SEQ ID NO: 1024 - protein, 10 aa, Artificial Sequence
  Description of Artificial Sequence: Synthetic peptide
  Seed: KYIKTWRPRY (AKT1 E17K)
KNIKTWRPRI

SEQ ID NO: 1025 - protein, 10 aa, Artificial Sequence
  Description of Artificial Sequence: Synthetic peptide
  Seed: KYIKTWRPRY (AKT1 E17K)
KNIKTWRPRK

SEQ ID NO: 1026 - protein, 10 aa, Artificial Sequence
  Description of Artificial Sequence: Synthetic peptide
  Seed: KYIKTWRPRY (AKT1 E17K)
KNIKTWRPRL

SEQ ID NO: 1027 - protein, 10 aa, Artificial Sequence
  Description of Artificial Sequence: Synthetic peptide
  Seed: KYIKTWRPRY (AKT1 E17K)
KNIKTWRPRM

SEQ ID NO: 1028 - protein, 10 aa, Artificial Sequence
  Description of Artificial Sequence: Synthetic peptide
  Seed: KYIKTWRPRY (AKT1 E17K)
KNIKTWRPRR

SEQ ID NO: 1029 - protein, 10 aa, Artificial Sequence
  Description of Artificial Sequence: Synthetic peptide
  Seed: KYIKTWRPRY (AKT1 E17K)
KNIKTWRPRV

SEQ ID NO: 1030 - protein, 10 aa, Artificial Sequence
  Description of Artificial Sequence: Synthetic peptide
  Seed: KYIKTWRPRY (AKT1 E17K)
KNIKTWRPRY

SEQ ID NO: 1031 - protein, 9 aa, Artificial Sequence
  Description of Artificial Sequence: Synthetic peptide
  Seed: KYIKTWRPR (AKT1 E17K)
KNIKTWRPV

SEQ ID NO: 1032 - protein, 10 aa, Artificial Sequence
  Description of Artificial Sequence: Synthetic peptide
  Seed: KRGKYIKTWR (AKT1 E17K)
KPGKYIKTWR

SEQ ID NO: 1033 - protein, 10 aa, Artificial Sequence
  Description of Artificial Sequence: Synthetic peptide
  Seed: KYIKTWRPRY (AKT1 E17K)
KPIKTWRPRA

SEQ ID NO: 1034 - protein, 10 aa, Artificial Sequence
  Description of Artificial Sequence: Synthetic peptide
  Seed: KYIKTWRPRY (AKT1 E17K)
KPIKTWRPRI

SEQ ID NO: 1035 - protein, 10 aa, Artificial Sequence
  Description of Artificial Sequence: Synthetic peptide
  Seed: KYIKTWRPRY (AKT1 E17K)
KPIKTWRPRK

SEQ ID NO: 1036 - protein, 10 aa, Artificial Sequence
  Description of Artificial Sequence: Synthetic peptide
  Seed: KYIKTWRPRY (AKT1 E17K)
KPIKTWRPRM

SEQ ID NO: 1037 - protein, 10 aa, Artificial Sequence
  Description of Artificial Sequence: Synthetic peptide
  Seed: KYIKTWRPRY (AKT1 E17K)
KPIKTWRPRR

SEQ ID NO: 1038 - protein, 10 aa, Artificial Sequence
  Description of Artificial Sequence: Synthetic peptide
  Seed: KYIKTWRPRY (AKT1 E17K)
KPIKTWRPRV

SEQ ID NO: 1039 - protein, 10 aa, Artificial Sequence
  Description of Artificial Sequence: Synthetic peptide
  Seed: KRGKYIKTWR (AKT1 E17K)
KQGKYIKTWK

SEQ ID NO: 1040 - protein, 10 aa, Artificial Sequence
  Description of Artificial Sequence: Synthetic peptide
  Seed: KRGKYIKTWR (AKT1 E17K)
KQGKYIKTWR

SEQ ID NO: 1041 - protein, 9 aa, Artificial Sequence
  Description of Artificial Sequence: Synthetic peptide
  Seed: KYIKTWRPR (AKT1 E17K)
KQIKTWRPA

SEQ ID NO: 1042 - protein, 9 aa, Artificial Sequence
  Description of Artificial Sequence: Synthetic peptide
  Seed: KYIKTWRPR (AKT1 E17K)
KQIKTWRPG

SEQ ID NO: 1043 - protein, 9 aa, Artificial Sequence
  Description of Artificial Sequence: Synthetic peptide
  Seed: KYIKTWRPR (AKT1 E17K)
KQIKTWRPI

SEQ ID NO: 1044 - protein, 9 aa, Artificial Sequence
  Description of Artificial Sequence: Synthetic peptide
  Seed: KYIKTWRPR (AKT1 E17K)
KQIKTWRPK

SEQ ID NO: 1045 - protein, 9 aa, Artificial Sequence
  Description of Artificial Sequence: Synthetic peptide
  Seed: KYIKTWRPR (AKT1 E17K)
KQIKTWRPL

SEQ ID NO: 1046 - protein, 9 aa, Artificial Sequence
  Description of Artificial Sequence: Synthetic peptide
  Seed: KYIKTWRPR (AKT1 E17K)
KQIKTWRPM

SEQ ID NO: 1047 - protein, 9 aa, Artificial Sequence
  Description of Artificial Sequence: Synthetic peptide
  Seed: KYIKTWRPR (AKT1 E17K)
KQIKTWRPR

SEQ ID NO: 1048 - protein, 10 aa, Artificial Sequence
  Description of Artificial Sequence: Synthetic peptide
  Seed: KYIKTWRPRY (AKT1 E17K)
KQIKTWRPRA

SEQ ID NO: 1049 - protein, 10 aa, Artificial Sequence
  Description of Artificial Sequence: Synthetic peptide
  Seed: KYIKTWRPRY (AKT1 E17K)
KQIKTWRPRC

SEQ ID NO: 1050 - protein, 10 aa, Artificial Sequence
  Description of Artificial Sequence: Synthetic peptide
  Seed: KYIKTWRPRY (AKT1 E17K)
KQIKTWRPRD

SEQ ID NO: 1051 - protein, 10 aa, Artificial Sequence
  Description of Artificial Sequence: Synthetic peptide
  Seed: KYIKTWRPRY (AKT1 E17K)
KQIKTWRPRE

SEQ ID NO: 1052 - protein, 10 aa, Artificial Sequence
  Description of Artificial Sequence: Synthetic peptide
  Seed: KYIKTWRPRY (AKT1 E17K)
KQIKTWRPRF

SEQ ID NO: 1053 - protein, 10 aa, Artificial Sequence
  Description of Artificial Sequence: Synthetic peptide
  Seed: KYIKTWRPRY (AKT1 E17K)
KQIKTWRPRG

SEQ ID NO: 1054 - protein, 10 aa, Artificial Sequence
  Description of Artificial Sequence: Synthetic peptide
  Seed: KYIKTWRPRY (AKT1 E17K)
KQIKTWRPRH

SEQ ID NO: 1055 - protein, 10 aa, Artificial Sequence
  Description of Artificial Sequence: Synthetic peptide
  Seed: KYIKTWRPRY (AKT1 E17K)
KQIKTWRPRI

SEQ ID NO: 1056 - protein, 10 aa, Artificial Sequence
  Description of Artificial Sequence: Synthetic peptide
  Seed: KYIKTWRPRY (AKT1 E17K)
KQIKTWRPRK

SEQ ID NO: 1057 - protein, 10 aa, Artificial Sequence
  Description of Artificial Sequence: Synthetic peptide
  Seed: KYIKTWRPRY (AKT1 E17K)
KQIKTWRPRL

SEQ ID NO: 1058 - protein, 10 aa, Artificial Sequence
  Description of Artificial Sequence: Synthetic peptide
  Seed: KYIKTWRPRY (AKT1 E17K)
KQIKTWRPRM

SEQ ID NO: 1059 - protein, 10 aa, Artificial Sequence
  Description of Artificial Sequence: Synthetic peptide
  Seed: KYIKTWRPRY (AKT1 E17K)
KQIKTWRPRN

SEQ ID NO: 1060 - protein, 10 aa, Artificial Sequence
  Description of Artificial Sequence: Synthetic peptide
  Seed: KYIKTWRPRY (AKT1 E17K)
KQIKTWRPRP

SEQ ID NO: 1061 - protein, 10 aa, Artificial Sequence
  Description of Artificial Sequence: Synthetic peptide
  Seed: KYIKTWRPRY (AKT1 E17K)
KQIKTWRPRQ

SEQ ID NO: 1062 - protein, 10 aa, Artificial Sequence
  Description of Artificial Sequence: Synthetic peptide
  Seed: KYIKTWRPRY (AKT1 E17K)
KQIKTWRPRR

SEQ ID NO: 1063 - protein, 10 aa, Artificial Sequence
  Description of Artificial Sequence: Synthetic peptide
  Seed: KYIKTWRPRY (AKT1 E17K)
KQIKTWRPRS

SEQ ID NO: 1064 - protein, 10 aa, Artificial Sequence
  Description of Artificial Sequence: Synthetic peptide
  Seed: KYIKTWRPRY (AKT1 E17K)
KQIKTWRPRT

SEQ ID NO: 1065 - protein, 10 aa, Artificial Sequence
  Description of Artificial Sequence: Synthetic peptide
  Seed: KYIKTWRPRY (AKT1 E17K)
KQIKTWRPRV

SEQ ID NO: 1066 - protein, 10 aa, Artificial Sequence
  Description of Artificial Sequence: Synthetic peptide
  Seed: KYIKTWRPRY (AKT1 E17K)
KQIKTWRPRW

SEQ ID NO: 1067 - protein, 10 aa, Artificial Sequence
  Description of Artificial Sequence: Synthetic peptide
  Seed: KYIKTWRPRY (AKT1 E17K)
KQIKTWRPRY

SEQ ID NO: 1068 - protein, 9 aa, Artificial Sequence
  Description of Artificial Sequence: Synthetic peptide
  Seed: KYIKTWRPR (AKT1 E17K)
KQIKTWRPS

SEQ ID NO: 1069 - protein, 9 aa, Artificial Sequence
  Description of Artificial Sequence: Synthetic peptide
  Seed: KYIKTWRPR (AKT1 E17K)
KQIKTWRPV

SEQ ID NO: 1070 - protein, 9 aa, Artificial Sequence
  Description of Artificial Sequence: Synthetic peptide
  Seed: KYIKTWRPR (AKT1 E17K)
KQIKTWRPY

SEQ ID NO: 1071 - protein, 10 aa, Artificial Sequence
  Description of Artificial Sequence: Synthetic peptide
  Seed: KRGKYIKTWR (AKT1 E17K)
KRGKYIKTWF

SEQ ID NO: 1072 - protein, 10 aa, Artificial Sequence
  Description of Artificial Sequence: Synthetic peptide
  Seed: KRGKYIKTWR (AKT1 E17K)
KRGKYIKTWI

SEQ ID NO: 1073 - protein, 10 aa, Artificial Sequence
  Description of Artificial Sequence: Synthetic peptide
  Seed: KRGKYIKTWR (AKT1 E17K)
KRGKYIKTWK

SEQ ID NO: 1074 - protein, 10 aa, Artificial Sequence
  Description of Artificial Sequence: Synthetic peptide
  Seed: KRGKYIKTWR (AKT1 E17K)
KRGKYIKTWL

SEQ ID NO: 1075 - protein, 10 aa, Artificial Sequence
  Description of Artificial Sequence: Synthetic peptide
  Seed: KRGKYIKTWR (AKT1 E17K)
KRGKYIKTWM

SEQ ID NO: 1076 - protein, 10 aa, Artificial Sequence
  Description of Artificial Sequence: Synthetic peptide
  Seed: KRGKYIKTWR (AKT1 E17K)
KRGKYIKTWY

SEQ ID NO: 1077 - protein, 9 aa, Artificial Sequence
  Description of Artificial Sequence: Synthetic peptide
  Seed: KYIKTWRPR (AKT1 E17K)
KRIKTWRPK

SEQ ID NO: 1078 - protein, 9 aa, Artificial Sequence
  Description of Artificial Sequence: Synthetic peptide
  Seed: KYIKTWRPR (AKT1 E17K)
KRIKTWRPR

SEQ ID NO: 1079 - protein, 10 aa, Artificial Sequence
  Description of Artificial Sequence: Synthetic peptide
  Seed: KYIKTWRPRY (AKT1 E17K)
KRIKTWRPRA

SEQ ID NO: 1080 - protein, 10 aa, Artificial Sequence
  Description of Artificial Sequence: Synthetic peptide
  Seed: KYIKTWRPRY (AKT1 E17K)
KRIKTWRPRI

SEQ ID NO: 1081 - protein, 10 aa, Artificial Sequence
  Description of Artificial Sequence: Synthetic peptide
  Seed: KYIKTWRPRY (AKT1 E17K)
KRIKTWRPRK

SEQ ID NO: 1082 - protein, 10 aa, Artificial Sequence
  Description of Artificial Sequence: Synthetic peptide
  Seed: KYIKTWRPRY (AKT1 E17K)
KRIKTWRPRL

SEQ ID NO: 1083 - protein, 10 aa, Artificial Sequence
  Description of Artificial Sequence: Synthetic peptide
  Seed: KYIKTWRPRY (AKT1 E17K)
KRIKTWRPRM

SEQ ID NO: 1084 - protein, 10 aa, Artificial Sequence
  Description of Artificial Sequence: Synthetic peptide
  Seed: KYIKTWRPRY (AKT1 E17K)
KRIKTWRPRR

SEQ ID NO: 1085 - protein, 10 aa, Artificial Sequence
  Description of Artificial Sequence: Synthetic peptide
  Seed: KYIKTWRPRY (AKT1 E17K)
KRIKTWRPRV

SEQ ID NO: 1086 - protein, 10 aa, Artificial Sequence
  Description of Artificial Sequence: Synthetic peptide
  Seed: KYIKTWRPRY (AKT1 E17K)
KRIKTWRPRY

SEQ ID NO: 1087 - protein, 10 aa, Artificial Sequence
  Description of Artificial Sequence: Synthetic peptide
  Seed: KRGKYIKTWR (AKT1 E17K)
KSGKYIKTWK

SEQ ID NO: 1088 - protein, 10 aa, Artificial Sequence
  Description of Artificial Sequence: Synthetic peptide
  Seed: KRGKYIKTWR (AKT1 E17K)
KSGKYIKTWR

SEQ ID NO: 1089 - protein, 9 aa, Artificial Sequence
  Description of Artificial Sequence: Synthetic peptide
  Seed: KYIKTWRPR (AKT1 E17K)
KSIKTWRPA

SEQ ID NO: 1090 - protein, 9 aa, Artificial Sequence
  Description of Artificial Sequence: Synthetic peptide
  Seed: KYIKTWRPR (AKT1 E17K)
KSIKTWRPC

SEQ ID NO: 1091 - protein, 9 aa, Artificial Sequence
  Description of Artificial Sequence: Synthetic peptide
  Seed: KYIKTWRPR (AKT1 E17K)
KSIKTWRPE

SEQ ID NO: 1092 - protein, 9 aa, Artificial Sequence
  Description of Artificial Sequence: Synthetic peptide
  Seed: KYIKTWRPR (AKT1 E17K)
KSIKTWRPF

SEQ ID NO: 1093 - protein, 9 aa, Artificial Sequence
  Description of Artificial Sequence: Synthetic peptide
  Seed: KYIKTWRPR (AKT1 E17K)
KSIKTWRPG

SEQ ID NO: 1094 - protein, 9 aa, Artificial Sequence
  Description of Artificial Sequence: Synthetic peptide
  Seed: KYIKTWRPR (AKT1 E17K)
KSIKTWRPH

SEQ ID NO: 1095 - protein, 9 aa, Artificial Sequence
  Description of Artificial Sequence: Synthetic peptide
  Seed: KYIKTWRPR (AKT1 E17K)
KSIKTWRPI

SEQ ID NO: 1096 - protein, 9 aa, Artificial Sequence
  Description of Artificial Sequence: Synthetic peptide
  Seed: KYIKTWRPR (AKT1 E17K)
KSIKTWRPK

SEQ ID NO: 1097 - protein, 9 aa, Artificial Sequence
  Description of Artificial Sequence: Synthetic peptide
  Seed: KYIKTWRPR (AKT1 E17K)
KSIKTWRPL

SEQ ID NO: 1098 - protein, 9 aa, Artificial Sequence
  Description of Artificial Sequence: Synthetic peptide
  Seed: KYIKTWRPR (AKT1 E17K)
KSIKTWRPM

SEQ ID NO: 1099 - protein, 9 aa, Artificial Sequence
  Description of Artificial Sequence: Synthetic peptide
  Seed: KYIKTWRPR (AKT1 E17K)
KSIKTWRPN

SEQ ID NO: 1100 - protein, 9 aa, Artificial Sequence
  Description of Artificial Sequence: Synthetic peptide
  Seed: KYIKTWRPR (AKT1 E17K)
KSIKTWRPP

SEQ ID NO: 1101 - protein, 9 aa, Artificial Sequence
  Description of Artificial Sequence: Synthetic peptide
  Seed: KYIKTWRPR (AKT1 E17K)
KSIKTWRPQ

SEQ ID NO: 1102 - protein, 9 aa, Artificial Sequence
  Description of Artificial Sequence: Synthetic peptide
  Seed: KYIKTWRPR (AKT1 E17K)
KSIKTWRPR

SEQ ID NO: 1103 - protein, 10 aa, Artificial Sequence
  Description of Artificial Sequence: Synthetic peptide
  Seed: KYIKTWRPRY (AKT1 E17K)
KSIKTWRPRA

SEQ ID NO: 1104 - protein, 10 aa, Artificial Sequence
  Description of Artificial Sequence: Synthetic peptide
  Seed: KYIKTWRPRY (AKT1 E17K)
KSIKTWRPRC

SEQ ID NO: 1105 - protein, 10 aa, Artificial Sequence
  Description of Artificial Sequence: Synthetic peptide
  Seed: KYIKTWRPRY (AKT1 E17K)
KSIKTWRPRD

SEQ ID NO: 1106 - protein, 10 aa, Artificial Sequence
  Description of Artificial Sequence: Synthetic peptide
  Seed: KYIKTWRPRY (AKT1 E17K)
KSIKTWRPRE

SEQ ID NO: 1107 - protein, 10 aa, Artificial Sequence
  Description of Artificial Sequence: Synthetic peptide
  Seed: KYIKTWRPRY (AKT1 E17K)
KSIKTWRPRF

SEQ ID NO: 1108 - protein, 10 aa, Artificial Sequence
  Description of Artificial Sequence: Synthetic peptide
  Seed: KYIKTWRPRY (AKT1 E17K)
KSIKTWRPRG

SEQ ID NO: 1109 - protein, 10 aa, Artificial Sequence
  Description of Artificial Sequence: Synthetic peptide
  Seed: KYIKTWRPRY (AKT1 E17K)
KSIKTWRPRH

SEQ ID NO: 1110 - protein, 10 aa, Artificial Sequence
  Description of Artificial Sequence: Synthetic peptide
  Seed: KYIKTWRPRY (AKT1 E17K)
KSIKTWRPRI

SEQ ID NO: 1111 - protein, 10 aa, Artificial Sequence
  Description of Artificial Sequence: Synthetic peptide
  Seed: KYIKTWRPRY (AKT1 E17K)
KSIKTWRPRK

SEQ ID NO: 1112 - protein, 10 aa, Artificial Sequence
  Description of Artificial Sequence: Synthetic peptide
  Seed: KYIKTWRPRY (AKT1 E17K)
KSIKTWRPRL

SEQ ID NO: 1113 - protein, 10 aa, Artificial Sequence
  Description of Artificial Sequence: Synthetic peptide
  Seed: KYIKTWRPRY (AKT1 E17K)
KSIKTWRPRM

SEQ ID NO: 1114 - protein, 10 aa, Artificial Sequence
  Description of Artificial Sequence: Synthetic peptide
  Seed: KYIKTWRPRY (AKT1 E17K)
KSIKTWRPRN

SEQ ID NO: 1115 - protein, 10 aa, Artificial Sequence
  Description of Artificial Sequence: Synthetic peptide
  Seed: KYIKTWRPRY (AKT1 E17K)
KSIKTWRPRP

SEQ ID NO: 1116 - protein, 10 aa, Artificial Sequence
  Description of Artificial Sequence: Synthetic peptide
  Seed: KYIKTWRPRY (AKT1 E17K)
KSIKTWRPRQ

SEQ ID NO: 1117 - protein, 10 aa, Artificial Sequence
  Description of Artificial Sequence: Synthetic peptide
  Seed: KYIKTWRPRY (AKT1 E17K)
KSIKTWRPRR

SEQ ID NO: 1118 - protein, 10 aa, Artificial Sequence
  Description of Artificial Sequence: Synthetic peptide
  Seed: KYIKTWRPRY (AKT1 E17K)
KSIKTWRPRS

SEQ ID NO: 1119 - protein, 10 aa, Artificial Sequence
  Description of Artificial Sequence: Synthetic peptide
  Seed: KYIKTWRPRY (AKT1 E17K)
KSIKTWRPRT

SEQ ID NO: 1120 - protein, 10 aa, Artificial Sequence
  Description of Artificial Sequence: Synthetic peptide
  Seed: KYIKTWRPRY (AKT1 E17K)
KSIKTWRPRV

SEQ ID NO: 1121 - protein, 10 aa, Artificial Sequence
  Description of Artificial Sequence: Synthetic peptide
  Seed: KYIKTWRPRY (AKT1 E17K)
KSIKTWRPRW

SEQ ID NO: 1122 - protein, 10 aa, Artificial Sequence
  Description of Artificial Sequence: Synthetic peptide
  Seed: KYIKTWRPRY (AKT1 E17K)
KSIKTWRPRY

SEQ ID NO: 1123 - protein, 9 aa, Artificial Sequence
  Description of Artificial Sequence: Synthetic peptide
  Seed: KYIKTWRPR (AKT1 E17K)
KSIKTWRPS

SEQ ID NO: 1124 - protein, 9 aa, Artificial Sequence
  Description of Artificial Sequence: Synthetic peptide
  Seed: KYIKTWRPR (AKT1 E17K)
KSIKTWRPT

SEQ ID NO: 1125 - protein, 9 aa, Artificial Sequence
  Description of Artificial Sequence: Synthetic peptide
  Seed: KYIKTWRPR (AKT1 E17K)
KSIKTWRPV

SEQ ID NO: 1126 - protein, 9 aa, Artificial Sequence
  Description of Artificial Sequence: Synthetic peptide
  Seed: KYIKTWRPR (AKT1 E17K)
KSIKTWRPY

SEQ ID NO: 1127 - protein, 10 aa, Artificial Sequence
  Description of Artificial Sequence: Synthetic peptide
  Seed: KRGKYIKTWR (AKT1 E17K)
KTGKYIKTWK

SEQ ID NO: 1128 - protein, 10 aa, Artificial Sequence
  Description of Artificial Sequence: Synthetic peptide
  Seed: KRGKYIKTWR (AKT1 E17K)
KTGKYIKTWR

SEQ ID NO: 1129 - protein, 9 aa, Artificial Sequence
  Description of Artificial Sequence: Synthetic peptide
  Seed: KYIKTWRPR (AKT1 E17K)
KTIKTWRPA

SEQ ID NO: 1130 - protein, 9 aa, Artificial Sequence
  Description of Artificial Sequence: Synthetic peptide
  Seed: KYIKTWRPR (AKT1 E17K)
KTIKTWRPC

SEQ ID NO: 1131 - protein, 9 aa, Artificial Sequence
  Description of Artificial Sequence: Synthetic peptide
  Seed: KYIKTWRPR (AKT1 E17K)
KTIKTWRPE

SEQ ID NO: 1132 - protein, 9 aa, Artificial Sequence
  Description of Artificial Sequence: Synthetic peptide
  Seed: KYIKTWRPR (AKT1 E17K)
KTIKTWRPF

SEQ ID NO: 1133 - protein, 9 aa, Artificial Sequence
  Description of Artificial Sequence: Synthetic peptide
  Seed: KYIKTWRPR (AKT1 E17K)
KTIKTWRPG

SEQ ID NO: 1134 - protein, 9 aa, Artificial Sequence
  Description of Artificial Sequence: Synthetic peptide
  Seed: KYIKTWRPR (AKT1 E17K)
KTIKTWRPH

SEQ ID NO: 1135 - protein, 9 aa, Artificial Sequence
  Description of Artificial Sequence: Synthetic peptide
  Seed: KYIKTWRPR (AKT1 E17K)
KTIKTWRPI

SEQ ID NO: 1136 - protein, 9 aa, Artificial Sequence
  Description of Artificial Sequence: Synthetic peptide
  Seed: KYIKTWRPR (AKT1 E17K)
KTIKTWRPK

SEQ ID NO: 1137 - protein, 9 aa, Artificial Sequence
  Description of Artificial Sequence: Synthetic peptide
  Seed: KYIKTWRPR (AKT1 E17K)
KTIKTWRPL

SEQ ID NO: 1138 - protein, 9 aa, Artificial Sequence
  Description of Artificial Sequence: Synthetic peptide
  Seed: KYIKTWRPR (AKT1 E17K)
KTIKTWRPM

SEQ ID NO: 1139 - protein, 9 aa, Artificial Sequence
  Description of Artificial Sequence: Synthetic peptide
  Seed: KYIKTWRPR (AKT1 E17K)
KTIKTWRPN

SEQ ID NO: 1140 - protein, 9 aa, Artificial Sequence
  Description of Artificial Sequence: Synthetic peptide
  Seed: KYIKTWRPR (AKT1 E17K)
KTIKTWRPP

SEQ ID NO: 1141 - protein, 9 aa, Artificial Sequence
  Description of Artificial Sequence: Synthetic peptide
  Seed: KYIKTWRPR (AKT1 E17K)
KTIKTWRPQ

SEQ ID NO: 1142 - protein, 9 aa, Artificial Sequence
  Description of Artificial Sequence: Synthetic peptide
  Seed: KYIKTWRPR (AKT1 E17K)
KTIKTWRPR

SEQ ID NO: 1143 - protein, 10 aa, Artificial Sequence
  Description of Artificial Sequence: Synthetic peptide
  Seed: KYIKTWRPRY (AKT1 E17K)
KTIKTWRPRA

SEQ ID NO: 1144 - protein, 10 aa, Artificial Sequence
  Description of Artificial Sequence: Synthetic peptide
  Seed: KYIKTWRPRY (AKT1 E17K)
KTIKTWRPRC

SEQ ID NO: 1145 - protein, 10 aa, Artificial Sequence
  Description of Artificial Sequence: Synthetic peptide
  Seed: KYIKTWRPRY (AKT1 E17K)
KTIKTWRPRD

SEQ ID NO: 1146 - protein, 10 aa, Artificial Sequence
  Description of Artificial Sequence: Synthetic peptide
  Seed: KYIKTWRPRY (AKT1 E17K)
KTIKTWRPRE

SEQ ID NO: 1147 - protein, 10 aa, Artificial Sequence
  Description of Artificial Sequence: Synthetic peptide
  Seed: KYIKTWRPRY (AKT1 E17K)
KTIKTWRPRF

SEQ ID NO: 1148 - protein, 10 aa, Artificial Sequence
  Description of Artificial Sequence: Synthetic peptide
  Seed: KYIKTWRPRY (AKT1 E17K)
KTIKTWRPRG

SEQ ID NO: 1149 - protein, 10 aa, Artificial Sequence
  Description of Artificial Sequence: Synthetic peptide
  Seed: KYIKTWRPRY (AKT1 E17K)
KTIKTWRPRH

SEQ ID NO: 1150 - protein, 10 aa, Artificial Sequence
  Description of Artificial Sequence: Synthetic peptide
  Seed: KYIKTWRPRY (AKT1 E17K)
KTIKTWRPRI

SEQ ID NO: 1151 - protein, 10 aa, Artificial Sequence
  Description of Artificial Sequence: Synthetic peptide
  Seed: KYIKTWRPRY (AKT1 E17K)
KTIKTWRPRK

SEQ ID NO: 1152 - protein, 10 aa, Artificial Sequence
  Description of Artificial Sequence: Synthetic peptide
  Seed: KYIKTWRPRY (AKT1 E17K)
KTIKTWRPRL

SEQ ID NO: 1153 - protein, 10 aa, Artificial Sequence
  Description of Artificial Sequence: Synthetic peptide
  Seed: KYIKTWRPRY (AKT1 E17K)
KTIKTWRPRM

SEQ ID NO: 1154 - protein, 10 aa, Artificial Sequence
  Description of Artificial Sequence: Synthetic peptide
  Seed: KYIKTWRPRY (AKT1 E17K)
KTIKTWRPRN

SEQ ID NO: 1155 - protein, 10 aa, Artificial Sequence
  Description of Artificial Sequence: Synthetic peptide
  Seed: KYIKTWRPRY (AKT1 E17K)
KTIKTWRPRP

SEQ ID NO: 1156 - protein, 10 aa, Artificial Sequence
  Description of Artificial Sequence: Synthetic peptide
  Seed: KYIKTWRPRY (AKT1 E17K)
KTIKTWRPRQ

SEQ ID NO: 1157 - protein, 10 aa, Artificial Sequence
  Description of Artificial Sequence: Synthetic peptide
  Seed: KYIKTWRPRY (AKT1 E17K)
KTIKTWRPRR

SEQ ID NO: 1158 - protein, 10 aa, Artificial Sequence
  Description of Artificial Sequence: Synthetic peptide
  Seed: KYIKTWRPRY (AKT1 E17K)
KTIKTWRPRS

SEQ ID NO: 1159 - protein, 10 aa, Artificial Sequence
  Description of Artificial Sequence: Synthetic peptide
  Seed: KYIKTWRPRY (AKT1 E17K)
KTIKTWRPRT

SEQ ID NO: 1160 - protein, 10 aa, Artificial Sequence
  Description of Artificial Sequence: Synthetic peptide
  Seed: KYIKTWRPRY (AKT1 E17K)
KTIKTWRPRV

SEQ ID NO: 1161 - protein, 10 aa, Artificial Sequence
  Description of Artificial Sequence: Synthetic peptide
  Seed: KYIKTWRPRY (AKT1 E17K)
KTIKTWRPRW

SEQ ID NO: 1162 - protein, 10 aa, Artificial Sequence
  Description of Artificial Sequence: Synthetic peptide
  Seed: KYIKTWRPRY (AKT1 E17K)
KTIKTWRPRY

SEQ ID NO: 1163 - protein, 9 aa, Artificial Sequence
  Description of Artificial Sequence: Synthetic peptide
  Seed: KYIKTWRPR (AKT1 E17K)
KTIKTWRPS

SEQ ID NO: 1164 - protein, 9 aa, Artificial Sequence
  Description of Artificial Sequence: Synthetic peptide
  Seed: KYIKTWRPR (AKT1 E17K)
KTIKTWRPT

SEQ ID NO: 1165 - protein, 9 aa, Artificial Sequence
  Description of Artificial Sequence: Synthetic peptide
  Seed: KYIKTWRPR (AKT1 E17K)
KTIKTWRPV

SEQ ID NO: 1166 - protein, 9 aa, Artificial Sequence
  Description of Artificial Sequence: Synthetic peptide
  Seed: KYIKTWRPR (AKT1 E17K)
KTIKTWRPY

SEQ ID NO: 1167 - protein, 10 aa, Artificial Sequence
  Description of Artificial Sequence: Synthetic peptide
  Seed: KRGKYIKTWR (AKT1 E17K)
KVGKYIKTWK

SEQ ID NO: 1168 - protein, 10 aa, Artificial Sequence
  Description of Artificial Sequence: Synthetic peptide
  Seed: KRGKYIKTWR (AKT1 E17K)
KVGKYIKTWR

SEQ ID NO: 1169 - protein, 9 aa, Artificial Sequence
  Description of Artificial Sequence: Synthetic peptide
  Seed: KYIKTWRPR (AKT1 E17K)
KVIKTWRPA

SEQ ID NO: 1170 - protein, 9 aa, Artificial Sequence
  Description of Artificial Sequence: Synthetic peptide
  Seed: KYIKTWRPR (AKT1 E17K)
KVIKTWRPC

SEQ ID NO: 1171 - protein, 9 aa, Artificial Sequence
  Description of Artificial Sequence: Synthetic peptide
  Seed: KYIKTWRPR (AKT1 E17K)
KVIKTWRPE

SEQ ID NO: 1172 - protein, 9 aa, Artificial Sequence
  Description of Artificial Sequence: Synthetic peptide
  Seed: KYIKTWRPR (AKT1 E17K)
KVIKTWRPF

SEQ ID NO: 1173 - protein, 9 aa, Artificial Sequence
  Description of Artificial Sequence: Synthetic peptide
  Seed: KYIKTWRPR (AKT1 E17K)
KVIKTWRPG

SEQ ID NO: 1174 - protein, 9 aa, Artificial Sequence
  Description of Artificial Sequence: Synthetic peptide
  Seed: KYIKTWRPR (AKT1 E17K)
KVIKTWRPH

SEQ ID NO: 1175 - protein, 9 aa, Artificial Sequence
  Description of Artificial Sequence: Synthetic peptide
  Seed: KYIKTWRPR (AKT1 E17K)
KVIKTWRPI

SEQ ID NO: 1176 - protein, 9 aa, Artificial Sequence
  Description of Artificial Sequence: Synthetic peptide
  Seed: KYIKTWRPR (AKT1 E17K)
KVIKTWRPK

SEQ ID NO: 1177 - protein, 9 aa, Artificial Sequence
  Description of Artificial Sequence: Synthetic peptide
  Seed: KYIKTWRPR (AKT1 E17K)
KVIKTWRPL

SEQ ID NO: 1178 - protein, 9 aa, Artificial Sequence
  Description of Artificial Sequence: Synthetic peptide
  Seed: KYIKTWRPR (AKT1 E17K)
KVIKTWRPM

SEQ ID NO: 1179 - protein, 9 aa, Artificial Sequence
  Description of Artificial Sequence: Synthetic peptide
  Seed: KYIKTWRPR (AKT1 E17K)
KVIKTWRPN

SEQ ID NO: 1180 - protein, 9 aa, Artificial Sequence
  Description of Artificial Sequence: Synthetic peptide
  Seed: KYIKTWRPR (AKT1 E17K)
KVIKTWRPP

SEQ ID NO: 1181 - protein, 9 aa, Artificial Sequence
  Description of Artificial Sequence: Synthetic peptide
  Seed: KYIKTWRPR (AKT1 E17K)
KVIKTWRPQ

SEQ ID NO: 1182 - protein, 9 aa, Artificial Sequence
  Description of Artificial Sequence: Synthetic peptide
  Seed: KYIKTWRPR (AKT1 E17K)
KVIKTWRPR

SEQ ID NO: 1183 - protein, 10 aa, Artificial Sequence
  Description of Artificial Sequence: Synthetic peptide
  Seed: KYIKTWRPRY (AKT1 E17K)
KVIKTWRPRA

SEQ ID NO: 1184 - protein, 10 aa, Artificial Sequence
  Description of Artificial Sequence: Synthetic peptide
  Seed: KYIKTWRPRY (AKT1 E17K)
KVIKTWRPRC

SEQ ID NO: 1185 - protein, 10 aa, Artificial Sequence
  Description of Artificial Sequence: Synthetic peptide
  Seed: KYIKTWRPRY (AKT1 E17K)
KVIKTWRPRD

SEQ ID NO: 1186 - protein, 10 aa, Artificial Sequence
  Description of Artificial Sequence: Synthetic peptide
  Seed: KYIKTWRPRY (AKT1 E17K)
KVIKTWRPRE

SEQ ID NO: 1187 - protein, 10 aa, Artificial Sequence
  Description of Artificial Sequence: Synthetic peptide
  Seed: KYIKTWRPRY (AKT1 E17K)
KVIKTWRPRF

SEQ ID NO: 1188 - protein, 10 aa, Artificial Sequence
  Description of Artificial Sequence: Synthetic peptide
  Seed: KYIKTWRPRY (AKT1 E17K)
KVIKTWRPRG

SEQ ID NO: 1189 - protein, 10 aa, Artificial Sequence
  Description of Artificial Sequence: Synthetic peptide
  Seed: KYIKTWRPRY (AKT1 E17K)
KVIKTWRPRH

SEQ ID NO: 1190 - protein, 10 aa, Artificial Sequence
  Description of Artificial Sequence: Synthetic peptide
  Seed: KYIKTWRPRY (AKT1 E17K)
KVIKTWRPRI

SEQ ID NO: 1191 - protein, 10 aa, Artificial Sequence
  Description of Artificial Sequence: Synthetic peptide
  Seed: KYIKTWRPRY (AKT1 E17K)
KVIKTWRPRK

SEQ ID NO: 1192 - protein, 10 aa, Artificial Sequence
  Description of Artificial Sequence: Synthetic peptide
  Seed: KYIKTWRPRY (AKT1 E17K)
KVIKTWRPRL

SEQ ID NO: 1193 - protein, 10 aa, Artificial Sequence
  Description of Artificial Sequence: Synthetic peptide
  Seed: KYIKTWRPRY (AKT1 E17K)
KVIKTWRPRM

SEQ ID NO: 1194 - protein, 10 aa, Artificial Sequence
  Description of Artificial Sequence: Synthetic peptide
  Seed: KYIKTWRPRY (AKT1 E17K)
KVIKTWRPRN

SEQ ID NO: 1195 - protein, 10 aa, Artificial Sequence
  Description of Artificial Sequence: Synthetic peptide
  Seed: KYIKTWRPRY (AKT1 E17K)
KVIKTWRPRP

SEQ ID NO: 1196 - protein, 10 aa, Artificial Sequence
  Description of Artificial Sequence: Synthetic peptide
  Seed: KYIKTWRPRY (AKT1 E17K)
KVIKTWRPRQ

SEQ ID NO: 1197 - protein, 10 aa, Artificial Sequence
  Description of Artificial Sequence: Synthetic peptide
  Seed: KYIKTWRPRY (AKT1 E17K)
KVIKTWRPRR

SEQ ID NO: 1198 - protein, 10 aa, Artificial Sequence
  Description of Artificial Sequence: Synthetic peptide
  Seed: KYIKTWRPRY (AKT1 E17K)
KVIKTWRPRS

SEQ ID NO: 1199 - protein, 10 aa, Artificial Sequence
  Description of Artificial Sequence: Synthetic peptide
  Seed: KYIKTWRPRY (AKT1 E17K)
KVIKTWRPRT

SEQ ID NO: 1200 - protein, 10 aa, Artificial Sequence
  Description of Artificial Sequence: Synthetic peptide
  Seed: KYIKTWRPRY (AKT1 E17K)
KVIKTWRPRV

SEQ ID NO: 1201 - protein, 10 aa, Artificial Sequence
  Description of Artificial Sequence: Synthetic peptide
  Seed: KYIKTWRPRY (AKT1 E17K)
KVIKTWRPRW

SEQ ID NO: 1202 - protein, 9 aa, Artificial Sequence
  Description of Artificial Sequence: Synthetic peptide
  Seed: KYIKTWRPR (AKT1 E17K)
KVIKTWRPS

SEQ ID NO: 1203 - protein, 9 aa, Artificial Sequence
  Description of Artificial Sequence: Synthetic peptide
  Seed: KYIKTWRPR (AKT1 E17K)
KVIKTWRPT

SEQ ID NO: 1204 - protein, 9 aa, Artificial Sequence
  Description of Artificial Sequence: Synthetic peptide
  Seed: KYIKTWRPR (AKT1 E17K)
KVIKTWRPV

SEQ ID NO: 1205 - protein, 9 aa, Artificial Sequence
  Description of Artificial Sequence: Synthetic peptide
  Seed: KYIKTWRPR (AKT1 E17K)
KVIKTWRPY

SEQ ID NO: 1206 - protein, 10 aa, Artificial Sequence
  Description of Artificial Sequence: Synthetic peptide
  Seed: KRGKYIKTWR (AKT1 E17K)
KWGKYIKTWK

SEQ ID NO: 1207 - protein, 10 aa, Artificial Sequence
  Description of Artificial Sequence: Synthetic peptide
  Seed: KRGKYIKTWR (AKT1 E17K)
KWGKYIKTWR

SEQ ID NO: 1208 - protein, 9 aa, Artificial Sequence
  Description of Artificial Sequence: Synthetic peptide
  Seed: KYIKTWRPR (AKT1 E17K)
KWIKTWRPA

SEQ ID NO: 1209 - protein, 9 aa, Artificial Sequence
  Description of Artificial Sequence: Synthetic peptide
  Seed: KYIKTWRPR (AKT1 E17K)
KWIKTWRPG

SEQ ID NO: 1210 - protein, 9 aa, Artificial Sequence
  Description of Artificial Sequence: Synthetic peptide
  Seed: KYIKTWRPR (AKT1 E17K)
KWIKTWRPH

SEQ ID NO: 1211 - protein, 9 aa, Artificial Sequence
  Description of Artificial Sequence: Synthetic peptide
  Seed: KYIKTWRPR (AKT1 E17K)
KWIKTWRPI

SEQ ID NO: 1212 - protein, 9 aa, Artificial Sequence
  Description of Artificial Sequence: Synthetic peptide
  Seed: KYIKTWRPR (AKT1 E17K)
KWIKTWRPK

SEQ ID NO: 1213 - protein, 9 aa, Artificial Sequence
  Description of Artificial Sequence: Synthetic peptide
  Seed: KYIKTWRPR (AKT1 E17K)
KWIKTWRPL

SEQ ID NO: 1214 - protein, 9 aa, Artificial Sequence
  Description of Artificial Sequence: Synthetic peptide
  Seed: KYIKTWRPR (AKT1 E17K)
KWIKTWRPM

SEQ ID NO: 1215 - protein, 9 aa, Artificial Sequence
  Description of Artificial Sequence: Synthetic peptide
  Seed: KYIKTWRPR (AKT1 E17K)
KWIKTWRPR

SEQ ID NO: 1216 - protein, 10 aa, Artificial Sequence
  Description of Artificial Sequence: Synthetic peptide
  Seed: KYIKTWRPRY (AKT1 E17K)
KWIKTWRPRA

SEQ ID NO: 1217 - protein, 10 aa, Artificial Sequence
  Description of Artificial Sequence: Synthetic peptide
  Seed: KYIKTWRPRY (AKT1 E17K)
KWIKTWRPRC

SEQ ID NO: 1218 - protein, 10 aa, Artificial Sequence
  Description of Artificial Sequence: Synthetic peptide
  Seed: KYIKTWRPRY (AKT1 E17K)
KWIKTWRPRD

SEQ ID NO: 1219 - protein, 10 aa, Artificial Sequence
  Description of Artificial Sequence: Synthetic peptide
  Seed: KYIKTWRPRY (AKT1 E17K)
KWIKTWRPRE

SEQ ID NO: 1220 - protein, 10 aa, Artificial Sequence
  Description of Artificial Sequence: Synthetic peptide
  Seed: KYIKTWRPRY (AKT1 E17K)
KWIKTWRPRF

SEQ ID NO: 1221 - protein, 10 aa, Artificial Sequence
  Description of Artificial Sequence: Synthetic peptide
  Seed: KYIKTWRPRY (AKT1 E17K)
KWIKTWRPRG

SEQ ID NO: 1222 - protein, 10 aa, Artificial Sequence
  Description of Artificial Sequence: Synthetic peptide
  Seed: KYIKTWRPRY (AKT1 E17K)
KWIKTWRPRH

SEQ ID NO: 1223 - protein, 10 aa, Artificial Sequence
  Description of Artificial Sequence: Synthetic peptide
  Seed: KYIKTWRPRY (AKT1 E17K)
KWIKTWRPRI

SEQ ID NO: 1224 - protein, 10 aa, Artificial Sequence
  Description of Artificial Sequence: Synthetic peptide
  Seed: KYIKTWRPRY (AKT1 E17K)
KWIKTWRPRK

SEQ ID NO: 1225 - protein, 10 aa, Artificial Sequence
  Description of Artificial Sequence: Synthetic peptide
  Seed: KYIKTWRPRY (AKT1 E17K)
KWIKTWRPRL

SEQ ID NO: 1226 - protein, 10 aa, Artificial Sequence
  Description of Artificial Sequence: Synthetic peptide
  Seed: KYIKTWRPRY (AKT1 E17K)
KWIKTWRPRM

SEQ ID NO: 1227 - protein, 10 aa, Artificial Sequence
  Description of Artificial Sequence: Synthetic peptide
  Seed: KYIKTWRPRY (AKT1 E17K)
KWIKTWRPRN

SEQ ID NO: 1228 - protein, 10 aa, Artificial Sequence
  Description of Artificial Sequence: Synthetic peptide
  Seed: KYIKTWRPRY (AKT1 E17K)
KWIKTWRPRP

SEQ ID NO: 1229 - protein, 10 aa, Artificial Sequence
  Description of Artificial Sequence: Synthetic peptide
  Seed: KYIKTWRPRY (AKT1 E17K)
KWIKTWRPRQ

SEQ ID NO: 1230 - protein, 10 aa, Artificial Sequence
  Description of Artificial Sequence: Synthetic peptide
  Seed: KYIKTWRPRY (AKT1 E17K)
KWIKTWRPRR

SEQ ID NO: 1231 - protein, 10 aa, Artificial Sequence
  Description of Artificial Sequence: Synthetic peptide
  Seed: KYIKTWRPRY (AKT1 E17K)
KWIKTWRPRS

SEQ ID NO: 1232 - protein, 10 aa, Artificial Sequence
  Description of Artificial Sequence: Synthetic peptide
  Seed: KYIKTWRPRY (AKT1 E17K)
KWIKTWRPRT

SEQ ID NO: 1233 - protein, 10 aa, Artificial Sequence
  Description of Artificial Sequence: Synthetic peptide
  Seed: KYIKTWRPRY (AKT1 E17K)
KWIKTWRPRV

SEQ ID NO: 1234 - protein, 10 aa, Artificial Sequence
  Description of Artificial Sequence: Synthetic peptide
  Seed: KYIKTWRPRY (AKT1 E17K)
KWIKTWRPRW

SEQ ID NO: 1235 - protein, 10 aa, Artificial Sequence
  Description of Artificial Sequence: Synthetic peptide
  Seed: KYIKTWRPRY (AKT1 E17K)
KWIKTWRPRY

SEQ ID NO: 1236 - protein, 11 aa, Artificial Sequence
  Description of Artificial Sequence: Synthetic peptide
  Seed: KYIKTWRPRYF (AKT1 E17K)
KWIKTWRPRYF

SEQ ID NO: 1237 - protein, 11 aa, Artificial Sequence
  Description of Artificial Sequence: Synthetic peptide
  Seed: KYIKTWRPRYF (AKT1 E17K)
KWIKTWRPRYI

SEQ ID NO: 1238 - protein, 11 aa, Artificial Sequence
  Description of Artificial Sequence: Synthetic peptide
  Seed: KYIKTWRPRYF (AKT1 E17K)
KWIKTWRPRYL

SEQ ID NO: 1239 - protein, 11 aa, Artificial Sequence
  Description of Artificial Sequence: Synthetic peptide
  Seed: KYIKTWRPRYF (AKT1 E17K)
KWIKTWRPRYM

SEQ ID NO: 1240 - protein, 11 aa, Artificial Sequence
  Description of Artificial Sequence: Synthetic peptide
  Seed: KYIKTWRPRYF (AKT1 E17K)
KWIKTWRPRYW

SEQ ID NO: 1241 - protein, 9 aa, Artificial Sequence
  Description of Artificial Sequence: Synthetic peptide
  Seed: KYIKTWRPR (AKT1 E17K)
KWIKTWRPS

SEQ ID NO: 1242 - protein, 9 aa, Artificial Sequence
  Description of Artificial Sequence: Synthetic peptide
  Seed: KYIKTWRPR (AKT1 E17K)
KWIKTWRPV

SEQ ID NO: 1243 - protein, 9 aa, Artificial Sequence
  Description of Artificial Sequence: Synthetic peptide
  Seed: KYIKTWRPR (AKT1 E17K)
KWIKTWRPY

SEQ ID NO: 1244 - protein, 10 aa, Artificial Sequence
  Description of Artificial Sequence: Synthetic peptide
  Seed: KRGKYIKTWR (AKT1 E17K)
KYGKYIKTWK

SEQ ID NO: 1245 - protein, 10 aa, Artificial Sequence
  Description of Artificial Sequence: Synthetic peptide
  Seed: KRGKYIKTWR (AKT1 E17K)
KYGKYIKTWR

SEQ ID NO: 1246 - protein, 9 aa, Artificial Sequence
  Description of Artificial Sequence: Synthetic peptide
  Seed: KYIKTWRPR (AKT1 E17K)
KYIKTWRPA

SEQ ID NO: 1247 - protein, 9 aa, Artificial Sequence
  Description of Artificial Sequence: Synthetic peptide
  Seed: KYIKTWRPR (AKT1 E17K)
KYIKTWRPC

SEQ ID NO: 1248 - protein, 9 aa, Artificial Sequence
  Description of Artificial Sequence: Synthetic peptide
  Seed: KYIKTWRPR (AKT1 E17K)
KYIKTWRPE

SEQ ID NO: 1249 - protein, 9 aa, Artificial Sequence
  Description of Artificial Sequence: Synthetic peptide
  Seed: KYIKTWRPR (AKT1 E17K)
KYIKTWRPG

SEQ ID NO: 1250 - protein, 9 aa, Artificial Sequence
  Description of Artificial Sequence: Synthetic peptide
  Seed: KYIKTWRPR (AKT1 E17K)
KYIKTWRPH

SEQ ID NO: 1251 - protein, 9 aa, Artificial Sequence
  Description of Artificial Sequence: Synthetic peptide
  Seed: KYIKTWRPR (AKT1 E17K)
KYIKTWRPI

SEQ ID NO: 1252 - protein, 9 aa, Artificial Sequence
  Description of Artificial Sequence: Synthetic peptide
  Seed: KYIKTWRPR (AKT1 E17K)
KYIKTWRPK

SEQ ID NO: 1253 - protein, 9 aa, Artificial Sequence
  Description of Artificial Sequence: Synthetic peptide
  Seed: KYIKTWRPR (AKT1 E17K)
KYIKTWRPL

SEQ ID NO: 1254 - protein, 9 aa, Artificial Sequence
  Description of Artificial Sequence: Synthetic peptide
  Seed: KYIKTWRPR (AKT1 E17K)
KYIKTWRPM

SEQ ID NO: 1255 - protein, 9 aa, Artificial Sequence
  Description of Artificial Sequence: Synthetic peptide
  Seed: KYIKTWRPR (AKT1 E17K)
KYIKTWRPN

SEQ ID NO: 1256 - protein, 9 aa, Artificial Sequence
  Description of Artificial Sequence: Synthetic peptide
  Seed: KYIKTWRPR (AKT1 E17K)
KYIKTWRPP

SEQ ID NO: 1257 - protein, 9 aa, Artificial Sequence
  Description of Artificial Sequence: Synthetic peptide
  Seed: KYIKTWRPR (AKT1 E17K)
KYIKTWRPQ

SEQ ID NO: 1258 - protein, 10 aa, Artificial Sequence
  Description of Artificial Sequence: Synthetic peptide
  Seed: KYIKTWRPRY (AKT1 E17K)
KYIKTWRPRA

SEQ ID NO: 1259 - protein, 10 aa, Artificial Sequence
  Description of Artificial Sequence: Synthetic peptide
  Seed: KYIKTWRPRY (AKT1 E17K)
KYIKTWRPRC

SEQ ID NO: 1260 - protein, 10 aa, Artificial Sequence
  Description of Artificial Sequence: Synthetic peptide
  Seed: KYIKTWRPRY (AKT1 E17K)
KYIKTWRPRD

SEQ ID NO: 1261 - protein, 10 aa, Artificial Sequence
  Description of Artificial Sequence: Synthetic peptide
  Seed: KYIKTWRPRY (AKT1 E17K)
KYIKTWRPRE

SEQ ID NO: 1262 - protein, 10 aa, Artificial Sequence
  Description of Artificial Sequence: Synthetic peptide
  Seed: KYIKTWRPRY (AKT1 E17K)
KYIKTWRPRG

SEQ ID NO: 1263 - protein, 10 aa, Artificial Sequence
  Description of Artificial Sequence: Synthetic peptide
  Seed: KYIKTWRPRY (AKT1 E17K)
KYIKTWRPRH

SEQ ID NO: 1264 - protein, 10 aa, Artificial Sequence
  Description of Artificial Sequence: Synthetic peptide
  Seed: KYIKTWRPRY (AKT1 E17K)
KYIKTWRPRI

SEQ ID NO: 1265 - protein, 10 aa, Artificial Sequence
  Description of Artificial Sequence: Synthetic peptide
  Seed: KYIKTWRPRY (AKT1 E17K)
KYIKTWRPRK

SEQ ID NO: 1266 - protein, 10 aa, Artificial Sequence
  Description of Artificial Sequence: Synthetic peptide
  Seed: KYIKTWRPRY (AKT1 E17K)
KYIKTWRPRL

SEQ ID NO: 1267 - protein, 10 aa, Artificial Sequence
  Description of Artificial Sequence: Synthetic peptide
  Seed: KYIKTWRPRY (AKT1 E17K)
KYIKTWRPRM

SEQ ID NO: 1268 - protein, 10 aa, Artificial Sequence
  Description of Artificial Sequence: Synthetic peptide
  Seed: KYIKTWRPRY (AKT1 E17K)
KYIKTWRPRN

SEQ ID NO: 1269 - protein, 10 aa, Artificial Sequence
  Description of Artificial Sequence: Synthetic peptide
  Seed: KYIKTWRPRY (AKT1 E17K)
KYIKTWRPRP

SEQ ID NO: 1270 - protein, 10 aa, Artificial Sequence
  Description of Artificial Sequence: Synthetic peptide
  Seed: KYIKTWRPRY (AKT1 E17K)
KYIKTWRPRQ

SEQ ID NO: 1271 - protein, 10 aa, Artificial Sequence
  Description of Artificial Sequence: Synthetic peptide
  Seed: KYIKTWRPRY (AKT1 E17K)
KYIKTWRPRR

SEQ ID NO: 1272 - protein, 10 aa, Artificial Sequence
  Description of Artificial Sequence: Synthetic peptide
  Seed: KYIKTWRPRY (AKT1 E17K)
KYIKTWRPRS

SEQ ID NO: 1273 - protein, 10 aa, Artificial Sequence
  Description of Artificial Sequence: Synthetic peptide
  Seed: KYIKTWRPRY (AKT1 E17K)
KYIKTWRPRT

SEQ ID NO: 1274 - protein, 10 aa, Artificial Sequence
  Description of Artificial Sequence: Synthetic peptide
  Seed: KYIKTWRPRY (AKT1 E17K)
KYIKTWRPRV

SEQ ID NO: 1275 - protein, 10 aa, Artificial Sequence
  Description of Artificial Sequence: Synthetic peptide
  Seed: KYIKTWRPRY (AKT1 E17K)
KYIKTWRPRW

SEQ ID NO: 1276 - protein, 11 aa, Artificial Sequence
  Description of Artificial Sequence: Synthetic peptide
  Seed: KYIKTWRPRYF (AKT1 E17K)
KYIKTWRPRYI

SEQ ID NO: 1277 - protein, 11 aa, Artificial Sequence
  Description of Artificial Sequence: Synthetic peptide
  Seed: KYIKTWRPRYF (AKT1 E17K)
KYIKTWRPRYL

SEQ ID NO: 1278 - protein, 11 aa, Artificial Sequence
  Description of Artificial Sequence: Synthetic peptide
  Seed: KYIKTWRPRYF (AKT1 E17K)
KYIKTWRPRYM

SEQ ID NO: 1279 - protein, 11 aa, Artificial Sequence
  Description of Artificial Sequence: Synthetic peptide
  Seed: KYIKTWRPRYF (AKT1 E17K)
KYIKTWRPRYV

SEQ ID NO: 1280 - protein, 11 aa, Artificial Sequence
  Description of Artificial Sequence: Synthetic peptide
  Seed: KYIKTWRPRYF (AKT1 E17K)
KYIKTWRPRYW

SEQ ID NO: 1281 - protein, 9 aa, Artificial Sequence
  Description of Artificial Sequence: Synthetic peptide
  Seed: KYIKTWRPR (AKT1 E17K)
KYIKTWRPS

SEQ ID NO: 1282 - protein, 9 aa, Artificial Sequence
  Description of Artificial Sequence: Synthetic peptide
  Seed: KYIKTWRPR (AKT1 E17K)
KYIKTWRPT

SEQ ID NO: 1283 - protein, 9 aa, Artificial Sequence
  Description of Artificial Sequence: Synthetic peptide
  Seed: KYIKTWRPR (AKT1 E17K)
KYIKTWRPV

SEQ ID NO: 1284 - protein, 9 aa, Artificial Sequence
  Description of Artificial Sequence: Synthetic peptide
  Seed: KYIKTWRPR (AKT1 E17K)
KYIKTWRPY

SEQ ID NO: 1285 - protein, 9 aa, Artificial Sequence
  Description of Artificial Sequence: Synthetic peptide
  Seed: RGKYIKTWR (AKT1 E17K)
RAKYIKTWA

SEQ ID NO: 1286 - protein, 9 aa, Artificial Sequence
  Description of Artificial Sequence: Synthetic peptide
  Seed: RGKYIKTWR (AKT1 E17K)
RAKYIKTWC

SEQ ID NO: 1287 - protein, 9 aa, Artificial Sequence
  Description of Artificial Sequence: Synthetic peptide
  Seed: RGKYIKTWR (AKT1 E17K)
RAKYIKTWE

SEQ ID NO: 1288 - protein, 9 aa, Artificial Sequence
  Description of Artificial Sequence: Synthetic peptide
  Seed: RGKYIKTWR (AKT1 E17K)
RAKYIKTWF

SEQ ID NO: 1289 - protein, 9 aa, Artificial Sequence
  Description of Artificial Sequence: Synthetic peptide
  Seed: RGKYIKTWR (AKT1 E17K)
RAKYIKTWG

SEQ ID NO: 1290 - protein, 9 aa, Artificial Sequence
  Description of Artificial Sequence: Synthetic peptide
  Seed: RGKYIKTWR (AKT1 E17K)
RAKYIKTWH

SEQ ID NO: 1291 - protein, 9 aa, Artificial Sequence
  Description of Artificial Sequence: Synthetic peptide
  Seed: RGKYIKTWR (AKT1 E17K)
RAKYIKTWI

SEQ ID NO: 1292 - protein, 9 aa, Artificial Sequence
  Description of Artificial Sequence: Synthetic peptide
  Seed: RGKYIKTWR (AKT1 E17K)
RAKYIKTWK

SEQ ID NO: 1293 - protein, 9 aa, Artificial Sequence
  Description of Artificial Sequence: Synthetic peptide
  Seed: RGKYIKTWR (AKT1 E17K)
RAKYIKTWL

SEQ ID NO: 1294 - protein, 9 aa, Artificial Sequence
  Description of Artificial Sequence: Synthetic peptide
  Seed: RGKYIKTWR (AKT1 E17K)
RAKYIKTWM

SEQ ID NO: 1295 - protein, 9 aa, Artificial Sequence
  Description of Artificial Sequence: Synthetic peptide
  Seed: RGKYIKTWR (AKT1 E17K)
RAKYIKTWN

SEQ ID NO: 1296 - protein, 9 aa, Artificial Sequence
  Description of Artificial Sequence: Synthetic peptide
  Seed: RGKYIKTWR (AKT1 E17K)
RAKYIKTWP

SEQ ID NO: 1297 - protein, 9 aa, Artificial Sequence
  Description of Artificial Sequence: Synthetic peptide
  Seed: RGKYIKTWR (AKT1 E17K)
RAKYIKTWQ

SEQ ID NO: 1298 - protein, 9 aa, Artificial Sequence
  Description of Artificial Sequence: Synthetic peptide
  Seed: RGKYIKTWR (AKT1 E17K)
RAKYIKTWR

SEQ ID NO: 1299 - protein, 11 aa, Artificial Sequence
  Description of Artificial Sequence: Synthetic peptide
  Seed: RGKYIKTWRPR (AKT1 E17K)
RAKYIKTWRPK

SEQ ID NO: 1300 - protein, 11 aa, Artificial Sequence
  Description of Artificial Sequence: Synthetic peptide
  Seed: RGKYIKTWRPR (AKT1 E17K)
RAKYIKTWRPR

SEQ ID NO: 1301 - protein, 9 aa, Artificial Sequence
  Description of Artificial Sequence: Synthetic peptide
  Seed: RGKYIKTWR (AKT1 E17K)
RAKYIKTWS

SEQ ID NO: 1302 - protein, 9 aa, Artificial Sequence
  Description of Artificial Sequence: Synthetic peptide
  Seed: RGKYIKTWR (AKT1 E17K)
RAKYIKTWT

SEQ ID NO: 1303 - protein, 9 aa, Artificial Sequence
  Description of Artificial Sequence: Synthetic peptide
  Seed: RGKYIKTWR (AKT1 E17K)
RAKYIKTWV

SEQ ID NO: 1304 - protein, 9 aa, Artificial Sequence
  Description of Artificial Sequence: Synthetic peptide
  Seed: RGKYIKTWR (AKT1 E17K)
RAKYIKTWY

SEQ ID NO: 1305 - protein, 9 aa, Artificial Sequence
  Description of Artificial Sequence: Synthetic peptide
  Seed: RGKYIKTWR (AKT1 E17K)
RCKYIKTWA

SEQ ID NO: 1306 - protein, 9 aa, Artificial Sequence
  Description of Artificial Sequence: Synthetic peptide
  Seed: RGKYIKTWR (AKT1 E17K)
RCKYIKTWK

SEQ ID NO: 1307 - protein, 9 aa, Artificial Sequence
  Description of Artificial Sequence: Synthetic peptide
  Seed: RGKYIKTWR (AKT1 E17K)
RCKYIKTWR

SEQ ID NO: 1308 - protein, 11 aa, Artificial Sequence
  Description of Artificial Sequence: Synthetic peptide
  Seed: RGKYIKTWRPR (AKT1 E17K)
RCKYIKTWRPK

SEQ ID NO: 1309 - protein, 11 aa, Artificial Sequence
  Description of Artificial Sequence: Synthetic peptide
  Seed: RGKYIKTWRPR (AKT1 E17K)
RCKYIKTWRPR

SEQ ID NO: 1310 - protein, 11 aa, Artificial Sequence
  Description of Artificial Sequence: Synthetic peptide
  Seed: RGKYIKTWRPR (AKT1 E17K)
RDKYIKTWRPK

SEQ ID NO: 1311 - protein, 11 aa, Artificial Sequence
  Description of Artificial Sequence: Synthetic peptide
  Seed: RGKYIKTWRPR (AKT1 E17K)
RDKYIKTWRPR

SEQ ID NO: 1312 - protein, 11 aa, Artificial Sequence
  Description of Artificial Sequence: Synthetic peptide
  Seed: RGKYIKTWRPR (AKT1 E17K)
REKYIKTWRPK

SEQ ID NO: 1313 - protein, 11 aa, Artificial Sequence
  Description of Artificial Sequence: Synthetic peptide
  Seed: RGKYIKTWRPR (AKT1 E17K)
REKYIKTWRPR

SEQ ID NO: 1314 - protein, 9 aa, Artificial Sequence
  Description of Artificial Sequence: Synthetic peptide
  Seed: RGKYIKTWR (AKT1 E17K)
RFKYIKTWA

SEQ ID NO: 1315 - protein, 9 aa, Artificial Sequence
  Description of Artificial Sequence: Synthetic peptide
  Seed: RGKYIKTWR (AKT1 E17K)
RFKYIKTWC

SEQ ID NO: 1316 - protein, 9 aa, Artificial Sequence
  Description of Artificial Sequence: Synthetic peptide
  Seed: RGKYIKTWR (AKT1 E17K)
RFKYIKTWE

SEQ ID NO: 1317 - protein, 9 aa, Artificial Sequence
  Description of Artificial Sequence: Synthetic peptide
  Seed: RGKYIKTWR (AKT1 E17K)
RFKYIKTWF

SEQ ID NO: 1318 - protein, 9 aa, Artificial Sequence
  Description of Artificial Sequence: Synthetic peptide
  Seed: RGKYIKTWR (AKT1 E17K)
RFKYIKTWG

SEQ ID NO: 1319 - protein, 9 aa, Artificial Sequence
  Description of Artificial Sequence: Synthetic peptide
  Seed: RGKYIKTWR (AKT1 E17K)
RFKYIKTWH

SEQ ID NO: 1320 - protein, 9 aa, Artificial Sequence
  Description of Artificial Sequence: Synthetic peptide
  Seed: RGKYIKTWR (AKT1 E17K)
RFKYIKTWI

SEQ ID NO: 1321 - protein, 9 aa, Artificial Sequence
  Description of Artificial Sequence: Synthetic peptide
  Seed: RGKYIKTWR (AKT1 E17K)
RFKYIKTWK

SEQ ID NO: 1322 - protein, 9 aa, Artificial Sequence
  Description of Artificial Sequence: Synthetic peptide
  Seed: RGKYIKTWR (AKT1 E17K)
RFKYIKTWL

SEQ ID NO: 1323 - protein, 9 aa, Artificial Sequence
  Description of Artificial Sequence: Synthetic peptide
  Seed: RGKYIKTWR (AKT1 E17K)
RFKYIKTWM

SEQ ID NO: 1324 - protein, 9 aa, Artificial Sequence
  Description of Artificial Sequence: Synthetic peptide
  Seed: RGKYIKTWR (AKT1 E17K)
RFKYIKTWN

SEQ ID NO: 1325 - protein, 9 aa, Artificial Sequence
  Description of Artificial Sequence: Synthetic peptide
  Seed: RGKYIKTWR (AKT1 E17K)
RFKYIKTWP

SEQ ID NO: 1326 - protein, 9 aa, Artificial Sequence
  Description of Artificial Sequence: Synthetic peptide
  Seed: RGKYIKTWR (AKT1 E17K)
RFKYIKTWQ

SEQ ID NO: 1327 - protein, 9 aa, Artificial Sequence
  Description of Artificial Sequence: Synthetic peptide
  Seed: RGKYIKTWR (AKT1 E17K)
RFKYIKTWR

SEQ ID NO: 1328 - protein, 11 aa, Artificial Sequence
  Description of Artificial Sequence: Synthetic peptide
  Seed: RGKYIKTWRPR (AKT1 E17K)
RFKYIKTWRPK

SEQ ID NO: 1329 - protein, 11 aa, Artificial Sequence
  Description of Artificial Sequence: Synthetic peptide
  Seed: RGKYIKTWRPR (AKT1 E17K)
RFKYIKTWRPR

SEQ ID NO: 1330 - protein, 9 aa, Artificial Sequence
  Description of Artificial Sequence: Synthetic peptide
  Seed: RGKYIKTWR (AKT1 E17K)
RFKYIKTWS

SEQ ID NO: 1331 - protein, 9 aa, Artificial Sequence
  Description of Artificial Sequence: Synthetic peptide
  Seed: RGKYIKTWR (AKT1 E17K)
RFKYIKTWT

SEQ ID NO: 1332 - protein, 9 aa, Artificial Sequence
  Description of Artificial Sequence: Synthetic peptide
  Seed: RGKYIKTWR (AKT1 E17K)
RFKYIKTWV

SEQ ID NO: 1333 - protein, 9 aa, Artificial Sequence
  Description of Artificial Sequence: Synthetic peptide
  Seed: RGKYIKTWR (AKT1 E17K)
RFKYIKTWY

SEQ ID NO: 1334 - protein, 9 aa, Artificial Sequence
  Description of Artificial Sequence: Synthetic peptide
  Seed: RGKYIKTWR (AKT1 E17K)
RGKYIKTWA

SEQ ID NO: 1335 - protein, 9 aa, Artificial Sequence
  Description of Artificial Sequence: Synthetic peptide
  Seed: RGKYIKTWR (AKT1 E17K)
RGKYIKTWG

SEQ ID NO: 1336 - protein, 9 aa, Artificial Sequence
  Description of Artificial Sequence: Synthetic peptide
  Seed: RGKYIKTWR (AKT1 E17K)
RGKYIKTWI

SEQ ID NO: 1337 - protein, 9 aa, Artificial Sequence
  Description of Artificial Sequence: Synthetic peptide
  Seed: RGKYIKTWR (AKT1 E17K)
RGKYIKTWK

SEQ ID NO: 1338 - protein, 9 aa, Artificial Sequence
  Description of Artificial Sequence: Synthetic peptide
  Seed: RGKYIKTWR (AKT1 E17K)
RGKYIKTWL

SEQ ID NO: 1339 - protein, 9 aa, Artificial Sequence
  Description of Artificial Sequence: Synthetic peptide
  Seed: RGKYIKTWR (AKT1 E17K)
RGKYIKTWM

SEQ ID NO: 1340 - protein, 11 aa, Artificial Sequence
  Description of Artificial Sequence: Synthetic peptide
  Seed: RGKYIKTWRPR (AKT1 E17K)
RGKYIKTWRPK

SEQ ID NO: 1341 - protein, 9 aa, Artificial Sequence
  Description of Artificial Sequence: Synthetic peptide
  Seed: RGKYIKTWR (AKT1 E17K)
RGKYIKTWS

SEQ ID NO: 1342 - protein, 9 aa, Artificial Sequence
  Description of Artificial Sequence: Synthetic peptide
  Seed: RGKYIKTWR (AKT1 E17K)
RGKYIKTWT

SEQ ID NO: 1343 - protein, 9 aa, Artificial Sequence
  Description of Artificial Sequence: Synthetic peptide
  Seed: RGKYIKTWR (AKT1 E17K)
RGKYIKTWV

SEQ ID NO: 1344 - protein, 9 aa, Artificial Sequence
  Description of Artificial Sequence: Synthetic peptide
  Seed: RGKYIKTWR (AKT1 E17K)
RGKYIKTWY

SEQ ID NO: 1345 - protein, 9 aa, Artificial Sequence
  Description of Artificial Sequence: Synthetic peptide
  Seed: RGKYIKTWR (AKT1 E17K)
RHKYIKTWK

SEQ ID NO: 1346 - protein, 9 aa, Artificial Sequence
  Description of Artificial Sequence: Synthetic peptide
  Seed: RGKYIKTWR (AKT1 E17K)
RHKYIKTWR

SEQ ID NO: 1347 - protein, 11 aa, Artificial Sequence
  Description of Artificial Sequence: Synthetic peptide
  Seed: RGKYIKTWRPR (AKT1 E17K)
RHKYIKTWRPK

SEQ ID NO: 1348 - protein, 11 aa, Artificial Sequence
  Description of Artificial Sequence: Synthetic peptide
  Seed: RGKYIKTWRPR (AKT1 E17K)
RHKYIKTWRPR

SEQ ID NO: 1349 - protein, 9 aa, Artificial Sequence
  Description of Artificial Sequence: Synthetic peptide
  Seed: RGKYIKTWR (AKT1 E17K)
RIKYIKTWA

SEQ ID NO: 1350 - protein, 9 aa, Artificial Sequence
  Description of Artificial Sequence: Synthetic peptide
  Seed: RGKYIKTWR (AKT1 E17K)
RIKYIKTWC

SEQ ID NO: 1351 - protein, 9 aa, Artificial Sequence
  Description of Artificial Sequence: Synthetic peptide
  Seed: RGKYIKTWR (AKT1 E17K)
RIKYIKTWE

SEQ ID NO: 1352 - protein, 9 aa, Artificial Sequence
  Description of Artificial Sequence: Synthetic peptide
  Seed: RGKYIKTWR (AKT1 E17K)
RIKYIKTWF

SEQ ID NO: 1353 - protein, 9 aa, Artificial Sequence
  Description of Artificial Sequence: Synthetic peptide
  Seed: RGKYIKTWR (AKT1 E17K)
RIKYIKTWG

SEQ ID NO: 1354 - protein, 9 aa, Artificial Sequence
  Description of Artificial Sequence: Synthetic peptide
  Seed: RGKYIKTWR (AKT1 E17K)
RIKYIKTWH

SEQ ID NO: 1355 - protein, 9 aa, Artificial Sequence
  Description of Artificial Sequence: Synthetic peptide
  Seed: RGKYIKTWR (AKT1 E17K)
RIKYIKTWI

SEQ ID NO: 1356 - protein, 9 aa, Artificial Sequence
  Description of Artificial Sequence: Synthetic peptide
  Seed: RGKYIKTWR (AKT1 E17K)
RIKYIKTWK

SEQ ID NO: 1357 - protein, 9 aa, Artificial Sequence
  Description of Artificial Sequence: Synthetic peptide
  Seed: RGKYIKTWR (AKT1 E17K)
RIKYIKTWL

SEQ ID NO: 1358 - protein, 9 aa, Artificial Sequence
  Description of Artificial Sequence: Synthetic peptide
  Seed: RGKYIKTWR (AKT1 E17K)
RIKYIKTWM

SEQ ID NO: 1359 - protein, 9 aa, Artificial Sequence
  Description of Artificial Sequence: Synthetic peptide
  Seed: RGKYIKTWR (AKT1 E17K)
RIKYIKTWN

SEQ ID NO: 1360 - protein, 9 aa, Artificial Sequence
  Description of Artificial Sequence: Synthetic peptide
  Seed: RGKYIKTWR (AKT1 E17K)
RIKYIKTWP

SEQ ID NO: 1361 - protein, 9 aa, Artificial Sequence
  Description of Artificial Sequence: Synthetic peptide
  Seed: RGKYIKTWR (AKT1 E17K)
RIKYIKTWQ

SEQ ID NO: 1362 - protein, 9 aa, Artificial Sequence
  Description of Artificial Sequence: Synthetic peptide
  Seed: RGKYIKTWR (AKT1 E17K)
RIKYIKTWR

SEQ ID NO: 1363 - protein, 11 aa, Artificial Sequence
  Description of Artificial Sequence: Synthetic peptide
  Seed: RGKYIKTWRPR (AKT1 E17K)
RIKYIKTWRPK

SEQ ID NO: 1364 - protein, 11 aa, Artificial Sequence
  Description of Artificial Sequence: Synthetic peptide
  Seed: RGKYIKTWRPR (AKT1 E17K)
RIKYIKTWRPR

SEQ ID NO: 1365 - protein, 9 aa, Artificial Sequence
  Description of Artificial Sequence: Synthetic peptide
  Seed: RGKYIKTWR (AKT1 E17K)
RIKYIKTWS

SEQ ID NO: 1366 - protein, 9 aa, Artificial Sequence
  Description of Artificial Sequence: Synthetic peptide
  Seed: RGKYIKTWR (AKT1 E17K)
RIKYIKTWT

SEQ ID NO: 1367 - protein, 9 aa, Artificial Sequence
  Description of Artificial Sequence: Synthetic peptide
  Seed: RGKYIKTWR (AKT1 E17K)
RIKYIKTWV

SEQ ID NO: 1368 - protein, 9 aa, Artificial Sequence
  Description of Artificial Sequence: Synthetic peptide
  Seed: RGKYIKTWR (AKT1 E17K)
RIKYIKTWY

SEQ ID NO: 1369 - protein, 9 aa, Artificial Sequence
  Description of Artificial Sequence: Synthetic peptide
  Seed: RGKYIKTWR (AKT1 E17K)
RKKYIKTWK

SEQ ID NO: 1370 - protein, 11 aa, Artificial Sequence
  Description of Artificial Sequence: Synthetic peptide
  Seed: RGKYIKTWRPR (AKT1 E17K)
RKKYIKTWRPK

SEQ ID NO: 1371 - protein, 11 aa, Artificial Sequence
  Description of Artificial Sequence: Synthetic peptide
  Seed: RGKYIKTWRPR (AKT1 E17K)
RKKYIKTWRPR

SEQ ID NO: 1372 - protein, 9 aa, Artificial Sequence
  Description of Artificial Sequence: Synthetic peptide
  Seed: RGKYIKTWR (AKT1 E17K)
RLKYIKTWA

SEQ ID NO: 1373 - protein, 9 aa, Artificial Sequence
  Description of Artificial Sequence: Synthetic peptide
  Seed: RGKYIKTWR (AKT1 E17K)
RLKYIKTWF

SEQ ID NO: 1374 - protein, 9 aa, Artificial Sequence
  Description of Artificial Sequence: Synthetic peptide
  Seed: RGKYIKTWR (AKT1 E17K)
RLKYIKTWG

SEQ ID NO: 1375 - protein, 9 aa, Artificial Sequence
  Description of Artificial Sequence: Synthetic peptide
  Seed: RGKYIKTWR (AKT1 E17K)
RLKYIKTWI

SEQ ID NO: 1376 - protein, 9 aa, Artificial Sequence
  Description of Artificial Sequence: Synthetic peptide
  Seed: RGKYIKTWR (AKT1 E17K)
RLKYIKTWK

SEQ ID NO: 1377 - protein, 9 aa, Artificial Sequence
  Description of Artificial Sequence: Synthetic peptide
  Seed: RGKYIKTWR (AKT1 E17K)
RLKYIKTWL

SEQ ID NO: 1378 - protein, 9 aa, Artificial Sequence
  Description of Artificial Sequence: Synthetic peptide
  Seed: RGKYIKTWR (AKT1 E17K)
RLKYIKTWM

SEQ ID NO: 1379 - protein, 9 aa, Artificial Sequence
  Description of Artificial Sequence: Synthetic peptide
  Seed: RGKYIKTWR (AKT1 E17K)
RLKYIKTWN

SEQ ID NO: 1380 - protein, 9 aa, Artificial Sequence
  Description of Artificial Sequence: Synthetic peptide
  Seed: RGKYIKTWR (AKT1 E17K)
RLKYIKTWP

SEQ ID NO: 1381 - protein, 9 aa, Artificial Sequence
  Description of Artificial Sequence: Synthetic peptide
  Seed: RGKYIKTWR (AKT1 E17K)
RLKYIKTWQ

SEQ ID NO: 1382 - protein, 9 aa, Artificial Sequence
  Description of Artificial Sequence: Synthetic peptide
  Seed: RGKYIKTWR (AKT1 E17K)
RLKYIKTWR

SEQ ID NO: 1383 - protein, 11 aa, Artificial Sequence
  Description of Artificial Sequence: Synthetic peptide
  Seed: RGKYIKTWRPR (AKT1 E17K)
RLKYIKTWRPK

SEQ ID NO: 1384 - protein, 11 aa, Artificial Sequence
  Description of Artificial Sequence: Synthetic peptide
  Seed: RGKYIKTWRPR (AKT1 E17K)
RLKYIKTWRPR

SEQ ID NO: 1385 - protein, 9 aa, Artificial Sequence
  Description of Artificial Sequence: Synthetic peptide
  Seed: RGKYIKTWR (AKT1 E17K)
RLKYIKTWS

SEQ ID NO: 1386 - protein, 9 aa, Artificial Sequence
  Description of Artificial Sequence: Synthetic peptide
  Seed: RGKYIKTWR (AKT1 E17K)
RLKYIKTWT

SEQ ID NO: 1387 - protein, 9 aa, Artificial Sequence
  Description of Artificial Sequence: Synthetic peptide
  Seed: RGKYIKTWR (AKT1 E17K)
RLKYIKTWV

SEQ ID NO: 1388 - protein, 9 aa, Artificial Sequence
  Description of Artificial Sequence: Synthetic peptide
  Seed: RGKYIKTWR (AKT1 E17K)
RLKYIKTWY

SEQ ID NO: 1389 - protein, 9 aa, Artificial Sequence
  Description of Artificial Sequence: Synthetic peptide
  Seed: RGKYIKTWR (AKT1 E17K)
RMKYIKTWA

SEQ ID NO: 1390 - protein, 9 aa, Artificial Sequence
  Description of Artificial Sequence: Synthetic peptide
  Seed: RGKYIKTWR (AKT1 E17K)
RMKYIKTWC

SEQ ID NO: 1391 - protein, 9 aa, Artificial Sequence
  Description of Artificial Sequence: Synthetic peptide
  Seed: RGKYIKTWR (AKT1 E17K)
RMKYIKTWE

SEQ ID NO: 1392 - protein, 9 aa, Artificial Sequence
  Description of Artificial Sequence: Synthetic peptide
  Seed: RGKYIKTWR (AKT1 E17K)
RMKYIKTWF

SEQ ID NO: 1393 - protein, 9 aa, Artificial Sequence
  Description of Artificial Sequence: Synthetic peptide
  Seed: RGKYIKTWR (AKT1 E17K)
RMKYIKTWG

SEQ ID NO: 1394 - protein, 9 aa, Artificial Sequence
  Description of Artificial Sequence: Synthetic peptide
  Seed: RGKYIKTWR (AKT1 E17K)
RMKYIKTWH

SEQ ID NO: 1395 - protein, 9 aa, Artificial Sequence
  Description of Artificial Sequence: Synthetic peptide
  Seed: RGKYIKTWR (AKT1 E17K)
RMKYIKTWI

SEQ ID NO: 1396 - protein, 9 aa, Artificial Sequence
  Description of Artificial Sequence: Synthetic peptide
  Seed: RGKYIKTWR (AKT1 E17K)
RMKYIKTWK

SEQ ID NO: 1397 - protein, 9 aa, Artificial Sequence
  Description of Artificial Sequence: Synthetic peptide
  Seed: RGKYIKTWR (AKT1 E17K)
RMKYIKTWL

SEQ ID NO: 1398 - protein, 9 aa, Artificial Sequence
  Description of Artificial Sequence: Synthetic peptide
  Seed: RGKYIKTWR (AKT1 E17K)
RMKYIKTWM

SEQ ID NO: 1399 - protein, 9 aa, Artificial Sequence
  Description of Artificial Sequence: Synthetic peptide
  Seed: RGKYIKTWR (AKT1 E17K)
RMKYIKTWN

SEQ ID NO: 1400 - protein, 9 aa, Artificial Sequence
  Description of Artificial Sequence: Synthetic peptide
  Seed: RGKYIKTWR (AKT1 E17K)
RMKYIKTWP

SEQ ID NO: 1401 - protein, 9 aa, Artificial Sequence
  Description of Artificial Sequence: Synthetic peptide
  Seed: RGKYIKTWR (AKT1 E17K)
RMKYIKTWQ

SEQ ID NO: 1402 - protein, 11 aa, Artificial Sequence
  Description of Artificial Sequence: Synthetic peptide
  Seed: RGKYIKTWRPR (AKT1 E17K)
RMKYIKTWRPH

SEQ ID NO: 1403 - protein, 11 aa, Artificial Sequence
  Description of Artificial Sequence: Synthetic peptide
  Seed: RGKYIKTWRPR (AKT1 E17K)
RMKYIKTWRPK

SEQ ID NO: 1404 - protein, 11 aa, Artificial Sequence
  Description of Artificial Sequence: Synthetic peptide
  Seed: RGKYIKTWRPR (AKT1 E17K)
RMKYIKTWRPR

SEQ ID NO: 1405 - protein, 11 aa, Artificial Sequence
  Description of Artificial Sequence: Synthetic peptide
  Seed: RGKYIKTWRPR (AKT1 E17K)
RMKYIKTWRPY

SEQ ID NO: 1406 - protein, 9 aa, Artificial Sequence
  Description of Artificial Sequence: Synthetic peptide
  Seed: RGKYIKTWR (AKT1 E17K)
RMKYIKTWS

SEQ ID NO: 1407 - protein, 9 aa, Artificial Sequence
  Description of Artificial Sequence: Synthetic peptide
  Seed: RGKYIKTWR (AKT1 E17K)
RMKYIKTWT

SEQ ID NO: 1408 - protein, 9 aa, Artificial Sequence
  Description of Artificial Sequence: Synthetic peptide
  Seed: RGKYIKTWR (AKT1 E17K)
RMKYIKTWV

SEQ ID NO: 1409 - protein, 9 aa, Artificial Sequence
  Description of Artificial Sequence: Synthetic peptide
  Seed: RGKYIKTWR (AKT1 E17K)
RMKYIKTWY

SEQ ID NO: 1410 - protein, 9 aa, Artificial Sequence
  Description of Artificial Sequence: Synthetic peptide
  Seed: RGKYIKTWR (AKT1 E17K)
RNKYIKTWA

SEQ ID NO: 1411 - protein, 9 aa, Artificial Sequence
  Description of Artificial Sequence: Synthetic peptide
  Seed: RGKYIKTWR (AKT1 E17K)
RNKYIKTWI

SEQ ID NO: 1412 - protein, 9 aa, Artificial Sequence
  Description of Artificial Sequence: Synthetic peptide
  Seed: RGKYIKTWR (AKT1 E17K)
RNKYIKTWK

SEQ ID NO: 1413 - protein, 9 aa, Artificial Sequence
  Description of Artificial Sequence: Synthetic peptide
  Seed: RGKYIKTWR (AKT1 E17K)
RNKYIKTWL

SEQ ID NO: 1414 - protein, 9 aa, Artificial Sequence
  Description of Artificial Sequence: Synthetic peptide
  Seed: RGKYIKTWR (AKT1 E17K)
RNKYIKTWM

SEQ ID NO: 1415 - protein, 9 aa, Artificial Sequence
  Description of Artificial Sequence: Synthetic peptide
  Seed: RGKYIKTWR (AKT1 E17K)
RNKYIKTWR

SEQ ID NO: 1416 - protein, 11 aa, Artificial Sequence
  Description of Artificial Sequence: Synthetic peptide
  Seed: RGKYIKTWRPR (AKT1 E17K)
RNKYIKTWRPK

SEQ ID NO: 1417 - protein, 11 aa, Artificial Sequence
  Description of Artificial Sequence: Synthetic peptide
  Seed: RGKYIKTWRPR (AKT1 E17K)
RNKYIKTWRPR

SEQ ID NO: 1418 - protein, 9 aa, Artificial Sequence
  Description of Artificial Sequence: Synthetic peptide
  Seed: RGKYIKTWR (AKT1 E17K)
RNKYIKTWS

SEQ ID NO: 1419 - protein, 9 aa, Artificial Sequence
  Description of Artificial Sequence: Synthetic peptide
  Seed: RGKYIKTWR (AKT1 E17K)
RNKYIKTWV

SEQ ID NO: 1420 - protein, 9 aa, Artificial Sequence
  Description of Artificial Sequence: Synthetic peptide
  Seed: RGKYIKTWR (AKT1 E17K)
RPKYIKTWR

SEQ ID NO: 1421 - protein, 11 aa, Artificial Sequence
  Description of Artificial Sequence: Synthetic peptide
  Seed: RGKYIKTWRPR (AKT1 E17K)
RPKYIKTWRPK

SEQ ID NO: 1422 - protein, 11 aa, Artificial Sequence
  Description of Artificial Sequence: Synthetic peptide
  Seed: RGKYIKTWRPR (AKT1 E17K)
RPKYIKTWRPR

SEQ ID NO: 1423 - protein, 9 aa, Artificial Sequence
  Description of Artificial Sequence: Synthetic peptide
  Seed: RGKYIKTWR (AKT1 E17K)
RQKYIKTWA

SEQ ID NO: 1424 - protein, 9 aa, Artificial Sequence
  Description of Artificial Sequence: Synthetic peptide
  Seed: RGKYIKTWR (AKT1 E17K)
RQKYIKTWG

SEQ ID NO: 1425 - protein, 9 aa, Artificial Sequence
  Description of Artificial Sequence: Synthetic peptide
  Seed: RGKYIKTWR (AKT1 E17K)
RQKYIKTWI

SEQ ID NO: 1426 - protein, 9 aa, Artificial Sequence
  Description of Artificial Sequence: Synthetic peptide
  Seed: RGKYIKTWR (AKT1 E17K)
RQKYIKTWK

SEQ ID NO: 1427 - protein, 9 aa, Artificial Sequence
  Description of Artificial Sequence: Synthetic peptide
  Seed: RGKYIKTWR (AKT1 E17K)
RQKYIKTWL

SEQ ID NO: 1428 - protein, 9 aa, Artificial Sequence
  Description of Artificial Sequence: Synthetic peptide
  Seed: RGKYIKTWR (AKT1 E17K)
RQKYIKTWM

SEQ ID NO: 1429 - protein, 9 aa, Artificial Sequence
  Description of Artificial Sequence: Synthetic peptide
  Seed: RGKYIKTWR (AKT1 E17K)
RQKYIKTWR

SEQ ID NO: 1430 - protein, 11 aa, Artificial Sequence
  Description of Artificial Sequence: Synthetic peptide
  Seed: RGKYIKTWRPR (AKT1 E17K)
RQKYIKTWRPK

SEQ ID NO: 1431 - protein, 11 aa, Artificial Sequence
  Description of Artificial Sequence: Synthetic peptide
  Seed: RGKYIKTWRPR (AKT1 E17K)
RQKYIKTWRPR

SEQ ID NO: 1432 - protein, 9 aa, Artificial Sequence
  Description of Artificial Sequence: Synthetic peptide
  Seed: RGKYIKTWR (AKT1 E17K)
RQKYIKTWS

SEQ ID NO: 1433 - protein, 9 aa, Artificial Sequence
  Description of Artificial Sequence: Synthetic peptide
  Seed: RGKYIKTWR (AKT1 E17K)
RQKYIKTWT

SEQ ID NO: 1434 - protein, 9 aa, Artificial Sequence
  Description of Artificial Sequence: Synthetic peptide
  Seed: RGKYIKTWR (AKT1 E17K)
RQKYIKTWV

SEQ ID NO: 1435 - protein, 9 aa, Artificial Sequence
  Description of Artificial Sequence: Synthetic peptide
  Seed: RGKYIKTWR (AKT1 E17K)
RQKYIKTWY

SEQ ID NO: 1436 - protein, 11 aa, Artificial Sequence
  Description of Artificial Sequence: Synthetic peptide
  Seed: RGKYIKTWRPR (AKT1 E17K)
RRKYIKTWRPK

SEQ ID NO: 1437 - protein, 11 aa, Artificial Sequence
  Description of Artificial Sequence: Synthetic peptide
  Seed: RGKYIKTWRPR (AKT1 E17K)
RRKYIKTWRPR

SEQ ID NO: 1438 - protein, 9 aa, Artificial Sequence
  Description of Artificial Sequence: Synthetic peptide
  Seed: RGKYIKTWR (AKT1 E17K)
RSKYIKTWA

SEQ ID NO: 1439 - protein, 9 aa, Artificial Sequence
  Description of Artificial Sequence: Synthetic peptide
  Seed: RGKYIKTWR (AKT1 E17K)
RSKYIKTWC

SEQ ID NO: 1440 - protein, 9 aa, Artificial Sequence
  Description of Artificial Sequence: Synthetic peptide
  Seed: RGKYIKTWR (AKT1 E17K)
RSKYIKTWE

SEQ ID NO: 1441 - protein, 9 aa, Artificial Sequence
  Description of Artificial Sequence: Synthetic peptide
  Seed: RGKYIKTWR (AKT1 E17K)
RSKYIKTWF

SEQ ID NO: 1442 - protein, 9 aa, Artificial Sequence
  Description of Artificial Sequence: Synthetic peptide
  Seed: RGKYIKTWR (AKT1 E17K)
RSKYIKTWG

SEQ ID NO: 1443 - protein, 9 aa, Artificial Sequence
  Description of Artificial Sequence: Synthetic peptide
  Seed: RGKYIKTWR (AKT1 E17K)
RSKYIKTWH

SEQ ID NO: 1444 - protein, 9 aa, Artificial Sequence
  Description of Artificial Sequence: Synthetic peptide
  Seed: RGKYIKTWR (AKT1 E17K)
RSKYIKTWI

SEQ ID NO: 1445 - protein, 9 aa, Artificial Sequence
  Description of Artificial Sequence: Synthetic peptide
  Seed: RGKYIKTWR (AKT1 E17K)
RSKYIKTWL

SEQ ID NO: 1446 - protein, 9 aa, Artificial Sequence
  Description of Artificial Sequence: Synthetic peptide
  Seed: RGKYIKTWR (AKT1 E17K)
RSKYIKTWM

SEQ ID NO: 1447 - protein, 9 aa, Artificial Sequence
  Description of Artificial Sequence: Synthetic peptide
  Seed: RGKYIKTWR (AKT1 E17K)
RSKYIKTWN

SEQ ID NO: 1448 - protein, 9 aa, Artificial Sequence
  Description of Artificial Sequence: Synthetic peptide
  Seed: RGKYIKTWR (AKT1 E17K)
RSKYIKTWP

SEQ ID NO: 1449 - protein, 9 aa, Artificial Sequence
  Description of Artificial Sequence: Synthetic peptide
  Seed: RGKYIKTWR (AKT1 E17K)
RSKYIKTWQ

SEQ ID NO: 1450 - protein, 9 aa, Artificial Sequence
  Description of Artificial Sequence: Synthetic peptide
  Seed: RGKYIKTWR (AKT1 E17K)
RSKYIKTWR

SEQ ID NO: 1451 - protein, 11 aa, Artificial Sequence
  Description of Artificial Sequence: Synthetic peptide
  Seed: RGKYIKTWRPR (AKT1 E17K)
RSKYIKTWRPK

SEQ ID NO: 1452 - protein, 11 aa, Artificial Sequence
  Description of Artificial Sequence: Synthetic peptide
  Seed: RGKYIKTWRPR (AKT1 E17K)
RSKYIKTWRPR

SEQ ID NO: 1453 - protein, 9 aa, Artificial Sequence
  Description of Artificial Sequence: Synthetic peptide
  Seed: RGKYIKTWR (AKT1 E17K)
RSKYIKTWS

SEQ ID NO: 1454 - protein, 9 aa, Artificial Sequence
  Description of Artificial Sequence: Synthetic peptide
  Seed: RGKYIKTWR (AKT1 E17K)
RSKYIKTWT

SEQ ID NO: 1455 - protein, 9 aa, Artificial Sequence
  Description of Artificial Sequence: Synthetic peptide
  Seed: RGKYIKTWR (AKT1 E17K)
RSKYIKTWV

SEQ ID NO: 1456 - protein, 9 aa, Artificial Sequence
  Description of Artificial Sequence: Synthetic peptide
  Seed: RGKYIKTWR (AKT1 E17K)
RSKYIKTWY

SEQ ID NO: 1457 - protein, 9 aa, Artificial Sequence
  Description of Artificial Sequence: Synthetic peptide
  Seed: RGKYIKTWR (AKT1 E17K)
RTKYIKTWA

SEQ ID NO: 1458 - protein, 9 aa, Artificial Sequence
  Description of Artificial Sequence: Synthetic peptide
  Seed: RGKYIKTWR (AKT1 E17K)
RTKYIKTWC

SEQ ID NO: 1459 - protein, 9 aa, Artificial Sequence
  Description of Artificial Sequence: Synthetic peptide
  Seed: RGKYIKTWR (AKT1 E17K)
RTKYIKTWD

SEQ ID NO: 1460 - protein, 9 aa, Artificial Sequence
  Description of Artificial Sequence: Synthetic peptide
  Seed: RGKYIKTWR (AKT1 E17K)
RTKYIKTWE

SEQ ID NO: 1461 - protein, 9 aa, Artificial Sequence
  Description of Artificial Sequence: Synthetic peptide
  Seed: RGKYIKTWR (AKT1 E17K)
RTKYIKTWF

SEQ ID NO: 1462 - protein, 9 aa, Artificial Sequence
  Description of Artificial Sequence: Synthetic peptide
  Seed: RGKYIKTWR (AKT1 E17K)
RTKYIKTWG

SEQ ID NO: 1463 - protein, 9 aa, Artificial Sequence
  Description of Artificial Sequence: Synthetic peptide
  Seed: RGKYIKTWR (AKT1 E17K)
RTKYIKTWH

SEQ ID NO: 1464 - protein, 9 aa, Artificial Sequence
  Description of Artificial Sequence: Synthetic peptide
  Seed: RGKYIKTWR (AKT1 E17K)
RTKYIKTWI

SEQ ID NO: 1465 - protein, 9 aa, Artificial Sequence
  Description of Artificial Sequence: Synthetic peptide
  Seed: RGKYIKTWR (AKT1 E17K)
RTKYIKTWL

SEQ ID NO: 1466 - protein, 9 aa, Artificial Sequence
  Description of Artificial Sequence: Synthetic peptide
  Seed: RGKYIKTWR (AKT1 E17K)
RTKYIKTWM

SEQ ID NO: 1467 - protein, 9 aa, Artificial Sequence
  Description of Artificial Sequence: Synthetic peptide
  Seed: RGKYIKTWR (AKT1 E17K)
RTKYIKTWN

SEQ ID NO: 1468 - protein, 9 aa, Artificial Sequence
  Description of Artificial Sequence: Synthetic peptide
  Seed: RGKYIKTWR (AKT1 E17K)
RTKYIKTWP

SEQ ID NO: 1469 - protein, 9 aa, Artificial Sequence
  Description of Artificial Sequence: Synthetic peptide
  Seed: RGKYIKTWR (AKT1 E17K)
RTKYIKTWQ

SEQ ID NO: 1470 - protein, 9 aa, Artificial Sequence
  Description of Artificial Sequence: Synthetic peptide
  Seed: RGKYIKTWR (AKT1 E17K)
RTKYIKTWR

SEQ ID NO: 1471 - protein, 11 aa, Artificial Sequence
  Description of Artificial Sequence: Synthetic peptide
  Seed: RGKYIKTWRPR (AKT1 E17K)
RTKYIKTWRPK

SEQ ID NO: 1472 - protein, 11 aa, Artificial Sequence
  Description of Artificial Sequence: Synthetic peptide
  Seed: RGKYIKTWRPR (AKT1 E17K)
RTKYIKTWRPR

SEQ ID NO: 1473 - protein, 9 aa, Artificial Sequence
  Description of Artificial Sequence: Synthetic peptide
  Seed: RGKYIKTWR (AKT1 E17K)
RTKYIKTWS

SEQ ID NO: 1474 - protein, 9 aa, Artificial Sequence
  Description of Artificial Sequence: Synthetic peptide
  Seed: RGKYIKTWR (AKT1 E17K)
RTKYIKTWT

SEQ ID NO: 1475 - protein, 9 aa, Artificial Sequence
  Description of Artificial Sequence: Synthetic peptide
  Seed: RGKYIKTWR (AKT1 E17K)
RTKYIKTWV

SEQ ID NO: 1476 - protein, 9 aa, Artificial Sequence
  Description of Artificial Sequence: Synthetic peptide
  Seed: RGKYIKTWR (AKT1 E17K)
RTKYIKTWY

SEQ ID NO: 1477 - protein, 9 aa, Artificial Sequence
  Description of Artificial Sequence: Synthetic peptide
  Seed: RGKYIKTWR (AKT1 E17K)
RVKYIKTWA

SEQ ID NO: 1478 - protein, 9 aa, Artificial Sequence
  Description of Artificial Sequence: Synthetic peptide
  Seed: RGKYIKTWR (AKT1 E17K)
RVKYIKTWC

SEQ ID NO: 1479 - protein, 9 aa, Artificial Sequence
  Description of Artificial Sequence: Synthetic peptide
  Seed: RGKYIKTWR (AKT1 E17K)
RVKYIKTWD

SEQ ID NO: 1480 - protein, 9 aa, Artificial Sequence
  Description of Artificial Sequence: Synthetic peptide
  Seed: RGKYIKTWR (AKT1 E17K)
RVKYIKTWE

SEQ ID NO: 1481 - protein, 9 aa, Artificial Sequence
  Description of Artificial Sequence: Synthetic peptide
  Seed: RGKYIKTWR (AKT1 E17K)
RVKYIKTWF

SEQ ID NO: 1482 - protein, 9 aa, Artificial Sequence
  Description of Artificial Sequence: Synthetic peptide
  Seed: RGKYIKTWR (AKT1 E17K)
RVKYIKTWG

SEQ ID NO: 1483 - protein, 9 aa, Artificial Sequence
  Description of Artificial Sequence: Synthetic peptide
  Seed: RGKYIKTWR (AKT1 E17K)
RVKYIKTWH

SEQ ID NO: 1484 - protein, 9 aa, Artificial Sequence
  Description of Artificial Sequence: Synthetic peptide
  Seed: RGKYIKTWR (AKT1 E17K)
RVKYIKTWI

SEQ ID NO: 1485 - protein, 9 aa, Artificial Sequence
  Description of Artificial Sequence: Synthetic peptide
  Seed: RGKYIKTWR (AKT1 E17K)
RVKYIKTWL

SEQ ID NO: 1486 - protein, 9 aa, Artificial Sequence
  Description of Artificial Sequence: Synthetic peptide
  Seed: RGKYIKTWR (AKT1 E17K)
RVKYIKTWM

SEQ ID NO: 1487 - protein, 9 aa, Artificial Sequence
  Description of Artificial Sequence: Synthetic peptide
  Seed: RGKYIKTWR (AKT1 E17K)
RVKYIKTWN

SEQ ID NO: 1488 - protein, 9 aa, Artificial Sequence
  Description of Artificial Sequence: Synthetic peptide
  Seed: RGKYIKTWR (AKT1 E17K)
RVKYIKTWP

SEQ ID NO: 1489 - protein, 9 aa, Artificial Sequence
  Description of Artificial Sequence: Synthetic peptide
  Seed: RGKYIKTWR (AKT1 E17K)
RVKYIKTWQ

SEQ ID NO: 1490 - protein, 11 aa, Artificial Sequence
  Description of Artificial Sequence: Synthetic peptide
  Seed: RGKYIKTWRPR (AKT1 E17K)
RVKYIKTWRPK

SEQ ID NO: 1491 - protein, 11 aa, Artificial Sequence
  Description of Artificial Sequence: Synthetic peptide
  Seed: RGKYIKTWRPR (AKT1 E17K)
RVKYIKTWRPR

SEQ ID NO: 1492 - protein, 9 aa, Artificial Sequence
  Description of Artificial Sequence: Synthetic peptide
  Seed: RGKYIKTWR (AKT1 E17K)
RVKYIKTWS

SEQ ID NO: 1493 - protein, 9 aa, Artificial Sequence
  Description of Artificial Sequence: Synthetic peptide
  Seed: RGKYIKTWR (AKT1 E17K)
RVKYIKTWT

SEQ ID NO: 1494 - protein, 9 aa, Artificial Sequence
  Description of Artificial Sequence: Synthetic peptide
  Seed: RGKYIKTWR (AKT1 E17K)
RVKYIKTWV

SEQ ID NO: 1495 - protein, 9 aa, Artificial Sequence
  Description of Artificial Sequence: Synthetic peptide
  Seed: RGKYIKTWR (AKT1 E17K)
RVKYIKTWY

SEQ ID NO: 1496 - protein, 9 aa, Artificial Sequence
  Description of Artificial Sequence: Synthetic peptide
  Seed: RGKYIKTWR (AKT1 E17K)
RWKYIKTWA

SEQ ID NO: 1497 - protein, 9 aa, Artificial Sequence
  Description of Artificial Sequence: Synthetic peptide
  Seed: RGKYIKTWR (AKT1 E17K)
RWKYIKTWG

SEQ ID NO: 1498 - protein, 9 aa, Artificial Sequence
  Description of Artificial Sequence: Synthetic peptide
  Seed: RGKYIKTWR (AKT1 E17K)
RWKYIKTWI

SEQ ID NO: 1499 - protein, 9 aa, Artificial Sequence
  Description of Artificial Sequence: Synthetic peptide
  Seed: RGKYIKTWR (AKT1 E17K)
RWKYIKTWK

SEQ ID NO: 1500 - protein, 9 aa, Artificial Sequence
  Description of Artificial Sequence: Synthetic peptide
  Seed: RGKYIKTWR (AKT1 E17K)
RWKYIKTWL

SEQ ID NO: 1501 - protein, 9 aa, Artificial Sequence
  Description of Artificial Sequence: Synthetic peptide
  Seed: RGKYIKTWR (AKT1 E17K)
RWKYIKTWM

SEQ ID NO: 1502 - protein, 9 aa, Artificial Sequence
  Description of Artificial Sequence: Synthetic peptide
  Seed: RGKYIKTWR (AKT1 E17K)
RWKYIKTWR

SEQ ID NO: 1503 - protein, 11 aa, Artificial Sequence
  Description of Artificial Sequence: Synthetic peptide
  Seed: RGKYIKTWRPR (AKT1 E17K)
RWKYIKTWRPK

SEQ ID NO: 1504 - protein, 11 aa, Artificial Sequence
  Description of Artificial Sequence: Synthetic peptide
  Seed: RGKYIKTWRPR (AKT1 E17K)
RWKYIKTWRPR

SEQ ID NO: 1505 - protein, 9 aa, Artificial Sequence
  Description of Artificial Sequence: Synthetic peptide
  Seed: RGKYIKTWR (AKT1 E17K)
RWKYIKTWS

SEQ ID NO: 1506 - protein, 9 aa, Artificial Sequence
  Description of Artificial Sequence: Synthetic peptide
  Seed: RGKYIKTWR (AKT1 E17K)
RWKYIKTWT

SEQ ID NO: 1507 - protein, 9 aa, Artificial Sequence
  Description of Artificial Sequence: Synthetic peptide
  Seed: RGKYIKTWR (AKT1 E17K)
RWKYIKTWV

SEQ ID NO: 1508 - protein, 9 aa, Artificial Sequence
  Description of Artificial Sequence: Synthetic peptide
  Seed: RGKYIKTWR (AKT1 E17K)
RWKYIKTWY

SEQ ID NO: 1509 - protein, 9 aa, Artificial Sequence
  Description of Artificial Sequence: Synthetic peptide
  Seed: RGKYIKTWR (AKT1 E17K)
RYKYIKTWA

SEQ ID NO: 1510 - protein, 9 aa, Artificial Sequence
  Description of Artificial Sequence: Synthetic peptide
  Seed: RGKYIKTWR (AKT1 E17K)
RYKYIKTWC

SEQ ID NO: 1511 - protein, 9 aa, Artificial Sequence
  Description of Artificial Sequence: Synthetic peptide
  Seed: RGKYIKTWR (AKT1 E17K)
RYKYIKTWE

SEQ ID NO: 1512 - protein, 9 aa, Artificial Sequence
  Description of Artificial Sequence: Synthetic peptide
  Seed: RGKYIKTWR (AKT1 E17K)
RYKYIKTWF

SEQ ID NO: 1513 - protein, 9 aa, Artificial Sequence
  Description of Artificial Sequence: Synthetic peptide
  Seed: RGKYIKTWR (AKT1 E17K)
RYKYIKTWG

SEQ ID NO: 1514 - protein, 9 aa, Artificial Sequence
  Description of Artificial Sequence: Synthetic peptide
  Seed: RGKYIKTWR (AKT1 E17K)
RYKYIKTWH

SEQ ID NO: 1515 - protein, 9 aa, Artificial Sequence
  Description of Artificial Sequence: Synthetic peptide
  Seed: RGKYIKTWR (AKT1 E17K)
RYKYIKTWI

SEQ ID NO: 1516 - protein, 9 aa, Artificial Sequence
  Description of Artificial Sequence: Synthetic peptide
  Seed: RGKYIKTWR (AKT1 E17K)
RYKYIKTWK

SEQ ID NO: 1517 - protein, 9 aa, Artificial Sequence
  Description of Artificial Sequence: Synthetic peptide
  Seed: RGKYIKTWR (AKT1 E17K)
RYKYIKTWL

SEQ ID NO: 1518 - protein, 9 aa, Artificial Sequence
  Description of Artificial Sequence: Synthetic peptide
  Seed: RGKYIKTWR (AKT1 E17K)
RYKYIKTWM

SEQ ID NO: 1519 - protein, 9 aa, Artificial Sequence
  Description of Artificial Sequence: Synthetic peptide
  Seed: RGKYIKTWR (AKT1 E17K)
RYKYIKTWN

SEQ ID NO: 1520 - protein, 9 aa, Artificial Sequence
  Description of Artificial Sequence: Synthetic peptide
  Seed: RGKYIKTWR (AKT1 E17K)
RYKYIKTWP

SEQ ID NO: 1521 - protein, 9 aa, Artificial Sequence
  Description of Artificial Sequence: Synthetic peptide
  Seed: RGKYIKTWR (AKT1 E17K)
RYKYIKTWQ

SEQ ID NO: 1522 - protein, 9 aa, Artificial Sequence
  Description of Artificial Sequence: Synthetic peptide
  Seed: RGKYIKTWR (AKT1 E17K)
RYKYIKTWR

SEQ ID NO: 1523 - protein, 11 aa, Artificial Sequence
  Description of Artificial Sequence: Synthetic peptide
  Seed: RGKYIKTWRPR (AKT1 E17K)
RYKYIKTWRPK

SEQ ID NO: 1524 - protein, 11 aa, Artificial Sequence
  Description of Artificial Sequence: Synthetic peptide
  Seed: RGKYIKTWRPR (AKT1 E17K)
RYKYIKTWRPR

SEQ ID NO: 1525 - protein, 9 aa, Artificial Sequence
  Description of Artificial Sequence: Synthetic peptide
  Seed: RGKYIKTWR (AKT1 E17K)
RYKYIKTWS

SEQ ID NO: 1526 - protein, 9 aa, Artificial Sequence
  Description of Artificial Sequence: Synthetic peptide
  Seed: RGKYIKTWR (AKT1 E17K)
RYKYIKTWT

SEQ ID NO: 1527 - protein, 9 aa, Artificial Sequence
  Description of Artificial Sequence: Synthetic peptide
  Seed: RGKYIKTWR (AKT1 E17K)
RYKYIKTWV

SEQ ID NO: 1528 - protein, 9 aa, Artificial Sequence
  Description of Artificial Sequence: Synthetic peptide
  Seed: RGKYIKTWR (AKT1 E17K)
RYKYIKTWY

SEQ ID NO: 1529 - protein, 9 aa, Artificial Sequence
  Description of Artificial Sequence: Synthetic peptide
  Seed: WLHKRGKYI (AKT1 E17K)
WAHKRGKYA

SEQ ID NO: 1530 - protein, 9 aa, Artificial Sequence
  Description of Artificial Sequence: Synthetic peptide
  Seed: WLHKRGKYI (AKT1 E17K)
WAHKRGKYF

SEQ ID NO: 1531 - protein, 9 aa, Artificial Sequence
  Description of Artificial Sequence: Synthetic peptide
  Seed: WLHKRGKYI (AKT1 E17K)
WAHKRGKYI

SEQ ID NO: 1532 - protein, 9 aa, Artificial Sequence
  Description of Artificial Sequence: Synthetic peptide
  Seed: WLHKRGKYI (AKT1 E17K)
WAHKRGKYM

SEQ ID NO: 1533 - protein, 9 aa, Artificial Sequence
  Description of Artificial Sequence: Synthetic peptide
  Seed: WLHKRGKYI (AKT1 E17K)
WAHKRGKYV

SEQ ID NO: 1534 - protein, 9 aa, Artificial Sequence
  Description of Artificial Sequence: Synthetic peptide
  Seed: WLHKRGKYI (AKT1 E17K)
WCHKRGKYL

SEQ ID NO: 1535 - protein, 9 aa, Artificial Sequence
  Description of Artificial Sequence: Synthetic peptide
  Seed: WLHKRGKYI (AKT1 E17K)
WFHKRGKYF

SEQ ID NO: 1536 - protein, 9 aa, Artificial Sequence
  Description of Artificial Sequence: Synthetic peptide
  Seed: WLHKRGKYI (AKT1 E17K)
WFHKRGKYI

SEQ ID NO: 1537 - protein, 9 aa, Artificial Sequence
  Description of Artificial Sequence: Synthetic peptide
  Seed: WLHKRGKYI (AKT1 E17K)
WFHKRGKYL

SEQ ID NO: 1538 - protein, 9 aa, Artificial Sequence
  Description of Artificial Sequence: Synthetic peptide
  Seed: WLHKRGKYI (AKT1 E17K)
WFHKRGKYM

SEQ ID NO: 1539 - protein, 9 aa, Artificial Sequence
  Description of Artificial Sequence: Synthetic peptide
  Seed: WLHKRGKYI (AKT1 E17K)
WFHKRGKYV

SEQ ID NO: 1540 - protein, 9 aa, Artificial Sequence
  Description of Artificial Sequence: Synthetic peptide
  Seed: WLHKRGKYI (AKT1 E17K)
WGHKRGKYF

SEQ ID NO: 1541 - protein, 9 aa, Artificial Sequence
  Description of Artificial Sequence: Synthetic peptide
  Seed: WLHKRGKYI (AKT1 E17K)
WGHKRGKYI

SEQ ID NO: 1542 - protein, 9 aa, Artificial Sequence
  Description of Artificial Sequence: Synthetic peptide
  Seed: WLHKRGKYI (AKT1 E17K)
WGHKRGKYL

SEQ ID NO: 1543 - protein, 9 aa, Artificial Sequence
  Description of Artificial Sequence: Synthetic peptide
  Seed: WLHKRGKYI (AKT1 E17K)
WGHKRGKYM

SEQ ID NO: 1544 - protein, 9 aa, Artificial Sequence
  Description of Artificial Sequence: Synthetic peptide
  Seed: WLHKRGKYI (AKT1 E17K)
WGHKRGKYV

SEQ ID NO: 1545 - protein, 9 aa, Artificial Sequence
  Description of Artificial Sequence: Synthetic peptide
  Seed: WLHKRGKYI (AKT1 E17K)
WIHKRGKYA

SEQ ID NO: 1546 - protein, 9 aa, Artificial Sequence
  Description of Artificial Sequence: Synthetic peptide
  Seed: WLHKRGKYI (AKT1 E17K)
WIHKRGKYF

SEQ ID NO: 1547 - protein, 9 aa, Artificial Sequence
  Description of Artificial Sequence: Synthetic peptide
  Seed: WLHKRGKYI (AKT1 E17K)
WIHKRGKYI

SEQ ID NO: 1548 - protein, 9 aa, Artificial Sequence
  Description of Artificial Sequence: Synthetic peptide
  Seed: WLHKRGKYI (AKT1 E17K)
WIHKRGKYL

SEQ ID NO: 1549 - protein, 9 aa, Artificial Sequence
  Description of Artificial Sequence: Synthetic peptide
  Seed: WLHKRGKYI (AKT1 E17K)
WIHKRGKYM

SEQ ID NO: 1550 - protein, 9 aa, Artificial Sequence
  Description of Artificial Sequence: Synthetic peptide
  Seed: WLHKRGKYI (AKT1 E17K)
WIHKRGKYV

SEQ ID NO: 1551 - protein, 9 aa, Artificial Sequence
  Description of Artificial Sequence: Synthetic peptide
  Seed: WLHKRGKYI (AKT1 E17K)
WKHKRGKYL

SEQ ID NO: 1552 - protein, 9 aa, Artificial Sequence
  Description of Artificial Sequence: Synthetic peptide
  Seed: WLHKRGKYI (AKT1 E17K)
WKHKRGKYM

SEQ ID NO: 1553 - protein, 9 aa, Artificial Sequence
  Description of Artificial Sequence: Synthetic peptide
  Seed: WLHKRGKYI (AKT1 E17K)
WLHKRGKYA

SEQ ID NO: 1554 - protein, 9 aa, Artificial Sequence
  Description of Artificial Sequence: Synthetic peptide
  Seed: WLHKRGKYI (AKT1 E17K)
WLHKRGKYC

SEQ ID NO: 1555 - protein, 9 aa, Artificial Sequence
  Description of Artificial Sequence: Synthetic peptide
  Seed: WLHKRGKYI (AKT1 E17K)
WLHKRGKYF

SEQ ID NO: 1556 - protein, 9 aa, Artificial Sequence
  Description of Artificial Sequence: Synthetic peptide
  Seed: WLHKRGKYI (AKT1 E17K)
WLHKRGKYL

SEQ ID NO: 1557 - protein, 9 aa, Artificial Sequence
  Description of Artificial Sequence: Synthetic peptide
  Seed: WLHKRGKYI (AKT1 E17K)
WLHKRGKYM

SEQ ID NO: 1558 - protein, 9 aa, Artificial Sequence
  Description of Artificial Sequence: Synthetic peptide
  Seed: WLHKRGKYI (AKT1 E17K)
WMHKRGKYA

SEQ ID NO: 1559 - protein, 9 aa, Artificial Sequence
  Description of Artificial Sequence: Synthetic peptide
  Seed: WLHKRGKYI (AKT1 E17K)
WMHKRGKYC

SEQ ID NO: 1560 - protein, 9 aa, Artificial Sequence
  Description of Artificial Sequence: Synthetic peptide
  Seed: WLHKRGKYI (AKT1 E17K)
WMHKRGKYF

SEQ ID NO: 1561 - protein, 9 aa, Artificial Sequence
  Description of Artificial Sequence: Synthetic peptide
  Seed: WLHKRGKYI (AKT1 E17K)
WMHKRGKYI

SEQ ID NO: 1562 - protein, 9 aa, Artificial Sequence
  Description of Artificial Sequence: Synthetic peptide
  Seed: WLHKRGKYI (AKT1 E17K)
WMHKRGKYL

SEQ ID NO: 1563 - protein, 9 aa, Artificial Sequence
  Description of Artificial Sequence: Synthetic peptide
  Seed: WLHKRGKYI (AKT1 E17K)
WMHKRGKYM

SEQ ID NO: 1564 - protein, 9 aa, Artificial Sequence
  Description of Artificial Sequence: Synthetic peptide
  Seed: WLHKRGKYI (AKT1 E17K)
WMHKRGKYT

SEQ ID NO: 1565 - protein, 9 aa, Artificial Sequence
  Description of Artificial Sequence: Synthetic peptide
  Seed: WLHKRGKYI (AKT1 E17K)
WNHKRGKYI

SEQ ID NO: 1566 - protein, 9 aa, Artificial Sequence
  Description of Artificial Sequence: Synthetic peptide
  Seed: WLHKRGKYI (AKT1 E17K)
WNHKRGKYL

SEQ ID NO: 1567 - protein, 9 aa, Artificial Sequence
  Description of Artificial Sequence: Synthetic peptide
  Seed: WLHKRGKYI (AKT1 E17K)
WNHKRGKYM

SEQ ID NO: 1568 - protein, 9 aa, Artificial Sequence
  Description of Artificial Sequence: Synthetic peptide
  Seed: WLHKRGKYI (AKT1 E17K)
WNHKRGKYV

SEQ ID NO: 1569 - protein, 9 aa, Artificial Sequence
  Description of Artificial Sequence: Synthetic peptide
  Seed: WLHKRGKYI (AKT1 E17K)
WPHKRGKYA

SEQ ID NO: 1570 - protein, 9 aa, Artificial Sequence
  Description of Artificial Sequence: Synthetic peptide
  Seed: WLHKRGKYI (AKT1 E17K)
WPHKRGKYC

SEQ ID NO: 1571 - protein, 9 aa, Artificial Sequence
  Description of Artificial Sequence: Synthetic peptide
  Seed: WLHKRGKYI (AKT1 E17K)
WPHKRGKYF

SEQ ID NO: 1572 - protein, 9 aa, Artificial Sequence
  Description of Artificial Sequence: Synthetic peptide
  Seed: WLHKRGKYI (AKT1 E17K)
WPHKRGKYI

SEQ ID NO: 1573 - protein, 9 aa, Artificial Sequence
  Description of Artificial Sequence: Synthetic peptide
  Seed: WLHKRGKYI (AKT1 E17K)
WPHKRGKYL

SEQ ID NO: 1574 - protein, 9 aa, Artificial Sequence
  Description of Artificial Sequence: Synthetic peptide
  Seed: WLHKRGKYI (AKT1 E17K)
WPHKRGKYM

SEQ ID NO: 1575 - protein, 9 aa, Artificial Sequence
  Description of Artificial Sequence: Synthetic peptide
  Seed: WLHKRGKYI (AKT1 E17K)
WPHKRGKYV

SEQ ID NO: 1576 - protein, 9 aa, Artificial Sequence
  Description of Artificial Sequence: Synthetic peptide
  Seed: WLHKRGKYI (AKT1 E17K)
WQHKRGKYA

SEQ ID NO: 1577 - protein, 9 aa, Artificial Sequence
  Description of Artificial Sequence: Synthetic peptide
  Seed: WLHKRGKYI (AKT1 E17K)
WQHKRGKYF

SEQ ID NO: 1578 - protein, 9 aa, Artificial Sequence
  Description of Artificial Sequence: Synthetic peptide
  Seed: WLHKRGKYI (AKT1 E17K)
WQHKRGKYI

SEQ ID NO: 1579 - protein, 9 aa, Artificial Sequence
  Description of Artificial Sequence: Synthetic peptide
  Seed: WLHKRGKYI (AKT1 E17K)
WQHKRGKYL

SEQ ID NO: 1580 - protein, 9 aa, Artificial Sequence
  Description of Artificial Sequence: Synthetic peptide
  Seed: WLHKRGKYI (AKT1 E17K)
WQHKRGKYM

SEQ ID NO: 1581 - protein, 9 aa, Artificial Sequence
  Description of Artificial Sequence: Synthetic peptide
  Seed: WLHKRGKYI (AKT1 E17K)
WQHKRGKYV

SEQ ID NO: 1582 - protein, 9 aa, Artificial Sequence
  Description of Artificial Sequence: Synthetic peptide
  Seed: WLHKRGKYI (AKT1 E17K)
WRHKRGKYL

SEQ ID NO: 1583 - protein, 9 aa, Artificial Sequence
  Description of Artificial Sequence: Synthetic peptide
  Seed: WLHKRGKYI (AKT1 E17K)
WRHKRGKYM

SEQ ID NO: 1584 - protein, 9 aa, Artificial Sequence
  Description of Artificial Sequence: Synthetic peptide
  Seed: WLHKRGKYI (AKT1 E17K)
WSHKRGKYI

SEQ ID NO: 1585 - protein, 9 aa, Artificial Sequence
  Description of Artificial Sequence: Synthetic peptide
  Seed: WLHKRGKYI (AKT1 E17K)
WSHKRGKYL

SEQ ID NO: 1586 - protein, 9 aa, Artificial Sequence
  Description of Artificial Sequence: Synthetic peptide
  Seed: WLHKRGKYI (AKT1 E17K)
WSHKRGKYM

SEQ ID NO: 1587 - protein, 9 aa, Artificial Sequence
  Description of Artificial Sequence: Synthetic peptide
  Seed: WLHKRGKYI (AKT1 E17K)
WSHKRGKYV

SEQ ID NO: 1588 - protein, 9 aa, Artificial Sequence
  Description of Artificial Sequence: Synthetic peptide
  Seed: WLHKRGKYI (AKT1 E17K)
WTHKRGKYL

SEQ ID NO: 1589 - protein, 9 aa, Artificial Sequence
  Description of Artificial Sequence: Synthetic peptide
  Seed: WLHKRGKYI (AKT1 E17K)
WTHKRGKYM

SEQ ID NO: 1590 - protein, 9 aa, Artificial Sequence
  Description of Artificial Sequence: Synthetic peptide
  Seed: WLHKRGKYI (AKT1 E17K)
WVHKRGKYA

SEQ ID NO: 1591 - protein, 9 aa, Artificial Sequence
  Description of Artificial Sequence: Synthetic peptide
  Seed: WLHKRGKYI (AKT1 E17K)
WVHKRGKYF

SEQ ID NO: 1592 - protein, 9 aa, Artificial Sequence
  Description of Artificial Sequence: Synthetic peptide
  Seed: WLHKRGKYI (AKT1 E17K)
WVHKRGKYI

SEQ ID NO: 1593 - protein, 9 aa, Artificial Sequence
  Description of Artificial Sequence: Synthetic peptide
  Seed: WLHKRGKYI (AKT1 E17K)
WVHKRGKYL

SEQ ID NO: 1594 - protein, 9 aa, Artificial Sequence
  Description of Artificial Sequence: Synthetic peptide
  Seed: WLHKRGKYI (AKT1 E17K)
WVHKRGKYM

SEQ ID NO: 1595 - protein, 9 aa, Artificial Sequence
  Description of Artificial Sequence: Synthetic peptide
  Seed: WLHKRGKYI (AKT1 E17K)
WVHKRGKYV

SEQ ID NO: 1596 - protein, 9 aa, Artificial Sequence
  Description of Artificial Sequence: Synthetic peptide
  Seed: WLHKRGKYI (AKT1 E17K)
WWHKRGKYL

SEQ ID NO: 1597 - protein, 9 aa, Artificial Sequence
  Description of Artificial Sequence: Synthetic peptide
  Seed: WLHKRGKYI (AKT1 E17K)
WYHKRGKYL

SEQ ID NO: 1598 - protein, 9 aa, Artificial Sequence
  Description of Artificial Sequence: Synthetic peptide
  Seed: GWLHKRGKY (AKT1 E17K)
GALHKRGKY

SEQ ID NO: 1599 - protein, 9 aa, Artificial Sequence
  Description of Artificial Sequence: Synthetic peptide
  Seed: GWLHKRGKY (AKT1 E17K)
GELHKRGKY

SEQ ID NO: 1600 - protein, 9 aa, Artificial Sequence
  Description of Artificial Sequence: Synthetic peptide
  Seed: GWLHKRGKY (AKT1 E17K)
GFLHKRGKY

SEQ ID NO: 1601 - protein, 9 aa, Artificial Sequence
  Description of Artificial Sequence: Synthetic peptide
  Seed: GWLHKRGKY (AKT1 E17K)
GGLHKRGKY

SEQ ID NO: 1602 - protein, 9 aa, Artificial Sequence
  Description of Artificial Sequence: Synthetic peptide
  Seed: GWLHKRGKY (AKT1 E17K)
GILHKRGKY

SEQ ID NO: 1603 - protein, 9 aa, Artificial Sequence
  Description of Artificial Sequence: Synthetic peptide
  Seed: GWLHKRGKY (AKT1 E17K)
GLLHKRGKF

SEQ ID NO: 1604 - protein, 9 aa, Artificial Sequence
  Description of Artificial Sequence: Synthetic peptide
  Seed: GWLHKRGKY (AKT1 E17K)
GLLHKRGKY

SEQ ID NO: 1605 - protein, 9 aa, Artificial Sequence
  Description of Artificial Sequence: Synthetic peptide
  Seed: GWLHKRGKY (AKT1 E17K)
GMLHKRGKF

SEQ ID NO: 1606 - protein, 9 aa, Artificial Sequence
  Description of Artificial Sequence: Synthetic peptide
  Seed: GWLHKRGKY (AKT1 E17K)
GNLHKRGKY

SEQ ID NO: 1607 - protein, 9 aa, Artificial Sequence
  Description of Artificial Sequence: Synthetic peptide
  Seed: GWLHKRGKY (AKT1 E17K)
GQLHKRGKY

SEQ ID NO: 1608 - protein, 9 aa, Artificial Sequence
  Description of Artificial Sequence: Synthetic peptide
  Seed: GWLHKRGKY (AKT1 E17K)
GSLHKRGKF

SEQ ID NO: 1609 - protein, 9 aa, Artificial Sequence
  Description of Artificial Sequence: Synthetic peptide
  Seed: GWLHKRGKY (AKT1 E17K)
GSLHKRGKY

SEQ ID NO: 1610 - protein, 9 aa, Artificial Sequence
  Description of Artificial Sequence: Synthetic peptide
  Seed: GWLHKRGKY (AKT1 E17K)
GTLHKRGKF

SEQ ID NO: 1611 - protein, 9 aa, Artificial Sequence
  Description of Artificial Sequence: Synthetic peptide
  Seed: GWLHKRGKY (AKT1 E17K)
GVLHKRGKF

SEQ ID NO: 1612 - protein, 9 aa, Artificial Sequence
  Description of Artificial Sequence: Synthetic peptide
  Seed: GWLHKRGKY (AKT1 E17K)
GVLHKRGKY

SEQ ID NO: 1613 - protein, 9 aa, Artificial Sequence
  Description of Artificial Sequence: Synthetic peptide
  Seed: GWLHKRGKY (AKT1 E17K)
GYLHKRGKF

SEQ ID NO: 1614 - protein, 9 aa, Artificial Sequence
  Description of Artificial Sequence: Synthetic peptide
  Seed: GWLHKRGKY (AKT1 E17K)
GYLHKRGKY

SEQ ID NO: 1615 - protein, 9 aa, Artificial Sequence
  Description of Artificial Sequence: Synthetic peptide
  Seed: KRGKYIKTW (AKT1 E17K)
KAGKYIKTF

SEQ ID NO: 1616 - protein, 9 aa, Artificial Sequence
  Description of Artificial Sequence: Synthetic peptide
  Seed: KRGKYIKTW (AKT1 E17K)
KAGKYIKTI

SEQ ID NO: 1617 - protein, 9 aa, Artificial Sequence
  Description of Artificial Sequence: Synthetic peptide
  Seed: KRGKYIKTW (AKT1 E17K)
KAGKYIKTL

SEQ ID NO: 1618 - protein, 9 aa, Artificial Sequence
  Description of Artificial Sequence: Synthetic peptide
  Seed: KRGKYIKTW (AKT1 E17K)
KAGKYIKTM

SEQ ID NO: 1619 - protein, 9 aa, Artificial Sequence
  Description of Artificial Sequence: Synthetic peptide
  Seed: KRGKYIKTW (AKT1 E17K)
KAGKYIKTV

SEQ ID NO: 1620 - protein, 9 aa, Artificial Sequence
  Description of Artificial Sequence: Synthetic peptide
  Seed: KRGKYIKTW (AKT1 E17K)
KAGKYIKTW

SEQ ID NO: 1621 - protein, 9 aa, Artificial Sequence
  Description of Artificial Sequence: Synthetic peptide
  Seed: KRGKYIKTW (AKT1 E17K)
KAGKYIKTY

SEQ ID NO: 1622 - protein, 9 aa, Artificial Sequence
  Description of Artificial Sequence: Synthetic peptide
  Seed: KRGKYIKTW (AKT1 E17K)
KCGKYIKTF

SEQ ID NO: 1623 - protein, 9 aa, Artificial Sequence
  Description of Artificial Sequence: Synthetic peptide
  Seed: KRGKYIKTW (AKT1 E17K)
KCGKYIKTW

SEQ ID NO: 1624 - protein, 9 aa, Artificial Sequence
  Description of Artificial Sequence: Synthetic peptide
  Seed: KRGKYIKTW (AKT1 E17K)
KCGKYIKTY

SEQ ID NO: 1625 - protein, 9 aa, Artificial Sequence
  Description of Artificial Sequence: Synthetic peptide
  Seed: KRGKYIKTW (AKT1 E17K)
KDGKYIKTF

SEQ ID NO: 1626 - protein, 9 aa, Artificial Sequence
  Description of Artificial Sequence: Synthetic peptide
  Seed: KRGKYIKTW (AKT1 E17K)
KDGKYIKTW

SEQ ID NO: 1627 - protein, 9 aa, Artificial Sequence
  Description of Artificial Sequence: Synthetic peptide
  Seed: KRGKYIKTW (AKT1 E17K)
KEGKYIKTF

SEQ ID NO: 1628 - protein, 9 aa, Artificial Sequence
  Description of Artificial Sequence: Synthetic peptide
  Seed: KRGKYIKTW (AKT1 E17K)
KEGKYIKTL

SEQ ID NO: 1629 - protein, 9 aa, Artificial Sequence
  Description of Artificial Sequence: Synthetic peptide
  Seed: KRGKYIKTW (AKT1 E17K)
KEGKYIKTM

SEQ ID NO: 1630 - protein, 9 aa, Artificial Sequence
  Description of Artificial Sequence: Synthetic peptide
  Seed: KRGKYIKTW (AKT1 E17K)
KEGKYIKTW

SEQ ID NO: 1631 - protein, 9 aa, Artificial Sequence
  Description of Artificial Sequence: Synthetic peptide
  Seed: KRGKYIKTW (AKT1 E17K)
KEGKYIKTY

SEQ ID NO: 1632 - protein, 11 aa, Artificial Sequence
  Description of Artificial Sequence: Synthetic peptide
  Seed: KEGWLHKRGKY (AKT1 E17K)
KEGWLHKRGKF

SEQ ID NO: 1633 - protein, 11 aa, Artificial Sequence
  Description of Artificial Sequence: Synthetic peptide
  Seed: KEGWLHKRGKY (AKT1 E17K)
KEGWLHKRGKL

SEQ ID NO: 1634 - protein, 11 aa, Artificial Sequence
  Description of Artificial Sequence: Synthetic peptide
  Seed: KEGWLHKRGKY (AKT1 E17K)
KEGWLHKRGKW

SEQ ID NO: 1635 - protein, 9 aa, Artificial Sequence
  Description of Artificial Sequence: Synthetic peptide
  Seed: KRGKYIKTW (AKT1 E17K)
KFGKYIKTF

SEQ ID NO: 1636 - protein, 9 aa, Artificial Sequence
  Description of Artificial Sequence: Synthetic peptide
  Seed: KRGKYIKTW (AKT1 E17K)
KFGKYIKTI

SEQ ID NO: 1637 - protein, 9 aa, Artificial Sequence
  Description of Artificial Sequence: Synthetic peptide
  Seed: KRGKYIKTW (AKT1 E17K)
KFGKYIKTL

SEQ ID NO: 1638 - protein, 9 aa, Artificial Sequence
  Description of Artificial Sequence: Synthetic peptide
  Seed: KRGKYIKTW (AKT1 E17K)
KFGKYIKTM

SEQ ID NO: 1639 - protein, 9 aa, Artificial Sequence
  Description of Artificial Sequence: Synthetic peptide
  Seed: KRGKYIKTW (AKT1 E17K)
KFGKYIKTV

SEQ ID NO: 1640 - protein, 9 aa, Artificial Sequence
  Description of Artificial Sequence: Synthetic peptide
  Seed: KRGKYIKTW (AKT1 E17K)
KFGKYIKTW

SEQ ID NO: 1641 - protein, 9 aa, Artificial Sequence
  Description of Artificial Sequence: Synthetic peptide
  Seed: KRGKYIKTW (AKT1 E17K)
KFGKYIKTY

SEQ ID NO: 1642 - protein, 9 aa, Artificial Sequence
  Description of Artificial Sequence: Synthetic peptide
  Seed: KRGKYIKTW (AKT1 E17K)
KGGKYIKTF

SEQ ID NO: 1643 - protein, 9 aa, Artificial Sequence
  Description of Artificial Sequence: Synthetic peptide
  Seed: KRGKYIKTW (AKT1 E17K)
KGGKYIKTL

SEQ ID NO: 1644 - protein, 9 aa, Artificial Sequence
  Description of Artificial Sequence: Synthetic peptide
  Seed: KRGKYIKTW (AKT1 E17K)
KGGKYIKTM

SEQ ID NO: 1645 - protein, 9 aa, Artificial Sequence
  Description of Artificial Sequence: Synthetic peptide
  Seed: KRGKYIKTW (AKT1 E17K)
KGGKYIKTW

SEQ ID NO: 1646 - protein, 9 aa, Artificial Sequence
  Description of Artificial Sequence: Synthetic peptide
  Seed: KRGKYIKTW (AKT1 E17K)
KGGKYIKTY

SEQ ID NO: 1647 - protein, 9 aa, Artificial Sequence
  Description of Artificial Sequence: Synthetic peptide
  Seed: KRGKYIKTW (AKT1 E17K)
KHGKYIKTF

SEQ ID NO: 1648 - protein, 9 aa, Artificial Sequence
  Description of Artificial Sequence: Synthetic peptide
  Seed: KRGKYIKTW (AKT1 E17K)
KHGKYIKTI

SEQ ID NO: 1649 - protein, 9 aa, Artificial Sequence
  Description of Artificial Sequence: Synthetic peptide
  Seed: KRGKYIKTW (AKT1 E17K)
KHGKYIKTL

SEQ ID NO: 1650 - protein, 9 aa, Artificial Sequence
  Description of Artificial Sequence: Synthetic peptide
  Seed: KRGKYIKTW (AKT1 E17K)
KHGKYIKTM

SEQ ID NO: 1651 - protein, 9 aa, Artificial Sequence
  Description of Artificial Sequence: Synthetic peptide
  Seed: KRGKYIKTW (AKT1 E17K)
KHGKYIKTV

SEQ ID NO: 1652 - protein, 9 aa, Artificial Sequence
  Description of Artificial Sequence: Synthetic peptide
  Seed: KRGKYIKTW (AKT1 E17K)
KHGKYIKTY

SEQ ID NO: 1653 - protein, 9 aa, Artificial Sequence
  Description of Artificial Sequence: Synthetic peptide
  Seed: KRGKYIKTW (AKT1 E17K)
KIGKYIKTF

SEQ ID NO: 1654 - protein, 9 aa, Artificial Sequence
  Description of Artificial Sequence: Synthetic peptide
  Seed: KRGKYIKTW (AKT1 E17K)
KIGKYIKTL

SEQ ID NO: 1655 - protein, 9 aa, Artificial Sequence
  Description of Artificial Sequence: Synthetic peptide
  Seed: KRGKYIKTW (AKT1 E17K)
KIGKYIKTM

SEQ ID NO: 1656 - protein, 9 aa, Artificial Sequence
  Description of Artificial Sequence: Synthetic peptide
  Seed: KRGKYIKTW (AKT1 E17K)
KIGKYIKTW

SEQ ID NO: 1657 - protein, 9 aa, Artificial Sequence
  Description of Artificial Sequence: Synthetic peptide
  Seed: KRGKYIKTW (AKT1 E17K)
KIGKYIKTY

SEQ ID NO: 1658 - protein, 9 aa, Artificial Sequence
  Description of Artificial Sequence: Synthetic peptide
  Seed: KRGKYIKTW (AKT1 E17K)
KKGKYIKTF

SEQ ID NO: 1659 - protein, 9 aa, Artificial Sequence
  Description of Artificial Sequence: Synthetic peptide
  Seed: KRGKYIKTW (AKT1 E17K)
KKGKYIKTK

SEQ ID NO: 1660 - protein, 9 aa, Artificial Sequence
  Description of Artificial Sequence: Synthetic peptide
  Seed: KRGKYIKTW (AKT1 E17K)
KKGKYIKTL

SEQ ID NO: 1661 - protein, 9 aa, Artificial Sequence
  Description of Artificial Sequence: Synthetic peptide
  Seed: KRGKYIKTW (AKT1 E17K)
KKGKYIKTM

SEQ ID NO: 1662 - protein, 9 aa, Artificial Sequence
  Description of Artificial Sequence: Synthetic peptide
  Seed: KRGKYIKTW (AKT1 E17K)
KKGKYIKTW

SEQ ID NO: 1663 - protein, 9 aa, Artificial Sequence
  Description of Artificial Sequence: Synthetic peptide
  Seed: KRGKYIKTW (AKT1 E17K)
KKGKYIKTY

SEQ ID NO: 1664 - protein, 9 aa, Artificial Sequence
  Description of Artificial Sequence: Synthetic peptide
  Seed: KRGKYIKTW (AKT1 E17K)
KLGKYIKTF

SEQ ID NO: 1665 - protein, 9 aa, Artificial Sequence
  Description of Artificial Sequence: Synthetic peptide
  Seed: KRGKYIKTW (AKT1 E17K)
KLGKYIKTL

SEQ ID NO: 1666 - protein, 9 aa, Artificial Sequence
  Description of Artificial Sequence: Synthetic peptide
  Seed: KRGKYIKTW (AKT1 E17K)
KLGKYIKTM

SEQ ID NO: 1667 - protein, 9 aa, Artificial Sequence
  Description of Artificial Sequence: Synthetic peptide
  Seed: KRGKYIKTW (AKT1 E17K)
KLGKYIKTW

SEQ ID NO: 1668 - protein, 9 aa, Artificial Sequence
  Description of Artificial Sequence: Synthetic peptide
  Seed: KRGKYIKTW (AKT1 E17K)
KLGKYIKTY

SEQ ID NO: 1669 - protein, 9 aa, Artificial Sequence
  Description of Artificial Sequence: Synthetic peptide
  Seed: KRGKYIKTW (AKT1 E17K)
KMGKYIKTF

SEQ ID NO: 1670 - protein, 9 aa, Artificial Sequence
  Description of Artificial Sequence: Synthetic peptide
  Seed: KRGKYIKTW (AKT1 E17K)
KMGKYIKTL

SEQ ID NO: 1671 - protein, 9 aa, Artificial Sequence
  Description of Artificial Sequence: Synthetic peptide
  Seed: KRGKYIKTW (AKT1 E17K)
KMGKYIKTM

SEQ ID NO: 1672 - protein, 9 aa, Artificial Sequence
  Description of Artificial Sequence: Synthetic peptide
  Seed: KRGKYIKTW (AKT1 E17K)
KMGKYIKTW

SEQ ID NO: 1673 - protein, 9 aa, Artificial Sequence
  Description of Artificial Sequence: Synthetic peptide
  Seed: KRGKYIKTW (AKT1 E17K)
KMGKYIKTY

SEQ ID NO: 1674 - protein, 9 aa, Artificial Sequence
  Description of Artificial Sequence: Synthetic peptide
  Seed: KRGKYIKTW (AKT1 E17K)
KNGKYIKTF

SEQ ID NO: 1675 - protein, 9 aa, Artificial Sequence
  Description of Artificial Sequence: Synthetic peptide
  Seed: KRGKYIKTW (AKT1 E17K)
KNGKYIKTL

SEQ ID NO: 1676 - protein, 9 aa, Artificial Sequence
  Description of Artificial Sequence: Synthetic peptide
  Seed: KRGKYIKTW (AKT1 E17K)
KNGKYIKTM

SEQ ID NO: 1677 - protein, 9 aa, Artificial Sequence
  Description of Artificial Sequence: Synthetic peptide
  Seed: KRGKYIKTW (AKT1 E17K)
KNGKYIKTW

SEQ ID NO: 1678 - protein, 9 aa, Artificial Sequence
  Description of Artificial Sequence: Synthetic peptide
  Seed: KRGKYIKTW (AKT1 E17K)
KNGKYIKTY

SEQ ID NO: 1679 - protein, 9 aa, Artificial Sequence
  Description of Artificial Sequence: Synthetic peptide
  Seed: KRGKYIKTW (AKT1 E17K)
KPGKYIKTF

SEQ ID NO: 1680 - protein, 9 aa, Artificial Sequence
  Description of Artificial Sequence: Synthetic peptide
  Seed: KRGKYIKTW (AKT1 E17K)
KPGKYIKTL

SEQ ID NO: 1681 - protein, 9 aa, Artificial Sequence
  Description of Artificial Sequence: Synthetic peptide
  Seed: KRGKYIKTW (AKT1 E17K)
KPGKYIKTW

SEQ ID NO: 1682 - protein, 9 aa, Artificial Sequence
  Description of Artificial Sequence: Synthetic peptide
  Seed: KYIKTWRPR (AKT1 E17K)
KPIKTWRPR

SEQ ID NO: 1683 - protein, 9 aa, Artificial Sequence
  Description of Artificial Sequence: Synthetic peptide
  Seed: KRGKYIKTW (AKT1 E17K)
KQGKYIKTF

SEQ ID NO: 1684 - protein, 9 aa, Artificial Sequence
  Description of Artificial Sequence: Synthetic peptide
  Seed: KRGKYIKTW (AKT1 E17K)
KQGKYIKTI

SEQ ID NO: 1685 - protein, 9 aa, Artificial Sequence
  Description of Artificial Sequence: Synthetic peptide
  Seed: KRGKYIKTW (AKT1 E17K)
KQGKYIKTK

SEQ ID NO: 1686 - protein, 9 aa, Artificial Sequence
  Description of Artificial Sequence: Synthetic peptide
  Seed: KRGKYIKTW (AKT1 E17K)
KQGKYIKTL

SEQ ID NO: 1687 - protein, 9 aa, Artificial Sequence
  Description of Artificial Sequence: Synthetic peptide
  Seed: KRGKYIKTW (AKT1 E17K)
KQGKYIKTM

SEQ ID NO: 1688 - protein, 9 aa, Artificial Sequence
  Description of Artificial Sequence: Synthetic peptide
  Seed: KRGKYIKTW (AKT1 E17K)
KQGKYIKTR

SEQ ID NO: 1689 - protein, 9 aa, Artificial Sequence
  Description of Artificial Sequence: Synthetic peptide
  Seed: KRGKYIKTW (AKT1 E17K)
KQGKYIKTV

SEQ ID NO: 1690 - protein, 9 aa, Artificial Sequence
  Description of Artificial Sequence: Synthetic peptide
  Seed: KRGKYIKTW (AKT1 E17K)
KQGKYIKTW

SEQ ID NO: 1691 - protein, 9 aa, Artificial Sequence
  Description of Artificial Sequence: Synthetic peptide
  Seed: KRGKYIKTW (AKT1 E17K)
KQGKYIKTY

SEQ ID NO: 1692 - protein, 9 aa, Artificial Sequence
  Description of Artificial Sequence: Synthetic peptide
  Seed: KRGKYIKTW (AKT1 E17K)
KRGKYIKTA

SEQ ID NO: 1693 - protein, 9 aa, Artificial Sequence
  Description of Artificial Sequence: Synthetic peptide
  Seed: KRGKYIKTW (AKT1 E17K)
KRGKYIKTC

SEQ ID NO: 1694 - protein, 9 aa, Artificial Sequence
  Description of Artificial Sequence: Synthetic peptide
  Seed: KRGKYIKTW (AKT1 E17K)
KRGKYIKTH

SEQ ID NO: 1695 - protein, 9 aa, Artificial Sequence
  Description of Artificial Sequence: Synthetic peptide
  Seed: KRGKYIKTW (AKT1 E17K)
KRGKYIKTI

SEQ ID NO: 1696 - protein, 9 aa, Artificial Sequence
  Description of Artificial Sequence: Synthetic peptide
  Seed: KRGKYIKTW (AKT1 E17K)
KRGKYIKTK

SEQ ID NO: 1697 - protein, 9 aa, Artificial Sequence
  Description of Artificial Sequence: Synthetic peptide
  Seed: KRGKYIKTW (AKT1 E17K)
KRGKYIKTM

SEQ ID NO: 1698 - protein, 9 aa, Artificial Sequence
  Description of Artificial Sequence: Synthetic peptide
  Seed: KRGKYIKTW (AKT1 E17K)
KRGKYIKTQ

SEQ ID NO: 1699 - protein, 9 aa, Artificial Sequence
  Description of Artificial Sequence: Synthetic peptide
  Seed: KRGKYIKTW (AKT1 E17K)
KRGKYIKTR

SEQ ID NO: 1700 - protein, 9 aa, Artificial Sequence
  Description of Artificial Sequence: Synthetic peptide
  Seed: KRGKYIKTW (AKT1 E17K)
KRGKYIKTT

SEQ ID NO: 1701 - protein, 9 aa, Artificial Sequence
  Description of Artificial Sequence: Synthetic peptide
  Seed: KRGKYIKTW (AKT1 E17K)
KRGKYIKTV

SEQ ID NO: 1702 - protein, 10 aa, Artificial Sequence
  Description of Artificial Sequence: Synthetic peptide
  Seed: KRGKYIKTWR (AKT1 E17K)
KRGKYIKTWW

SEQ ID NO: 1703 - protein, 9 aa, Artificial Sequence
  Description of Artificial Sequence: Synthetic peptide
  Seed: KRGKYIKTW (AKT1 E17K)
KSGKYIKTC

SEQ ID NO: 1704 - protein, 9 aa, Artificial Sequence
  Description of Artificial Sequence: Synthetic peptide
  Seed: KRGKYIKTW (AKT1 E17K)
KSGKYIKTF

SEQ ID NO: 1705 - protein, 9 aa, Artificial Sequence
  Description of Artificial Sequence: Synthetic peptide
  Seed: KRGKYIKTW (AKT1 E17K)
KSGKYIKTI

SEQ ID NO: 1706 - protein, 9 aa, Artificial Sequence
  Description of Artificial Sequence: Synthetic peptide
  Seed: KRGKYIKTW (AKT1 E17K)
KSGKYIKTL

SEQ ID NO: 1707 - protein, 9 aa, Artificial Sequence
  Description of Artificial Sequence: Synthetic peptide
  Seed: KRGKYIKTW (AKT1 E17K)
KSGKYIKTM

SEQ ID NO: 1708 - protein, 9 aa, Artificial Sequence
  Description of Artificial Sequence: Synthetic peptide
  Seed: KRGKYIKTW (AKT1 E17K)
KSGKYIKTV

SEQ ID NO: 1709 - protein, 9 aa, Artificial Sequence
  Description of Artificial Sequence: Synthetic peptide
  Seed: KRGKYIKTW (AKT1 E17K)
KSGKYIKTW

SEQ ID NO: 1710 - protein, 9 aa, Artificial Sequence
  Description of Artificial Sequence: Synthetic peptide
  Seed: KRGKYIKTW (AKT1 E17K)
KSGKYIKTY

SEQ ID NO: 1711 - protein, 9 aa, Artificial Sequence
  Description of Artificial Sequence: Synthetic peptide
  Seed: KRGKYIKTW (AKT1 E17K)
KTGKYIKTC

SEQ ID NO: 1712 - protein, 9 aa, Artificial Sequence
  Description of Artificial Sequence: Synthetic peptide
  Seed: KRGKYIKTW (AKT1 E17K)
KTGKYIKTI

SEQ ID NO: 1713 - protein, 9 aa, Artificial Sequence
  Description of Artificial Sequence: Synthetic peptide
  Seed: KRGKYIKTW (AKT1 E17K)
KTGKYIKTL

SEQ ID NO: 1714 - protein, 9 aa, Artificial Sequence
  Description of Artificial Sequence: Synthetic peptide
  Seed: KRGKYIKTW (AKT1 E17K)
KTGKYIKTM

SEQ ID NO: 1715 - protein, 9 aa, Artificial Sequence
  Description of Artificial Sequence: Synthetic peptide
  Seed: KRGKYIKTW (AKT1 E17K)
KTGKYIKTV

SEQ ID NO: 1716 - protein, 9 aa, Artificial Sequence
  Description of Artificial Sequence: Synthetic peptide
  Seed: KRGKYIKTW (AKT1 E17K)
KTGKYIKTW

SEQ ID NO: 1717 - protein, 9 aa, Artificial Sequence
  Description of Artificial Sequence: Synthetic peptide
  Seed: KRGKYIKTW (AKT1 E17K)
KTGKYIKTY

SEQ ID NO: 1718 - protein, 9 aa, Artificial Sequence
  Description of Artificial Sequence: Synthetic peptide
  Seed: KRGKYIKTW (AKT1 E17K)
KVGKYIKTF

SEQ ID NO: 1719 - protein, 9 aa, Artificial Sequence
  Description of Artificial Sequence: Synthetic peptide
  Seed: KRGKYIKTW (AKT1 E17K)
KVGKYIKTI

SEQ ID NO: 1720 - protein, 9 aa, Artificial Sequence
  Description of Artificial Sequence: Synthetic peptide
  Seed: KRGKYIKTW (AKT1 E17K)
KVGKYIKTL

SEQ ID NO: 1721 - protein, 9 aa, Artificial Sequence
  Description of Artificial Sequence: Synthetic peptide
  Seed: KRGKYIKTW (AKT1 E17K)
KVGKYIKTM

SEQ ID NO: 1722 - protein, 9 aa, Artificial Sequence
  Description of Artificial Sequence: Synthetic peptide
  Seed: KRGKYIKTW (AKT1 E17K)
KVGKYIKTW

SEQ ID NO: 1723 - protein, 9 aa, Artificial Sequence
  Description of Artificial Sequence: Synthetic peptide
  Seed: KRGKYIKTW (AKT1 E17K)
KVGKYIKTY

SEQ ID NO: 1724 - protein, 9 aa, Artificial Sequence
  Description of Artificial Sequence: Synthetic peptide
  Seed: KRGKYIKTW (AKT1 E17K)
KWGKYIKTF

SEQ ID NO: 1725 - protein, 9 aa, Artificial Sequence
  Description of Artificial Sequence: Synthetic peptide
  Seed: KRGKYIKTW (AKT1 E17K)
KWGKYIKTL

SEQ ID NO: 1726 - protein, 9 aa, Artificial Sequence
  Description of Artificial Sequence: Synthetic peptide
  Seed: KRGKYIKTW (AKT1 E17K)
KWGKYIKTM

SEQ ID NO: 1727 - protein, 9 aa, Artificial Sequence
  Description of Artificial Sequence: Synthetic peptide
  Seed: KRGKYIKTW (AKT1 E17K)
KWGKYIKTW

SEQ ID NO: 1728 - protein, 9 aa, Artificial Sequence
  Description of Artificial Sequence: Synthetic peptide
  Seed: KRGKYIKTW (AKT1 E17K)
KWGKYIKTY

SEQ ID NO: 1729 - protein, 9 aa, Artificial Sequence
  Description of Artificial Sequence: Synthetic peptide
  Seed: KRGKYIKTW (AKT1 E17K)
KYGKYIKTF

SEQ ID NO: 1730 - protein, 9 aa, Artificial Sequence
  Description of Artificial Sequence: Synthetic peptide
  Seed: KRGKYIKTW (AKT1 E17K)
KYGKYIKTI

SEQ ID NO: 1731 - protein, 9 aa, Artificial Sequence
  Description of Artificial Sequence: Synthetic peptide
  Seed: KRGKYIKTW (AKT1 E17K)
KYGKYIKTL

SEQ ID NO: 1732 - protein, 9 aa, Artificial Sequence
  Description of Artificial Sequence: Synthetic peptide
  Seed: KRGKYIKTW (AKT1 E17K)
KYGKYIKTM

SEQ ID NO: 1733 - protein, 9 aa, Artificial Sequence
  Description of Artificial Sequence: Synthetic peptide
  Seed: KRGKYIKTW (AKT1 E17K)
KYGKYIKTV

SEQ ID NO: 1734 - protein, 9 aa, Artificial Sequence
  Description of Artificial Sequence: Synthetic peptide
  Seed: KRGKYIKTW (AKT1 E17K)
KYGKYIKTW

SEQ ID NO: 1735 - protein, 9 aa, Artificial Sequence
  Description of Artificial Sequence: Synthetic peptide
  Seed: KRGKYIKTW (AKT1 E17K)
KYGKYIKTY

SEQ ID NO: 1736 - protein, 8 aa, Artificial Sequence
  Description of Artificial Sequence: Synthetic peptide
  Seed: RGKYIKTW (AKT1 E17K)
RAKYIKTF

SEQ ID NO: 1737 - protein, 8 aa, Artificial Sequence
  Description of Artificial Sequence: Synthetic peptide
  Seed: RGKYIKTW (AKT1 E17K)
RAKYIKTW

SEQ ID NO: 1738 - protein, 8 aa, Artificial Sequence
  Description of Artificial Sequence: Synthetic peptide
  Seed: RGKYIKTW (AKT1 E17K)
RCKYIKTW

SEQ ID NO: 1739 - protein, 8 aa, Artificial Sequence
  Description of Artificial Sequence: Synthetic peptide
  Seed: RGKYIKTW (AKT1 E17K)
RDKYIKTW

SEQ ID NO: 1740 - protein, 9 aa, Artificial Sequence
  Description of Artificial Sequence: Synthetic peptide
  Seed: RGKYIKTWR (AKT1 E17K)
RDKYIKTWK

SEQ ID NO: 1741 - protein, 9 aa, Artificial Sequence
  Description of Artificial Sequence: Synthetic peptide
  Seed: RGKYIKTWR (AKT1 E17K)
RDKYIKTWR

SEQ ID NO: 1742 - protein, 8 aa, Artificial Sequence
  Description of Artificial Sequence: Synthetic peptide
  Seed: RGKYIKTW (AKT1 E17K)
REKYIKTW

SEQ ID NO: 1743 - protein, 9 aa, Artificial Sequence
  Description of Artificial Sequence: Synthetic peptide
  Seed: RGKYIKTWR (AKT1 E17K)
REKYIKTWK

SEQ ID NO: 1744 - protein, 9 aa, Artificial Sequence
  Description of Artificial Sequence: Synthetic peptide
  Seed: RGKYIKTWR (AKT1 E17K)
REKYIKTWR

SEQ ID NO: 1745 - protein, 8 aa, Artificial Sequence
  Description of Artificial Sequence: Synthetic peptide
  Seed: RGKYIKTW (AKT1 E17K)
RIKYIKTW

SEQ ID NO: 1746 - protein, 9 aa, Artificial Sequence
  Description of Artificial Sequence: Synthetic peptide
  Seed: RGKYIKTWR (AKT1 E17K)
RKKYIKTWR

SEQ ID NO: 1747 - protein, 8 aa, Artificial Sequence
  Description of Artificial Sequence: Synthetic peptide
  Seed: RGKYIKTW (AKT1 E17K)
RLKYIKTW

SEQ ID NO: 1748 - protein, 8 aa, Artificial Sequence
  Description of Artificial Sequence: Synthetic peptide
  Seed: RGKYIKTW (AKT1 E17K)
RMKYIKTW

SEQ ID NO: 1749 - protein, 8 aa, Artificial Sequence
  Description of Artificial Sequence: Synthetic peptide
  Seed: RGKYIKTW (AKT1 E17K)
RNKYIKTW

SEQ ID NO: 1750 - protein, 8 aa, Artificial Sequence
  Description of Artificial Sequence: Synthetic peptide
  Seed: RGKYIKTW (AKT1 E17K)
RQKYIKTW

SEQ ID NO: 1751 - protein, 8 aa, Artificial Sequence
  Description of Artificial Sequence: Synthetic peptide
  Seed: RGKYIKTW (AKT1 E17K)
RSKYIKTF

SEQ ID NO: 1752 - protein, 8 aa, Artificial Sequence
  Description of Artificial Sequence: Synthetic peptide
  Seed: RGKYIKTW (AKT1 E17K)
RSKYIKTL

SEQ ID NO: 1753 - protein, 8 aa, Artificial Sequence
  Description of Artificial Sequence: Synthetic peptide
  Seed: RGKYIKTW (AKT1 E17K)
RSKYIKTW

SEQ ID NO: 1754 - protein, 8 aa, Artificial Sequence
  Description of Artificial Sequence: Synthetic peptide
  Seed: RGKYIKTW (AKT1 E17K)
RSKYIKTY

SEQ ID NO: 1755 - protein, 8 aa, Artificial Sequence
  Description of Artificial Sequence: Synthetic peptide
  Seed: RGKYIKTW (AKT1 E17K)
RTKYIKTF

SEQ ID NO: 1756 - protein, 8 aa, Artificial Sequence
  Description of Artificial Sequence: Synthetic peptide
  Seed: RGKYIKTW (AKT1 E17K)
RTKYIKTL

SEQ ID NO: 1757 - protein, 8 aa, Artificial Sequence
  Description of Artificial Sequence: Synthetic peptide
  Seed: RGKYIKTW (AKT1 E17K)
RTKYIKTW

SEQ ID NO: 1758 - protein, 8 aa, Artificial Sequence
  Description of Artificial Sequence: Synthetic peptide
  Seed: RGKYIKTW (AKT1 E17K)
RVKYIKTW

SEQ ID NO: 1759 - protein, 10 aa, Homo sapiens
  Native (AKT1 E17K)
KRGKYIKTWR

SEQ ID NO: 1760 - protein, 9 aa, Homo sapiens
  Native (AKT1 E17K)
KYIKTWRPR

SEQ ID NO: 1761 - protein, 10 aa, Homo sapiens
  Native (AKT1 E17K)
KYIKTWRPRY

SEQ ID NO: 1762 - protein, 9 aa, Homo sapiens
  Native (AKT1 E17K)
RGKYIKTWR

SEQ ID NO: 1763 - protein, 11 aa, Homo sapiens
  Native (AKT1 E17K)
RGKYIKTWRPR

SEQ ID NO: 1764 - protein, 9 aa, Homo sapiens
  Native (AKT1 E17K)
WLHKRGKYI

SEQ ID NO: 1765 - protein, 9 aa, Homo sapiens
  Native (AKT1 E17K)
GWLHKRGKY

SEQ ID NO: 1766 - protein, 11 aa, Homo sapiens
  Native (AKT1 E17K)
KEGWLHKRGKY

SEQ ID NO: 1767 - protein, 9 aa, Homo sapiens
  Native (AKT1 E17K)
KRGKYIKTW

SEQ ID NO: 1768 - protein, 8 aa, Homo sapiens
  Native (AKT1 E17K)
RGKYIKTW

SEQ ID NO: 1769 - protein, 10 aa, Artificial Sequence
  Description of Artificial Sequence: Synthetic peptide
  Seed: DFGLATEKSR (BRAF V600E)
DYGLATEKSR

SEQ ID NO: 1770 - protein, 11 aa, Artificial Sequence
  Description of Artificial Sequence: Synthetic peptide
  Seed: EKSRWSGSHQF (BRAF V600E)
EASRWSGSHQF

SEQ ID NO: 1771 - protein, 11 aa, Artificial Sequence
  Description of Artificial Sequence: Synthetic peptide
  Seed: EKSRWSGSHQF (BRAF V600E)
EASRWSGSHQI

SEQ ID NO: 1772 - protein, 11 aa, Artificial Sequence
  Description of Artificial Sequence: Synthetic peptide
  Seed: EKSRWSGSHQF (BRAF V600E)
EASRWSGSHQL

SEQ ID NO: 1773 - protein, 11 aa, Artificial Sequence
  Description of Artificial Sequence: Synthetic peptide
  Seed: EKSRWSGSHQF (BRAF V600E)
EASRWSGSHQM

SEQ ID NO: 1774 - protein, 11 aa, Artificial Sequence
  Description of Artificial Sequence: Synthetic peptide
  Seed: EKSRWSGSHQF (BRAF V600E)
ECSRWSGSHQF

SEQ ID NO: 1775 - protein, 11 aa, Artificial Sequence
  Description of Artificial Sequence: Synthetic peptide
  Seed: EKSRWSGSHQF (BRAF V600E)
ECSRWSGSHQI

SEQ ID NO: 1776 - protein, 11 aa, Artificial Sequence
  Description of Artificial Sequence: Synthetic peptide
  Seed: EKSRWSGSHQF (BRAF V600E)
ECSRWSGSHQL

SEQ ID NO: 1777 - protein, 11 aa, Artificial Sequence
  Description of Artificial Sequence: Synthetic peptide
  Seed: EKSRWSGSHQF (BRAF V600E)
ECSRWSGSHQM

SEQ ID NO: 1778 - protein, 11 aa, Artificial Sequence
  Description of Artificial Sequence: Synthetic peptide
  Seed: EKSRWSGSHQF (BRAF V600E)
EDSRWSGSHQF

SEQ ID NO: 1779 - protein, 11 aa, Artificial Sequence
  Description of Artificial Sequence: Synthetic peptide
  Seed: EKSRWSGSHQF (BRAF V600E)
EDSRWSGSHQI

SEQ ID NO: 1780 - protein, 11 aa, Artificial Sequence
  Description of Artificial Sequence: Synthetic peptide
  Seed: EKSRWSGSHQF (BRAF V600E)
EDSRWSGSHQL

SEQ ID NO: 1781 - protein, 11 aa, Artificial Sequence
  Description of Artificial Sequence: Synthetic peptide
  Seed: EKSRWSGSHQF (BRAF V600E)
EDSRWSGSHQM

SEQ ID NO: 1782 - protein, 11 aa, Artificial Sequence
  Description of Artificial Sequence: Synthetic peptide
  Seed: EKSRWSGSHQF (BRAF V600E)
EESRWSGSHQF

SEQ ID NO: 1783 - protein, 11 aa, Artificial Sequence
  Description of Artificial Sequence: Synthetic peptide
  Seed: EKSRWSGSHQF (BRAF V600E)
EESRWSGSHQI

SEQ ID NO: 1784 - protein, 11 aa, Artificial Sequence
  Description of Artificial Sequence: Synthetic peptide
  Seed: EKSRWSGSHQF (BRAF V600E)
EESRWSGSHQL

SEQ ID NO: 1785 - protein, 11 aa, Artificial Sequence
  Description of Artificial Sequence: Synthetic peptide
  Seed: EKSRWSGSHQF (BRAF V600E)
EESRWSGSHQM

SEQ ID NO: 1786 - protein, 11 aa, Artificial Sequence
  Description of Artificial Sequence: Synthetic peptide
  Seed: EKSRWSGSHQF (BRAF V600E)
EFSRWSGSHQF

SEQ ID NO: 1787 - protein, 11 aa, Artificial Sequence
  Description of Artificial Sequence: Synthetic peptide
  Seed: EKSRWSGSHQF (BRAF V600E)
EFSRWSGSHQI

SEQ ID NO: 1788 - protein, 11 aa, Artificial Sequence
  Description of Artificial Sequence: Synthetic peptide
  Seed: EKSRWSGSHQF (BRAF V600E)
EFSRWSGSHQK

SEQ ID NO: 1789 - protein, 11 aa, Artificial Sequence
  Description of Artificial Sequence: Synthetic peptide
  Seed: EKSRWSGSHQF (BRAF V600E)
EFSRWSGSHQL

SEQ ID NO: 1790 - protein, 11 aa, Artificial Sequence
  Description of Artificial Sequence: Synthetic peptide
  Seed: EKSRWSGSHQF (BRAF V600E)
EFSRWSGSHQM

SEQ ID NO: 1791 - protein, 11 aa, Artificial Sequence
  Description of Artificial Sequence: Synthetic peptide
  Seed: EKSRWSGSHQF (BRAF V600E)
EFSRWSGSHQV

SEQ ID NO: 1792 - protein, 11 aa, Artificial Sequence
  Description of Artificial Sequence: Synthetic peptide
  Seed: EKSRWSGSHQF (BRAF V600E)
EGSRWSGSHQF

SEQ ID NO: 1793 - protein, 11 aa, Artificial Sequence
  Description of Artificial Sequence: Synthetic peptide
  Seed: EKSRWSGSHQF (BRAF V600E)
EGSRWSGSHQI

SEQ ID NO: 1794 - protein, 11 aa, Artificial Sequence
  Description of Artificial Sequence: Synthetic peptide
  Seed: EKSRWSGSHQF (BRAF V600E)
EGSRWSGSHQL

SEQ ID NO: 1795 - protein, 11 aa, Artificial Sequence
  Description of Artificial Sequence: Synthetic peptide
  Seed: EKSRWSGSHQF (BRAF V600E)
EGSRWSGSHQM

SEQ ID NO: 1796 - protein, 11 aa, Artificial Sequence
  Description of Artificial Sequence: Synthetic peptide
  Seed: EKSRWSGSHQF (BRAF V600E)
EGSRWSGSHQV

SEQ ID NO: 1797 - protein, 11 aa, Artificial Sequence
  Description of Artificial Sequence: Synthetic peptide
  Seed: EKSRWSGSHQF (BRAF V600E)
EHSRWSGSHQF

SEQ ID NO: 1798 - protein, 11 aa, Artificial Sequence
  Description of Artificial Sequence: Synthetic peptide
  Seed: EKSRWSGSHQF (BRAF V600E)
EHSRWSGSHQI

SEQ ID NO: 1799 - protein, 11 aa, Artificial Sequence
  Description of Artificial Sequence: Synthetic peptide
  Seed: EKSRWSGSHQF (BRAF V600E)
EHSRWSGSHQL

SEQ ID NO: 1800 - protein, 11 aa, Artificial Sequence
  Description of Artificial Sequence: Synthetic peptide
  Seed: EKSRWSGSHQF (BRAF V600E)
EHSRWSGSHQM

SEQ ID NO: 1801 - protein, 11 aa, Artificial Sequence
  Description of Artificial Sequence: Synthetic peptide
  Seed: EKSRWSGSHQF (BRAF V600E)
EISRWSGSHQF

SEQ ID NO: 1802 - protein, 11 aa, Artificial Sequence
  Description of Artificial Sequence: Synthetic peptide
  Seed: EKSRWSGSHQF (BRAF V600E)
EISRWSGSHQI

SEQ ID NO: 1803 - protein, 11 aa, Artificial Sequence
  Description of Artificial Sequence: Synthetic peptide
  Seed: EKSRWSGSHQF (BRAF V600E)
EISRWSGSHQL

SEQ ID NO: 1804 - protein, 11 aa, Artificial Sequence
  Description of Artificial Sequence: Synthetic peptide
  Seed: EKSRWSGSHQF (BRAF V600E)
EISRWSGSHQM

SEQ ID NO: 1805 - protein, 11 aa, Artificial Sequence
  Description of Artificial Sequence: Synthetic peptide
  Seed: EKSRWSGSHQF (BRAF V600E)
EKSRWSGSHQI

SEQ ID NO: 1806 - protein, 11 aa, Artificial Sequence
  Description of Artificial Sequence: Synthetic peptide
  Seed: EKSRWSGSHQF (BRAF V600E)
EKSRWSGSHQL

SEQ ID NO: 1807 - protein, 11 aa, Artificial Sequence
  Description of Artificial Sequence: Synthetic peptide
  Seed: EKSRWSGSHQF (BRAF V600E)
EKSRWSGSHQM

SEQ ID NO: 1808 - protein, 11 aa, Artificial Sequence
  Description of Artificial Sequence: Synthetic peptide
  Seed: EKSRWSGSHQF (BRAF V600E)
EKSRWSGSHQV

SEQ ID NO: 1809 - protein, 11 aa, Artificial Sequence
  Description of Artificial Sequence: Synthetic peptide
  Seed: EKSRWSGSHQF (BRAF V600E)
ELSRWSGSHQF

SEQ ID NO: 1810 - protein, 11 aa, Artificial Sequence
  Description of Artificial Sequence: Synthetic peptide
  Seed: EKSRWSGSHQF (BRAF V600E)
ELSRWSGSHQI

SEQ ID NO: 1811 - protein, 11 aa, Artificial Sequence
  Description of Artificial Sequence: Synthetic peptide
  Seed: EKSRWSGSHQF (BRAF V600E)
ELSRWSGSHQL

SEQ ID NO: 1812 - protein, 11 aa, Artificial Sequence
  Description of Artificial Sequence: Synthetic peptide
  Seed: EKSRWSGSHQF (BRAF V600E)
ELSRWSGSHQM

SEQ ID NO: 1813 - protein, 11 aa, Artificial Sequence
  Description of Artificial Sequence: Synthetic peptide
  Seed: EKSRWSGSHQF (BRAF V600E)
EMSRWSGSHQF

SEQ ID NO: 1814 - protein, 11 aa, Artificial Sequence
  Description of Artificial Sequence: Synthetic peptide
  Seed: EKSRWSGSHQF (BRAF V600E)
EMSRWSGSHQI

SEQ ID NO: 1815 - protein, 11 aa, Artificial Sequence
  Description of Artificial Sequence: Synthetic peptide
  Seed: EKSRWSGSHQF (BRAF V600E)
EMSRWSGSHQK

SEQ ID NO: 1816 - protein, 11 aa, Artificial Sequence
  Description of Artificial Sequence: Synthetic peptide
  Seed: EKSRWSGSHQF (BRAF V600E)
EMSRWSGSHQL

SEQ ID NO: 1817 - protein, 11 aa, Artificial Sequence
  Description of Artificial Sequence: Synthetic peptide
  Seed: EKSRWSGSHQF (BRAF V600E)
EMSRWSGSHQM

SEQ ID NO: 1818 - protein, 11 aa, Artificial Sequence
  Description of Artificial Sequence: Synthetic peptide
  Seed: EKSRWSGSHQF (BRAF V600E)
EMSRWSGSHQV

SEQ ID NO: 1819 - protein, 11 aa, Artificial Sequence
  Description of Artificial Sequence: Synthetic peptide
  Seed: EKSRWSGSHQF (BRAF V600E)
ENSRWSGSHQF

SEQ ID NO: 1820 - protein, 11 aa, Artificial Sequence
  Description of Artificial Sequence: Synthetic peptide
  Seed: EKSRWSGSHQF (BRAF V600E)
ENSRWSGSHQI

SEQ ID NO: 1821 - protein, 11 aa, Artificial Sequence
  Description of Artificial Sequence: Synthetic peptide
  Seed: EKSRWSGSHQF (BRAF V600E)
ENSRWSGSHQL

SEQ ID NO: 1822 - protein, 11 aa, Artificial Sequence
  Description of Artificial Sequence: Synthetic peptide
  Seed: EKSRWSGSHQF (BRAF V600E)
ENSRWSGSHQM

SEQ ID NO: 1823 - protein, 11 aa, Artificial Sequence
  Description of Artificial Sequence: Synthetic peptide
  Seed: EKSRWSGSHQF (BRAF V600E)
EPSRWSGSHQF

SEQ ID NO: 1824 - protein, 11 aa, Artificial Sequence
  Description of Artificial Sequence: Synthetic peptide
  Seed: EKSRWSGSHQF (BRAF V600E)
EPSRWSGSHQI

SEQ ID NO: 1825 - protein, 11 aa, Artificial Sequence
  Description of Artificial Sequence: Synthetic peptide
  Seed: EKSRWSGSHQF (BRAF V600E)
EPSRWSGSHQL

SEQ ID NO: 1826 - protein, 11 aa, Artificial Sequence
  Description of Artificial Sequence: Synthetic peptide
  Seed: EKSRWSGSHQF (BRAF V600E)
EPSRWSGSHQM

SEQ ID NO: 1827 - protein, 11 aa, Artificial Sequence
  Description of Artificial Sequence: Synthetic peptide
  Seed: EKSRWSGSHQF (BRAF V600E)
EQSRWSGSHQF

SEQ ID NO: 1828 - protein, 11 aa, Artificial Sequence
  Description of Artificial Sequence: Synthetic peptide
  Seed: EKSRWSGSHQF (BRAF V600E)
EQSRWSGSHQI

SEQ ID NO: 1829 - protein, 11 aa, Artificial Sequence
  Description of Artificial Sequence: Synthetic peptide
  Seed: EKSRWSGSHQF (BRAF V600E)
EQSRWSGSHQL

SEQ ID NO: 1830 - protein, 11 aa, Artificial Sequence
  Description of Artificial Sequence: Synthetic peptide
  Seed: EKSRWSGSHQF (BRAF V600E)
EQSRWSGSHQM

SEQ ID NO: 1831 - protein, 11 aa, Artificial Sequence
  Description of Artificial Sequence: Synthetic peptide
  Seed: EKSRWSGSHQF (BRAF V600E)
ERSRWSGSHQF

SEQ ID NO: 1832 - protein, 11 aa, Artificial Sequence
  Description of Artificial Sequence: Synthetic peptide
  Seed: EKSRWSGSHQF (BRAF V600E)
ERSRWSGSHQI

SEQ ID NO: 1833 - protein, 11 aa, Artificial Sequence
  Description of Artificial Sequence: Synthetic peptide
  Seed: EKSRWSGSHQF (BRAF V600E)
ERSRWSGSHQK

SEQ ID NO: 1834 - protein, 11 aa, Artificial Sequence
  Description of Artificial Sequence: Synthetic peptide
  Seed: EKSRWSGSHQF (BRAF V600E)
ERSRWSGSHQL

SEQ ID NO: 1835 - protein, 11 aa, Artificial Sequence
  Description of Artificial Sequence: Synthetic peptide
  Seed: EKSRWSGSHQF (BRAF V600E)
ERSRWSGSHQM

SEQ ID NO: 1836 - protein, 11 aa, Artificial Sequence
  Description of Artificial Sequence: Synthetic peptide
  Seed: EKSRWSGSHQF (BRAF V600E)
ERSRWSGSHQR

SEQ ID NO: 1837 - protein, 11 aa, Artificial Sequence
  Description of Artificial Sequence: Synthetic peptide
  Seed: EKSRWSGSHQF (BRAF V600E)
ERSRWSGSHQV

SEQ ID NO: 1838 - protein, 11 aa, Artificial Sequence
  Description of Artificial Sequence: Synthetic peptide
  Seed: EKSRWSGSHQF (BRAF V600E)
ERSRWSGSHQY

SEQ ID NO: 1839 - protein, 11 aa, Artificial Sequence
  Description of Artificial Sequence: Synthetic peptide
  Seed: EKSRWSGSHQF (BRAF V600E)
ESSRWSGSHQF

SEQ ID NO: 1840 - protein, 11 aa, Artificial Sequence
  Description of Artificial Sequence: Synthetic peptide
  Seed: EKSRWSGSHQF (BRAF V600E)
ESSRWSGSHQI

SEQ ID NO: 1841 - protein, 11 aa, Artificial Sequence
  Description of Artificial Sequence: Synthetic peptide
  Seed: EKSRWSGSHQF (BRAF V600E)
ESSRWSGSHQL

SEQ ID NO: 1842 - protein, 11 aa, Artificial Sequence
  Description of Artificial Sequence: Synthetic peptide
  Seed: EKSRWSGSHQF (BRAF V600E)
ESSRWSGSHQM

SEQ ID NO: 1843 - protein, 11 aa, Artificial Sequence
  Description of Artificial Sequence: Synthetic peptide
  Seed: EKSRWSGSHQF (BRAF V600E)
ETSRWSGSHQF

SEQ ID NO: 1844 - protein, 11 aa, Artificial Sequence
  Description of Artificial Sequence: Synthetic peptide
  Seed: EKSRWSGSHQF (BRAF V600E)
ETSRWSGSHQI

SEQ ID NO: 1845 - protein, 11 aa, Artificial Sequence
  Description of Artificial Sequence: Synthetic peptide
  Seed: EKSRWSGSHQF (BRAF V600E)
ETSRWSGSHQL

SEQ ID NO: 1846 - protein, 11 aa, Artificial Sequence
  Description of Artificial Sequence: Synthetic peptide
  Seed: EKSRWSGSHQF (BRAF V600E)
ETSRWSGSHQM

SEQ ID NO: 1847 - protein, 11 aa, Artificial Sequence
  Description of Artificial Sequence: Synthetic peptide
  Seed: EKSRWSGSHQF (BRAF V600E)
EVSRWSGSHQF

SEQ ID NO: 1848 - protein, 11 aa, Artificial Sequence
  Description of Artificial Sequence: Synthetic peptide
  Seed: EKSRWSGSHQF (BRAF V600E)
EVSRWSGSHQI

SEQ ID NO: 1849 - protein, 11 aa, Artificial Sequence
  Description of Artificial Sequence: Synthetic peptide
  Seed: EKSRWSGSHQF (BRAF V600E)
EVSRWSGSHQL

SEQ ID NO: 1850 - protein, 11 aa, Artificial Sequence
  Description of Artificial Sequence: Synthetic peptide
  Seed: EKSRWSGSHQF (BRAF V600E)
EVSRWSGSHQM

SEQ ID NO: 1851 - protein, 11 aa, Artificial Sequence
  Description of Artificial Sequence: Synthetic peptide
  Seed: EKSRWSGSHQF (BRAF V600E)
EWSRWSGSHQF

SEQ ID NO: 1852 - protein, 11 aa, Artificial Sequence
  Description of Artificial Sequence: Synthetic peptide
  Seed: EKSRWSGSHQF (BRAF V600E)
EWSRWSGSHQI

SEQ ID NO: 1853 - protein, 11 aa, Artificial Sequence
  Description of Artificial Sequence: Synthetic peptide
  Seed: EKSRWSGSHQF (BRAF V600E)
EWSRWSGSHQK

SEQ ID NO: 1854 - protein, 11 aa, Artificial Sequence
  Description of Artificial Sequence: Synthetic peptide
  Seed: EKSRWSGSHQF (BRAF V600E)
EWSRWSGSHQL

SEQ ID NO: 1855 - protein, 11 aa, Artificial Sequence
  Description of Artificial Sequence: Synthetic peptide
  Seed: EKSRWSGSHQF (BRAF V600E)
EWSRWSGSHQM

SEQ ID NO: 1856 - protein, 11 aa, Artificial Sequence
  Description of Artificial Sequence: Synthetic peptide
  Seed: EKSRWSGSHQF (BRAF V600E)
EWSRWSGSHQV

SEQ ID NO: 1857 - protein, 11 aa, Artificial Sequence
  Description of Artificial Sequence: Synthetic peptide
  Seed: EKSRWSGSHQF (BRAF V600E)
EYSRWSGSHQF

SEQ ID NO: 1858 - protein, 11 aa, Artificial Sequence
  Description of Artificial Sequence: Synthetic peptide
  Seed: EKSRWSGSHQF (BRAF V600E)
EYSRWSGSHQI

SEQ ID NO: 1859 - protein, 11 aa, Artificial Sequence
  Description of Artificial Sequence: Synthetic peptide
  Seed: EKSRWSGSHQF (BRAF V600E)
EYSRWSGSHQK

SEQ ID NO: 1860 - protein, 11 aa, Artificial Sequence
  Description of Artificial Sequence: Synthetic peptide
  Seed: EKSRWSGSHQF (BRAF V600E)
EYSRWSGSHQL

SEQ ID NO: 1861 - protein, 11 aa, Artificial Sequence
  Description of Artificial Sequence: Synthetic peptide
  Seed: EKSRWSGSHQF (BRAF V600E)
EYSRWSGSHQM

SEQ ID NO: 1862 - protein, 11 aa, Artificial Sequence
  Description of Artificial Sequence: Synthetic peptide
  Seed: EKSRWSGSHQF (BRAF V600E)
EYSRWSGSHQV

SEQ ID NO: 1863 - protein, 10 aa, Artificial Sequence
  Description of Artificial Sequence: Synthetic peptide
  Seed: FGLATEKSRW (BRAF V600E)
FALATEKSRW

SEQ ID NO: 1864 - protein, 10 aa, Artificial Sequence
  Description of Artificial Sequence: Synthetic peptide
  Seed: FGLATEKSRW (BRAF V600E)
FCLATEKSRW

SEQ ID NO: 1865 - protein, 10 aa, Artificial Sequence
  Description of Artificial Sequence: Synthetic peptide
  Seed: FGLATEKSRW (BRAF V600E)
FILATEKSRW

SEQ ID NO: 1866 - protein, 10 aa, Artificial Sequence
  Description of Artificial Sequence: Synthetic peptide
  Seed: FGLATEKSRW (BRAF V600E)
FLLATEKSRW

SEQ ID NO: 1867 - protein, 10 aa, Artificial Sequence
  Description of Artificial Sequence: Synthetic peptide
  Seed: FGLATEKSRW (BRAF V600E)
FMLATEKSRW

SEQ ID NO: 1868 - protein, 10 aa, Artificial Sequence
  Description of Artificial Sequence: Synthetic peptide
  Seed: FGLATEKSRW (BRAF V600E)
FNLATEKSRW

SEQ ID NO: 1869 - protein, 10 aa, Artificial Sequence
  Description of Artificial Sequence: Synthetic peptide
  Seed: FGLATEKSRW (BRAF V600E)
FSLATEKSRF

SEQ ID NO: 1870 - protein, 10 aa, Artificial Sequence
  Description of Artificial Sequence: Synthetic peptide
  Seed: FGLATEKSRW (BRAF V600E)
FVLATEKSRW

SEQ ID NO: 1871 - protein, 11 aa, Artificial Sequence
  Description of Artificial Sequence: Synthetic peptide
  Seed: KIGDFGLATEK (BRAF V600E)
KAGDFGLATEK

SEQ ID NO: 1872 - protein, 11 aa, Artificial Sequence
  Description of Artificial Sequence: Synthetic peptide
  Seed: KIGDFGLATEK (BRAF V600E)
KAGDFGLATER

SEQ ID NO: 1873 - protein, 11 aa, Artificial Sequence
  Description of Artificial Sequence: Synthetic peptide
  Seed: KIGDFGLATEK (BRAF V600E)
KFGDFGLATEK

SEQ ID NO: 1874 - protein, 11 aa, Artificial Sequence
  Description of Artificial Sequence: Synthetic peptide
  Seed: KIGDFGLATEK (BRAF V600E)
KFGDFGLATER

SEQ ID NO: 1875 - protein, 11 aa, Artificial Sequence
  Description of Artificial Sequence: Synthetic peptide
  Seed: KIGDFGLATEK (BRAF V600E)
KGGDFGLATER

SEQ ID NO: 1876 - protein, 11 aa, Artificial Sequence
  Description of Artificial Sequence: Synthetic peptide
  Seed: KIGDFGLATEK (BRAF V600E)
KIGDFGLATER

SEQ ID NO: 1877 - protein, 11 aa, Artificial Sequence
  Description of Artificial Sequence: Synthetic peptide
  Seed: KIGDFGLATEK (BRAF V600E)
KLGDFGLATEK

SEQ ID NO: 1878 - protein, 11 aa, Artificial Sequence
  Description of Artificial Sequence: Synthetic peptide
  Seed: KIGDFGLATEK (BRAF V600E)
KLGDFGLATER

SEQ ID NO: 1879 - protein, 11 aa, Artificial Sequence
  Description of Artificial Sequence: Synthetic peptide
  Seed: KIGDFGLATEK (BRAF V600E)
KMGDFGLATEY

SEQ ID NO: 1880 - protein, 11 aa, Artificial Sequence
  Description of Artificial Sequence: Synthetic peptide
  Seed: KIGDFGLATEK (BRAF V600E)
KNGDFGLATER

SEQ ID NO: 1881 - protein, 11 aa, Artificial Sequence
  Description of Artificial Sequence: Synthetic peptide
  Seed: KIGDFGLATEK (BRAF V600E)
KQGDFGLATER

SEQ ID NO: 1882 - protein, 11 aa, Artificial Sequence
  Description of Artificial Sequence: Synthetic peptide
  Seed: KIGDFGLATEK (BRAF V600E)
KSGDFGLATEK

SEQ ID NO: 1883 - protein, 11 aa, Artificial Sequence
  Description of Artificial Sequence: Synthetic peptide
  Seed: KIGDFGLATEK (BRAF V600E)
KSGDFGLATER

SEQ ID NO: 1884 - protein, 11 aa, Artificial Sequence
  Description of Artificial Sequence: Synthetic peptide
  Seed: KIGDFGLATEK (BRAF V600E)
KTGDFGLATER

SEQ ID NO: 1885 - protein, 11 aa, Artificial Sequence
  Description of Artificial Sequence: Synthetic peptide
  Seed: KIGDFGLATEK (BRAF V600E)
KWGDFGLATEK

SEQ ID NO: 1886 - protein, 11 aa, Artificial Sequence
  Description of Artificial Sequence: Synthetic peptide
  Seed: KIGDFGLATEK (BRAF V600E)
KWGDFGLATER

SEQ ID NO: 1887 - protein, 11 aa, Artificial Sequence
  Description of Artificial Sequence: Synthetic peptide
  Seed: KIGDFGLATEK (BRAF V600E)
KYGDFGLATEK

SEQ ID NO: 1888 - protein, 11 aa, Artificial Sequence
  Description of Artificial Sequence: Synthetic peptide
  Seed: KIGDFGLATEK (BRAF V600E)
KYGDFGLATER

SEQ ID NO: 1889 - protein, 10 aa, Artificial Sequence
  Description of Artificial Sequence: Synthetic peptide
  Seed: DFGLATEKSR (BRAF V600E)
DAGLATEKSR

SEQ ID NO: 1890 - protein, 10 aa, Artificial Sequence
  Description of Artificial Sequence: Synthetic peptide
  Seed: DFGLATEKSR (BRAF V600E)
DGGLATEKSR

SEQ ID NO: 1891 - protein, 10 aa, Artificial Sequence
  Description of Artificial Sequence: Synthetic peptide
  Seed: DFGLATEKSR (BRAF V600E)
DIGLATEKSR

SEQ ID NO: 1892 - protein, 10 aa, Artificial Sequence
  Description of Artificial Sequence: Synthetic peptide
  Seed: DFGLATEKSR (BRAF V600E)
DLGLATEKSR

SEQ ID NO: 1893 - protein, 10 aa, Artificial Sequence
  Description of Artificial Sequence: Synthetic peptide
  Seed: DFGLATEKSR (BRAF V600E)
DMGLATEKSR

SEQ ID NO: 1894 - protein, 10 aa, Artificial Sequence
  Description of Artificial Sequence: Synthetic peptide
  Seed: DFGLATEKSR (BRAF V600E)
DQGLATEKSR

SEQ ID NO: 1895 - protein, 10 aa, Artificial Sequence
  Description of Artificial Sequence: Synthetic peptide
  Seed: DFGLATEKSR (BRAF V600E)
DSGLATEKSR

SEQ ID NO: 1896 - protein, 10 aa, Artificial Sequence
  Description of Artificial Sequence: Synthetic peptide
  Seed: DFGLATEKSR (BRAF V600E)
DTGLATEKSR

SEQ ID NO: 1897 - protein, 10 aa, Artificial Sequence
  Description of Artificial Sequence: Synthetic peptide
  Seed: DFGLATEKSR (BRAF V600E)
DVGLATEKSR

SEQ ID NO: 1898 - protein, 10 aa, Artificial Sequence
  Description of Artificial Sequence: Synthetic peptide
  Seed: DFGLATEKSR (BRAF V600E)
DWGLATEKSR

SEQ ID NO: 1899 - protein, 10 aa, Artificial Sequence
  Description of Artificial Sequence: Synthetic peptide
  Seed: DFGLATEKSR (BRAF V600E)
DYGLATEKSK

SEQ ID NO: 1900 - protein, 9 aa, Artificial Sequence
  Description of Artificial Sequence: Synthetic peptide
  Seed: FGLATEKSR (BRAF V600E)
FALATEKSA

SEQ ID NO: 1901 - protein, 9 aa, Artificial Sequence
  Description of Artificial Sequence: Synthetic peptide
  Seed: FGLATEKSR (BRAF V600E)
FALATEKSC

SEQ ID NO: 1902 - protein, 9 aa, Artificial Sequence
  Description of Artificial Sequence: Synthetic peptide
  Seed: FGLATEKSR (BRAF V600E)
FALATEKSF

SEQ ID NO: 1903 - protein, 9 aa, Artificial Sequence
  Description of Artificial Sequence: Synthetic peptide
  Seed: FGLATEKSR (BRAF V600E)
FALATEKSI

SEQ ID NO: 1904 - protein, 9 aa, Artificial Sequence
  Description of Artificial Sequence: Synthetic peptide
  Seed: FGLATEKSR (BRAF V600E)
FALATEKSK

SEQ ID NO: 1905 - protein, 9 aa, Artificial Sequence
  Description of Artificial Sequence: Synthetic peptide
  Seed: FGLATEKSR (BRAF V600E)
FALATEKSL

SEQ ID NO: 1906 - protein, 9 aa, Artificial Sequence
  Description of Artificial Sequence: Synthetic peptide
  Seed: FGLATEKSR (BRAF V600E)
FALATEKSM

SEQ ID NO: 1907 - protein, 9 aa, Artificial Sequence
  Description of Artificial Sequence: Synthetic peptide
  Seed: FGLATEKSR (BRAF V600E)
FALATEKSR

SEQ ID NO: 1908 - protein, 10 aa, Artificial Sequence
  Description of Artificial Sequence: Synthetic peptide
  Seed: FGLATEKSRW (BRAF V600E)
FALATEKSRF

SEQ ID NO: 1909 - protein, 9 aa, Artificial Sequence
  Description of Artificial Sequence: Synthetic peptide
  Seed: FGLATEKSR (BRAF V600E)
FALATEKSV

SEQ ID NO: 1910 - protein, 9 aa, Artificial Sequence
  Description of Artificial Sequence: Synthetic peptide
  Seed: FGLATEKSR (BRAF V600E)
FALATEKSY

SEQ ID NO: 1911 - protein, 9 aa, Artificial Sequence
  Description of Artificial Sequence: Synthetic peptide
  Seed: FGLATEKSR (BRAF V600E)
FCLATEKSL

SEQ ID NO: 1912 - protein, 9 aa, Artificial Sequence
  Description of Artificial Sequence: Synthetic peptide
  Seed: FGLATEKSR (BRAF V600E)
FCLATEKSM

SEQ ID NO: 1913 - protein, 9 aa, Artificial Sequence
  Description of Artificial Sequence: Synthetic peptide
  Seed: FGLATEKSR (BRAF V600E)
FDLATEKSK

SEQ ID NO: 1914 - protein, 9 aa, Artificial Sequence
  Description of Artificial Sequence: Synthetic peptide
  Seed: FGLATEKSR (BRAF V600E)
FDLATEKSR

SEQ ID NO: 1915 - protein, 10 aa, Artificial Sequence
  Description of Artificial Sequence: Synthetic peptide
  Seed: FGLATEKSRW (BRAF V600E)
FDLATEKSRW

SEQ ID NO: 1916 - protein, 10 aa, Artificial Sequence
  Description of Artificial Sequence: Synthetic peptide
  Seed: FGLATEKSRW (BRAF V600E)
FELATEKSRW

SEQ ID NO: 1917 - protein, 9 aa, Artificial Sequence
  Description of Artificial Sequence: Synthetic peptide
  Seed: FGLATEKSR (BRAF V600E)
FFLATEKSR

SEQ ID NO: 1918 - protein, 10 aa, Artificial Sequence
  Description of Artificial Sequence: Synthetic peptide
  Seed: FGLATEKSRW (BRAF V600E)
FFLATEKSRW

SEQ ID NO: 1919 - protein, 9 aa, Artificial Sequence
  Description of Artificial Sequence: Synthetic peptide
  Seed: FGLATEKSR (BRAF V600E)
FGLATEKSF

SEQ ID NO: 1920 - protein, 9 aa, Artificial Sequence
  Description of Artificial Sequence: Synthetic peptide
  Seed: FGLATEKSR (BRAF V600E)
FGLATEKSK

SEQ ID NO: 1921 - protein, 9 aa, Artificial Sequence
  Description of Artificial Sequence: Synthetic peptide
  Seed: FGLATEKSR (BRAF V600E)
FGLATEKSL

SEQ ID NO: 1922 - protein, 9 aa, Artificial Sequence
  Description of Artificial Sequence: Synthetic peptide
  Seed: FGLATEKSR (BRAF V600E)
FGLATEKSM

SEQ ID NO: 1923 - protein, 9 aa, Artificial Sequence
  Description of Artificial Sequence: Synthetic peptide
  Seed: FGLATEKSR (BRAF V600E)
FILATEKSF

SEQ ID NO: 1924 - protein, 9 aa, Artificial Sequence
  Description of Artificial Sequence: Synthetic peptide
  Seed: FGLATEKSR (BRAF V600E)
FILATEKSI

SEQ ID NO: 1925 - protein, 9 aa, Artificial Sequence
  Description of Artificial Sequence: Synthetic peptide
  Seed: FGLATEKSR (BRAF V600E)
FILATEKSK

SEQ ID NO: 1926 - protein, 9 aa, Artificial Sequence
  Description of Artificial Sequence: Synthetic peptide
  Seed: FGLATEKSR (BRAF V600E)
FILATEKSL

SEQ ID NO: 1927 - protein, 9 aa, Artificial Sequence
  Description of Artificial Sequence: Synthetic peptide
  Seed: FGLATEKSR (BRAF V600E)
FILATEKSM

SEQ ID NO: 1928 - protein, 9 aa, Artificial Sequence
  Description of Artificial Sequence: Synthetic peptide
  Seed: FGLATEKSR (BRAF V600E)
FILATEKSR

SEQ ID NO: 1929 - protein, 9 aa, Artificial Sequence
  Description of Artificial Sequence: Synthetic peptide
  Seed: FGLATEKSR (BRAF V600E)
FLLATEKSL

SEQ ID NO: 1930 - protein, 9 aa, Artificial Sequence
  Description of Artificial Sequence: Synthetic peptide
  Seed: FGLATEKSR (BRAF V600E)
FLLATEKSM

SEQ ID NO: 1931 - protein, 9 aa, Artificial Sequence
  Description of Artificial Sequence: Synthetic peptide
  Seed: FGLATEKSR (BRAF V600E)
FLLATEKSR

SEQ ID NO: 1932 - protein, 9 aa, Artificial Sequence
  Description of Artificial Sequence: Synthetic peptide
  Seed: FGLATEKSR (BRAF V600E)
FMLATEKSL

SEQ ID NO: 1933 - protein, 9 aa, Artificial Sequence
  Description of Artificial Sequence: Synthetic peptide
  Seed: FGLATEKSR (BRAF V600E)
FMLATEKSM

SEQ ID NO: 1934 - protein, 9 aa, Artificial Sequence
  Description of Artificial Sequence: Synthetic peptide
  Seed: FGLATEKSR (BRAF V600E)
FMLATEKSR

SEQ ID NO: 1935 - protein, 9 aa, Artificial Sequence
  Description of Artificial Sequence: Synthetic peptide
  Seed: FGLATEKSR (BRAF V600E)
FNLATEKSR

SEQ ID NO: 1936 - protein, 9 aa, Artificial Sequence
  Description of Artificial Sequence: Synthetic peptide
  Seed: FGLATEKSR (BRAF V600E)
FPLATEKSR

SEQ ID NO: 1937 - protein, 10 aa, Artificial Sequence
  Description of Artificial Sequence: Synthetic peptide
  Seed: FGLATEKSRW (BRAF V600E)
FPLATEKSRW

SEQ ID NO: 1938 - protein, 9 aa, Artificial Sequence
  Description of Artificial Sequence: Synthetic peptide
  Seed: FGLATEKSR (BRAF V600E)
FQLATEKSL

SEQ ID NO: 1939 - protein, 9 aa, Artificial Sequence
  Description of Artificial Sequence: Synthetic peptide
  Seed: FGLATEKSR (BRAF V600E)
FQLATEKSM

SEQ ID NO: 1940 - protein, 9 aa, Artificial Sequence
  Description of Artificial Sequence: Synthetic peptide
  Seed: FGLATEKSR (BRAF V600E)
FQLATEKSR

SEQ ID NO: 1941 - protein, 10 aa, Artificial Sequence
  Description of Artificial Sequence: Synthetic peptide
  Seed: FGLATEKSRW (BRAF V600E)
FQLATEKSRW

SEQ ID NO: 1942 - protein, 9 aa, Artificial Sequence
  Description of Artificial Sequence: Synthetic peptide
  Seed: FGLATEKSR (BRAF V600E)
FSLATEKSF

SEQ ID NO: 1943 - protein, 9 aa, Artificial Sequence
  Description of Artificial Sequence: Synthetic peptide
  Seed: FGLATEKSR (BRAF V600E)
FSLATEKSI

SEQ ID NO: 1944 - protein, 9 aa, Artificial Sequence
  Description of Artificial Sequence: Synthetic peptide
  Seed: FGLATEKSR (BRAF V600E)
FSLATEKSK

SEQ ID NO: 1945 - protein, 9 aa, Artificial Sequence
  Description of Artificial Sequence: Synthetic peptide
  Seed: FGLATEKSR (BRAF V600E)
FSLATEKSL

SEQ ID NO: 1946 - protein, 9 aa, Artificial Sequence
  Description of Artificial Sequence: Synthetic peptide
  Seed: FGLATEKSR (BRAF V600E)
FSLATEKSM

SEQ ID NO: 1947 - protein, 9 aa, Artificial Sequence
  Description of Artificial Sequence: Synthetic peptide
  Seed: FGLATEKSR (BRAF V600E)
FSLATEKSR

SEQ ID NO: 1948 - protein, 9 aa, Artificial Sequence
  Description of Artificial Sequence: Synthetic peptide
  Seed: FGLATEKSR (BRAF V600E)
FSLATEKSV

SEQ ID NO: 1949 - protein, 9 aa, Artificial Sequence
  Description of Artificial Sequence: Synthetic peptide
  Seed: FGLATEKSR (BRAF V600E)
FSLATEKSY

SEQ ID NO: 1950 - protein, 9 aa, Artificial Sequence
  Description of Artificial Sequence: Synthetic peptide
  Seed: FGLATEKSR (BRAF V600E)
FTLATEKSF

SEQ ID NO: 1951 - protein, 9 aa, Artificial Sequence
  Description of Artificial Sequence: Synthetic peptide
  Seed: FGLATEKSR (BRAF V600E)
FTLATEKSI

SEQ ID NO: 1952 - protein, 9 aa, Artificial Sequence
  Description of Artificial Sequence: Synthetic peptide
  Seed: FGLATEKSR (BRAF V600E)
FTLATEKSK

SEQ ID NO: 1953 - protein, 9 aa, Artificial Sequence
  Description of Artificial Sequence: Synthetic peptide
  Seed: FGLATEKSR (BRAF V600E)
FTLATEKSL

SEQ ID NO: 1954 - protein, 9 aa, Artificial Sequence
  Description of Artificial Sequence: Synthetic peptide
  Seed: FGLATEKSR (BRAF V600E)
FTLATEKSM

SEQ ID NO: 1955 - protein, 10 aa, Artificial Sequence
  Description of Artificial Sequence: Synthetic peptide
  Seed: FGLATEKSRW (BRAF V600E)
FTLATEKSRF

SEQ ID NO: 1956 - protein, 9 aa, Artificial Sequence
  Description of Artificial Sequence: Synthetic peptide
  Seed: FGLATEKSR (BRAF V600E)
FTLATEKSV

SEQ ID NO: 1957 - protein, 9 aa, Artificial Sequence
  Description of Artificial Sequence: Synthetic peptide
  Seed: FGLATEKSR (BRAF V600E)
FVLATEKSF

SEQ ID NO: 1958 - protein, 9 aa, Artificial Sequence
  Description of Artificial Sequence: Synthetic peptide
  Seed: FGLATEKSR (BRAF V600E)
FVLATEKSI

SEQ ID NO: 1959 - protein, 9 aa, Artificial Sequence
  Description of Artificial Sequence: Synthetic peptide
  Seed: FGLATEKSR (BRAF V600E)
FVLATEKSK

SEQ ID NO: 1960 - protein, 9 aa, Artificial Sequence
  Description of Artificial Sequence: Synthetic peptide
  Seed: FGLATEKSR (BRAF V600E)
FVLATEKSL

SEQ ID NO: 1961 - protein, 9 aa, Artificial Sequence
  Description of Artificial Sequence: Synthetic peptide
  Seed: FGLATEKSR (BRAF V600E)
FVLATEKSM

SEQ ID NO: 1962 - protein, 9 aa, Artificial Sequence
  Description of Artificial Sequence: Synthetic peptide
  Seed: FGLATEKSR (BRAF V600E)
FVLATEKSR

SEQ ID NO: 1963 - protein, 9 aa, Artificial Sequence
  Description of Artificial Sequence: Synthetic peptide
  Seed: FGLATEKSR (BRAF V600E)
FVLATEKSV

SEQ ID NO: 1964 - protein, 9 aa, Artificial Sequence
  Description of Artificial Sequence: Synthetic peptide
  Seed: FGLATEKSR (BRAF V600E)
FWLATEKSR

SEQ ID NO: 1965 - protein, 9 aa, Artificial Sequence
  Description of Artificial Sequence: Synthetic peptide
  Seed: FGLATEKSR (BRAF V600E)
FYLATEKSK

SEQ ID NO: 1966 - protein, 9 aa, Artificial Sequence
  Description of Artificial Sequence: Synthetic peptide
  Seed: FGLATEKSR (BRAF V600E)
FYLATEKSR

SEQ ID NO: 1967 - protein, 9 aa, Artificial Sequence
  Description of Artificial Sequence: Synthetic peptide
  Seed: GLATEKSRW (BRAF V600E)
GAATEKSRF

SEQ ID NO: 1968 - protein, 9 aa, Artificial Sequence
  Description of Artificial Sequence: Synthetic peptide
  Seed: GLATEKSRW (BRAF V600E)
GAATEKSRW

SEQ ID NO: 1969 - protein, 9 aa, Artificial Sequence
  Description of Artificial Sequence: Synthetic peptide
  Seed: GDFGLATEK (BRAF V600E)
GAFGLATEA

SEQ ID NO: 1970 - protein, 9 aa, Artificial Sequence
  Description of Artificial Sequence: Synthetic peptide
  Seed: GDFGLATEK (BRAF V600E)
GAFGLATEC

SEQ ID NO: 1971 - protein, 9 aa, Artificial Sequence
  Description of Artificial Sequence: Synthetic peptide
  Seed: GDFGLATEK (BRAF V600E)
GAFGLATEH

SEQ ID NO: 1972 - protein, 9 aa, Artificial Sequence
  Description of Artificial Sequence: Synthetic peptide
  Seed: GDFGLATEK (BRAF V600E)
GAFGLATEI

SEQ ID NO: 1973 - protein, 9 aa, Artificial Sequence
  Description of Artificial Sequence: Synthetic peptide
  Seed: GDFGLATEK (BRAF V600E)
GAFGLATEK

SEQ ID NO: 1974 - protein, 9 aa, Artificial Sequence
  Description of Artificial Sequence: Synthetic peptide
  Seed: GDFGLATEK (BRAF V600E)
GAFGLATEM

SEQ ID NO: 1975 - protein, 9 aa, Artificial Sequence
  Description of Artificial Sequence: Synthetic peptide
  Seed: GDFGLATEK (BRAF V600E)
GAFGLATER

SEQ ID NO: 1976 - protein, 9 aa, Artificial Sequence
  Description of Artificial Sequence: Synthetic peptide
  Seed: GDFGLATEK (BRAF V600E)
GAFGLATEV

SEQ ID NO: 1977 - protein, 9 aa, Artificial Sequence
  Description of Artificial Sequence: Synthetic peptide
  Seed: GDFGLATEK (BRAF V600E)
GAFGLATEW

SEQ ID NO: 1978 - protein, 9 aa, Artificial Sequence
  Description of Artificial Sequence: Synthetic peptide
  Seed: GDFGLATEK (BRAF V600E)
GAFGLATEY

SEQ ID NO: 1979 - protein, 9 aa, Artificial Sequence
  Description of Artificial Sequence: Synthetic peptide
  Seed: GLATEKSRW (BRAF V600E)
GCATEKSRW

SEQ ID NO: 1980 - protein, 9 aa, Artificial Sequence
  Description of Artificial Sequence: Synthetic peptide
  Seed: GDFGLATEK (BRAF V600E)
GCFGLATEF

SEQ ID NO: 1981 - protein, 9 aa, Artificial Sequence
  Description of Artificial Sequence: Synthetic peptide
  Seed: GDFGLATEK (BRAF V600E)
GCFGLATEK

SEQ ID NO: 1982 - protein, 9 aa, Artificial Sequence
  Description of Artificial Sequence: Synthetic peptide
  Seed: GDFGLATEK (BRAF V600E)
GCFGLATEL

SEQ ID NO: 1983 - protein, 9 aa, Artificial Sequence
  Description of Artificial Sequence: Synthetic peptide
  Seed: GDFGLATEK (BRAF V600E)
GCFGLATEM

SEQ ID NO: 1984 - protein, 9 aa, Artificial Sequence
  Description of Artificial Sequence: Synthetic peptide
  Seed: GDFGLATEK (BRAF V600E)
GCFGLATER

SEQ ID NO: 1985 - protein, 9 aa, Artificial Sequence
  Description of Artificial Sequence: Synthetic peptide
  Seed: GDFGLATEK (BRAF V600E)
GCFGLATEY

SEQ ID NO: 1986 - protein, 9 aa, Artificial Sequence
  Description of Artificial Sequence: Synthetic peptide
  Seed: GDFGLATEK (BRAF V600E)
GDFGLATEF

SEQ ID NO: 1987 - protein, 9 aa, Artificial Sequence
  Description of Artificial Sequence: Synthetic peptide
  Seed: GDFGLATEK (BRAF V600E)
GDFGLATEL

SEQ ID NO: 1988 - protein, 9 aa, Artificial Sequence
  Description of Artificial Sequence: Synthetic peptide
  Seed: GDFGLATEK (BRAF V600E)
GDFGLATEM

SEQ ID NO: 1989 - protein, 9 aa, Artificial Sequence
  Description of Artificial Sequence: Synthetic peptide
  Seed: GDFGLATEK (BRAF V600E)
GDFGLATER

SEQ ID NO: 1990 - protein, 9 aa, Artificial Sequence
  Description of Artificial Sequence: Synthetic peptide
  Seed: GDFGLATEK (BRAF V600E)
GDFGLATEW

SEQ ID NO: 1991 - protein, 9 aa, Artificial Sequence
  Description of Artificial Sequence: Synthetic peptide
  Seed: GDFGLATEK (BRAF V600E)
GDFGLATEY

SEQ ID NO: 1992 - protein, 9 aa, Artificial Sequence
  Description of Artificial Sequence: Synthetic peptide
  Seed: GLATEKSRW (BRAF V600E)
GEATEKSRF

SEQ ID NO: 1993 - protein, 9 aa, Artificial Sequence
  Description of Artificial Sequence: Synthetic peptide
  Seed: GDFGLATEK (BRAF V600E)
GEFGLATEF

SEQ ID NO: 1994 - protein, 9 aa, Artificial Sequence
  Description of Artificial Sequence: Synthetic peptide
  Seed: GDFGLATEK (BRAF V600E)
GEFGLATEH

SEQ ID NO: 1995 - protein, 9 aa, Artificial Sequence
  Description of Artificial Sequence: Synthetic peptide
  Seed: GDFGLATEK (BRAF V600E)
GEFGLATEI

SEQ ID NO: 1996 - protein, 9 aa, Artificial Sequence
  Description of Artificial Sequence: Synthetic peptide
  Seed: GDFGLATEK (BRAF V600E)
GEFGLATEK

SEQ ID NO: 1997 - protein, 9 aa, Artificial Sequence
  Description of Artificial Sequence: Synthetic peptide
  Seed: GDFGLATEK (BRAF V600E)
GEFGLATEL

SEQ ID NO: 1998 - protein, 9 aa, Artificial Sequence
  Description of Artificial Sequence: Synthetic peptide
  Seed: GDFGLATEK (BRAF V600E)
GEFGLATEM

SEQ ID NO: 1999 - protein, 9 aa, Artificial Sequence
  Description of Artificial Sequence: Synthetic peptide
  Seed: GDFGLATEK (BRAF V600E)
GEFGLATER

SEQ ID NO: 2000 - protein, 9 aa, Artificial Sequence
  Description of Artificial Sequence: Synthetic peptide
  Seed: GDFGLATEK (BRAF V600E)
GEFGLATEV

SEQ ID NO: 2001 - protein, 9 aa, Artificial Sequence
  Description of Artificial Sequence: Synthetic peptide
  Seed: GDFGLATEK (BRAF V600E)
GEFGLATEW

SEQ ID NO: 2002 - protein, 9 aa, Artificial Sequence
  Description of Artificial Sequence: Synthetic peptide
  Seed: GDFGLATEK (BRAF V600E)
GEFGLATEY

SEQ ID NO: 2003 - protein, 9 aa, Artificial Sequence
  Description of Artificial Sequence: Synthetic peptide
  Seed: GDFGLATEK (BRAF V600E)
GFFGLATEK

SEQ ID NO: 2004 - protein, 9 aa, Artificial Sequence
  Description of Artificial Sequence: Synthetic peptide
  Seed: GLATEKSRW (BRAF V600E)
GGATEKSRW

SEQ ID NO: 2005 - protein, 9 aa, Artificial Sequence
  Description of Artificial Sequence: Synthetic peptide
  Seed: GDFGLATEK (BRAF V600E)
GGFGLATEF

SEQ ID NO: 2006 - protein, 9 aa, Artificial Sequence
  Description of Artificial Sequence: Synthetic peptide
  Seed: GDFGLATEK (BRAF V600E)
GGFGLATEK

SEQ ID NO: 2007 - protein, 9 aa, Artificial Sequence
  Description of Artificial Sequence: Synthetic peptide
  Seed: GDFGLATEK (BRAF V600E)
GGFGLATEL

SEQ ID NO: 2008 - protein, 9 aa, Artificial Sequence
  Description of Artificial Sequence: Synthetic peptide
  Seed: GDFGLATEK (BRAF V600E)
GGFGLATEM

SEQ ID NO: 2009 - protein, 9 aa, Artificial Sequence
  Description of Artificial Sequence: Synthetic peptide
  Seed: GDFGLATEK (BRAF V600E)
GGFGLATER

SEQ ID NO: 2010 - protein, 9 aa, Artificial Sequence
  Description of Artificial Sequence: Synthetic peptide
  Seed: GDFGLATEK (BRAF V600E)
GHFGLATEY

SEQ ID NO: 2011 - protein, 9 aa, Artificial Sequence
  Description of Artificial Sequence: Synthetic peptide
  Seed: GLATEKSRW (BRAF V600E)
GIATEKSRF

SEQ ID NO: 2012 - protein, 9 aa, Artificial Sequence
  Description of Artificial Sequence: Synthetic peptide
  Seed: GLATEKSRW (BRAF V600E)
GIATEKSRL

SEQ ID NO: 2013 - protein, 9 aa, Artificial Sequence
  Description of Artificial Sequence: Synthetic peptide
  Seed: GLATEKSRW (BRAF V600E)
GIATEKSRW

SEQ ID NO: 2014 - protein, 9 aa, Artificial Sequence
  Description of Artificial Sequence: Synthetic peptide
  Seed: GDFGLATEK (BRAF V600E)
GIFGLATEF

SEQ ID NO: 2015 - protein, 9 aa, Artificial Sequence
  Description of Artificial Sequence: Synthetic peptide
  Seed: GDFGLATEK (BRAF V600E)
GIFGLATEH

SEQ ID NO: 2016 - protein, 9 aa, Artificial Sequence
  Description of Artificial Sequence: Synthetic peptide
  Seed: GDFGLATEK (BRAF V600E)
GIFGLATEI

SEQ ID NO: 2017 - protein, 9 aa, Artificial Sequence
  Description of Artificial Sequence: Synthetic peptide
  Seed: GDFGLATEK (BRAF V600E)
GIFGLATEK

SEQ ID NO: 2018 - protein, 9 aa, Artificial Sequence
  Description of Artificial Sequence: Synthetic peptide
  Seed: GDFGLATEK (BRAF V600E)
GIFGLATEL

SEQ ID NO: 2019 - protein, 9 aa, Artificial Sequence
  Description of Artificial Sequence: Synthetic peptide
  Seed: GDFGLATEK (BRAF V600E)
GIFGLATEM

SEQ ID NO: 2020 - protein, 9 aa, Artificial Sequence
  Description of Artificial Sequence: Synthetic peptide
  Seed: GDFGLATEK (BRAF V600E)
GIFGLATER

SEQ ID NO: 2021 - protein, 9 aa, Artificial Sequence
  Description of Artificial Sequence: Synthetic peptide
  Seed: GDFGLATEK (BRAF V600E)
GIFGLATEV

SEQ ID NO: 2022 - protein, 9 aa, Artificial Sequence
  Description of Artificial Sequence: Synthetic peptide
  Seed: GDFGLATEK (BRAF V600E)
GIFGLATEY

SEQ ID NO: 2023 - protein, 9 aa, Artificial Sequence
  Description of Artificial Sequence: Synthetic peptide
  Seed: GDFGLATEK (BRAF V600E)
GKFGLATEF

SEQ ID NO: 2024 - protein, 9 aa, Artificial Sequence
  Description of Artificial Sequence: Synthetic peptide
  Seed: GDFGLATEK (BRAF V600E)
GKFGLATEY

SEQ ID NO: 2025 - protein, 9 aa, Artificial Sequence
  Description of Artificial Sequence: Synthetic peptide
  Seed: GLATEKSRW (BRAF V600E)
GLATEKSRF

SEQ ID NO: 2026 - protein, 9 aa, Artificial Sequence
  Description of Artificial Sequence: Synthetic peptide
  Seed: GLATEKSRW (BRAF V600E)
GLATEKSRI

SEQ ID NO: 2027 - protein, 9 aa, Artificial Sequence
  Description of Artificial Sequence: Synthetic peptide
  Seed: GLATEKSRW (BRAF V600E)
GLATEKSRL

SEQ ID NO: 2028 - protein, 9 aa, Artificial Sequence
  Description of Artificial Sequence: Synthetic peptide
  Seed: GDFGLATEK (BRAF V600E)
GLFGLATEF

SEQ ID NO: 2029 - protein, 9 aa, Artificial Sequence
  Description of Artificial Sequence: Synthetic peptide
  Seed: GDFGLATEK (BRAF V600E)
GLFGLATEK

SEQ ID NO: 2030 - protein, 9 aa, Artificial Sequence
  Description of Artificial Sequence: Synthetic peptide
  Seed: GDFGLATEK (BRAF V600E)
GLFGLATEL

SEQ ID NO: 2031 - protein, 9 aa, Artificial Sequence
  Description of Artificial Sequence: Synthetic peptide
  Seed: GDFGLATEK (BRAF V600E)
GLFGLATEM

SEQ ID NO: 2032 - protein, 9 aa, Artificial Sequence
  Description of Artificial Sequence: Synthetic peptide
  Seed: GDFGLATEK (BRAF V600E)
GLFGLATER

SEQ ID NO: 2033 - protein, 9 aa, Artificial Sequence
  Description of Artificial Sequence: Synthetic peptide
  Seed: GDFGLATEK (BRAF V600E)
GLFGLATEY

SEQ ID NO: 2034 - protein, 9 aa, Artificial Sequence
  Description of Artificial Sequence: Synthetic peptide
  Seed: GLATEKSRW (BRAF V600E)
GMATEKSRF

SEQ ID NO: 2035 - protein, 9 aa, Artificial Sequence
  Description of Artificial Sequence: Synthetic peptide
  Seed: GLATEKSRW (BRAF V600E)
GMATEKSRI

SEQ ID NO: 2036 - protein, 9 aa, Artificial Sequence
  Description of Artificial Sequence: Synthetic peptide
  Seed: GLATEKSRW (BRAF V600E)
GMATEKSRL

SEQ ID NO: 2037 - protein, 9 aa, Artificial Sequence
  Description of Artificial Sequence: Synthetic peptide
  Seed: GLATEKSRW (BRAF V600E)
GMATEKSRW

SEQ ID NO: 2038 - protein, 9 aa, Artificial Sequence
  Description of Artificial Sequence: Synthetic peptide
  Seed: GDFGLATEK (BRAF V600E)
GMFGLATEF

SEQ ID NO: 2039 - protein, 9 aa, Artificial Sequence
  Description of Artificial Sequence: Synthetic peptide
  Seed: GDFGLATEK (BRAF V600E)
GMFGLATEK

SEQ ID NO: 2040 - protein, 9 aa, Artificial Sequence
  Description of Artificial Sequence: Synthetic peptide
  Seed: GDFGLATEK (BRAF V600E)
GMFGLATEL

SEQ ID NO: 2041 - protein, 9 aa, Artificial Sequence
  Description of Artificial Sequence: Synthetic peptide
  Seed: GDFGLATEK (BRAF V600E)
GMFGLATEM

SEQ ID NO: 2042 - protein, 9 aa, Artificial Sequence
  Description of Artificial Sequence: Synthetic peptide
  Seed: GDFGLATEK (BRAF V600E)
GMFGLATER

SEQ ID NO: 2043 - protein, 9 aa, Artificial Sequence
  Description of Artificial Sequence: Synthetic peptide
  Seed: GDFGLATEK (BRAF V600E)
GMFGLATEY

SEQ ID NO: 2044 - protein, 9 aa, Artificial Sequence
  Description of Artificial Sequence: Synthetic peptide
  Seed: GLATEKSRW (BRAF V600E)
GNATEKSRW

SEQ ID NO: 2045 - protein, 9 aa, Artificial Sequence
  Description of Artificial Sequence: Synthetic peptide
  Seed: GDFGLATEK (BRAF V600E)
GNFGLATEF

SEQ ID NO: 2046 - protein, 9 aa, Artificial Sequence
  Description of Artificial Sequence: Synthetic peptide
  Seed: GDFGLATEK (BRAF V600E)
GNFGLATEK

SEQ ID NO: 2047 - protein, 9 aa, Artificial Sequence
  Description of Artificial Sequence: Synthetic peptide
  Seed: GDFGLATEK (BRAF V600E)
GNFGLATEL

SEQ ID NO: 2048 - protein, 9 aa, Artificial Sequence
  Description of Artificial Sequence: Synthetic peptide
  Seed: GDFGLATEK (BRAF V600E)
GNFGLATER

SEQ ID NO: 2049 - protein, 9 aa, Artificial Sequence
  Description of Artificial Sequence: Synthetic peptide
  Seed: GDFGLATEK (BRAF V600E)
GNFGLATEY

SEQ ID NO: 2050 - protein, 9 aa, Artificial Sequence
  Description of Artificial Sequence: Synthetic peptide
  Seed: GLATEKSRW (BRAF V600E)
GPATEKSRW

SEQ ID NO: 2051 - protein, 9 aa, Artificial Sequence
  Description of Artificial Sequence: Synthetic peptide
  Seed: GDFGLATEK (BRAF V600E)
GPFGLATEK

SEQ ID NO: 2052 - protein, 9 aa, Artificial Sequence
  Description of Artificial Sequence: Synthetic peptide
  Seed: GDFGLATEK (BRAF V600E)
GPFGLATEL

SEQ ID NO: 2053 - protein, 9 aa, Artificial Sequence
  Description of Artificial Sequence: Synthetic peptide
  Seed: GDFGLATEK (BRAF V600E)
GPFGLATEM

SEQ ID NO: 2054 - protein, 9 aa, Artificial Sequence
  Description of Artificial Sequence: Synthetic peptide
  Seed: GDFGLATEK (BRAF V600E)
GPFGLATER

SEQ ID NO: 2055 - protein, 9 aa, Artificial Sequence
  Description of Artificial Sequence: Synthetic peptide
  Seed: GLATEKSRW (BRAF V600E)
GQATEKSRF

SEQ ID NO: 2056 - protein, 9 aa, Artificial Sequence
  Description of Artificial Sequence: Synthetic peptide
  Seed: GLATEKSRW (BRAF V600E)
GQATEKSRI

SEQ ID NO: 2057 - protein, 9 aa, Artificial Sequence
  Description of Artificial Sequence: Synthetic peptide
  Seed: GLATEKSRW (BRAF V600E)
GQATEKSRM

SEQ ID NO: 2058 - protein, 9 aa, Artificial Sequence
  Description of Artificial Sequence: Synthetic peptide
  Seed: GLATEKSRW (BRAF V600E)
GQATEKSRV

SEQ ID NO: 2059 - protein, 9 aa, Artificial Sequence
  Description of Artificial Sequence: Synthetic peptide
  Seed: GLATEKSRW (BRAF V600E)
GQATEKSRW

SEQ ID NO: 2060 - protein, 9 aa, Artificial Sequence
  Description of Artificial Sequence: Synthetic peptide
  Seed: GLATEKSRW (BRAF V600E)
GQATEKSRY

SEQ ID NO: 2061 - protein, 9 aa, Artificial Sequence
  Description of Artificial Sequence: Synthetic peptide
  Seed: GDFGLATEK (BRAF V600E)
GQFGLATEF

SEQ ID NO: 2062 - protein, 9 aa, Artificial Sequence
  Description of Artificial Sequence: Synthetic peptide
  Seed: GDFGLATEK (BRAF V600E)
GQFGLATEH

SEQ ID NO: 2063 - protein, 9 aa, Artificial Sequence
  Description of Artificial Sequence: Synthetic peptide
  Seed: GDFGLATEK (BRAF V600E)
GQFGLATEI

SEQ ID NO: 2064 - protein, 9 aa, Artificial Sequence
  Description of Artificial Sequence: Synthetic peptide
  Seed: GDFGLATEK (BRAF V600E)
GQFGLATEK

SEQ ID NO: 2065 - protein, 9 aa, Artificial Sequence
  Description of Artificial Sequence: Synthetic peptide
  Seed: GDFGLATEK (BRAF V600E)
GQFGLATEL

SEQ ID NO: 2066 - protein, 9 aa, Artificial Sequence
  Description of Artificial Sequence: Synthetic peptide
  Seed: GDFGLATEK (BRAF V600E)
GQFGLATEM

SEQ ID NO: 2067 - protein, 9 aa, Artificial Sequence
  Description of Artificial Sequence: Synthetic peptide
  Seed: GDFGLATEK (BRAF V600E)
GQFGLATER

SEQ ID NO: 2068 - protein, 9 aa, Artificial Sequence
  Description of Artificial Sequence: Synthetic peptide
  Seed: GDFGLATEK (BRAF V600E)
GQFGLATEV

SEQ ID NO: 2069 - protein, 9 aa, Artificial Sequence
  Description of Artificial Sequence: Synthetic peptide
  Seed: GDFGLATEK (BRAF V600E)
GQFGLATEW

SEQ ID NO: 2070 - protein, 9 aa, Artificial Sequence
  Description of Artificial Sequence: Synthetic peptide
  Seed: GDFGLATEK (BRAF V600E)
GQFGLATEY

SEQ ID NO: 2071 - protein, 9 aa, Artificial Sequence
  Description of Artificial Sequence: Synthetic peptide
  Seed: GDFGLATEK (BRAF V600E)
GRFGLATEF

SEQ ID NO: 2072 - protein, 9 aa, Artificial Sequence
  Description of Artificial Sequence: Synthetic peptide
  Seed: GDFGLATEK (BRAF V600E)
GRFGLATEL

SEQ ID NO: 2073 - protein, 9 aa, Artificial Sequence
  Description of Artificial Sequence: Synthetic peptide
  Seed: GDFGLATEK (BRAF V600E)
GRFGLATEM

SEQ ID NO: 2074 - protein, 9 aa, Artificial Sequence
  Description of Artificial Sequence: Synthetic peptide
  Seed: GDFGLATEK (BRAF V600E)
GRFGLATEW

SEQ ID NO: 2075 - protein, 9 aa, Artificial Sequence
  Description of Artificial Sequence: Synthetic peptide
  Seed: GDFGLATEK (BRAF V600E)
GRFGLATEY

SEQ ID NO: 2076 - protein, 9 aa, Artificial Sequence
  Description of Artificial Sequence: Synthetic peptide
  Seed: GLATEKSRW (BRAF V600E)
GSATEKSRF

SEQ ID NO: 2077 - protein, 9 aa, Artificial Sequence
  Description of Artificial Sequence: Synthetic peptide
  Seed: GDFGLATEK (BRAF V600E)
GSFGLATEF

SEQ ID NO: 2078 - protein, 9 aa, Artificial Sequence
  Description of Artificial Sequence: Synthetic peptide
  Seed: GDFGLATEK (BRAF V600E)
GSFGLATEH

SEQ ID NO: 2079 - protein, 9 aa, Artificial Sequence
  Description of Artificial Sequence: Synthetic peptide
  Seed: GDFGLATEK (BRAF V600E)
GSFGLATEI

SEQ ID NO: 2080 - protein, 9 aa, Artificial Sequence
  Description of Artificial Sequence: Synthetic peptide
  Seed: GDFGLATEK (BRAF V600E)
GSFGLATEK

SEQ ID NO: 2081 - protein, 9 aa, Artificial Sequence
  Description of Artificial Sequence: Synthetic peptide
  Seed: GDFGLATEK (BRAF V600E)
GSFGLATEL

SEQ ID NO: 2082 - protein, 9 aa, Artificial Sequence
  Description of Artificial Sequence: Synthetic peptide
  Seed: GDFGLATEK (BRAF V600E)
GSFGLATEM

SEQ ID NO: 2083 - protein, 9 aa, Artificial Sequence
  Description of Artificial Sequence: Synthetic peptide
  Seed: GDFGLATEK (BRAF V600E)
GSFGLATER

SEQ ID NO: 2084 - protein, 9 aa, Artificial Sequence
  Description of Artificial Sequence: Synthetic peptide
  Seed: GDFGLATEK (BRAF V600E)
GSFGLATEV

SEQ ID NO: 2085 - protein, 9 aa, Artificial Sequence
  Description of Artificial Sequence: Synthetic peptide
  Seed: GDFGLATEK (BRAF V600E)
GSFGLATEY

SEQ ID NO: 2086 - protein, 9 aa, Artificial Sequence
  Description of Artificial Sequence: Synthetic peptide
  Seed: GLATEKSRW (BRAF V600E)
GTATEKSRF

SEQ ID NO: 2087 - protein, 9 aa, Artificial Sequence
  Description of Artificial Sequence: Synthetic peptide
  Seed: GLATEKSRW (BRAF V600E)
GTATEKSRW

SEQ ID NO: 2088 - protein, 9 aa, Artificial Sequence
  Description of Artificial Sequence: Synthetic peptide
  Seed: GDFGLATEK (BRAF V600E)
GTFGLATEF

SEQ ID NO: 2089 - protein, 9 aa, Artificial Sequence
  Description of Artificial Sequence: Synthetic peptide
  Seed: GDFGLATEK (BRAF V600E)
GTFGLATEH

SEQ ID NO: 2090 - protein, 9 aa, Artificial Sequence
  Description of Artificial Sequence: Synthetic peptide
  Seed: GDFGLATEK (BRAF V600E)
GTFGLATEI

SEQ ID NO: 2091 - protein, 9 aa, Artificial Sequence
  Description of Artificial Sequence: Synthetic peptide
  Seed: GDFGLATEK (BRAF V600E)
GTFGLATEK

SEQ ID NO: 2092 - protein, 9 aa, Artificial Sequence
  Description of Artificial Sequence: Synthetic peptide
  Seed: GDFGLATEK (BRAF V600E)
GTFGLATEL

SEQ ID NO: 2093 - protein, 9 aa, Artificial Sequence
  Description of Artificial Sequence: Synthetic peptide
  Seed: GDFGLATEK (BRAF V600E)
GTFGLATEM

SEQ ID NO: 2094 - protein, 9 aa, Artificial Sequence
  Description of Artificial Sequence: Synthetic peptide
  Seed: GDFGLATEK (BRAF V600E)
GTFGLATER

SEQ ID NO: 2095 - protein, 9 aa, Artificial Sequence
  Description of Artificial Sequence: Synthetic peptide
  Seed: GDFGLATEK (BRAF V600E)
GTFGLATEV

SEQ ID NO: 2096 - protein, 9 aa, Artificial Sequence
  Description of Artificial Sequence: Synthetic peptide
  Seed: GDFGLATEK (BRAF V600E)
GTFGLATEY

SEQ ID NO: 2097 - protein, 9 aa, Artificial Sequence
  Description of Artificial Sequence: Synthetic peptide
  Seed: GLATEKSRW (BRAF V600E)
GVATEKSRF

SEQ ID NO: 2098 - protein, 9 aa, Artificial Sequence
  Description of Artificial Sequence: Synthetic peptide
  Seed: GLATEKSRW (BRAF V600E)
GVATEKSRL

SEQ ID NO: 2099 - protein, 9 aa, Artificial Sequence
  Description of Artificial Sequence: Synthetic peptide
  Seed: GLATEKSRW (BRAF V600E)
GVATEKSRW

SEQ ID NO: 2100 - protein, 9 aa, Artificial Sequence
  Description of Artificial Sequence: Synthetic peptide
  Seed: GDFGLATEK (BRAF V600E)
GVFGLATEF

SEQ ID NO: 2101 - protein, 9 aa, Artificial Sequence
  Description of Artificial Sequence: Synthetic peptide
  Seed: GDFGLATEK (BRAF V600E)
GVFGLATEH

SEQ ID NO: 2102 - protein, 9 aa, Artificial Sequence
  Description of Artificial Sequence: Synthetic peptide
  Seed: GDFGLATEK (BRAF V600E)
GVFGLATEI

SEQ ID NO: 2103 - protein, 9 aa, Artificial Sequence
  Description of Artificial Sequence: Synthetic peptide
  Seed: GDFGLATEK (BRAF V600E)
GVFGLATEK

SEQ ID NO: 2104 - protein, 9 aa, Artificial Sequence
  Description of Artificial Sequence: Synthetic peptide
  Seed: GDFGLATEK (BRAF V600E)
GVFGLATEL

SEQ ID NO: 2105 - protein, 9 aa, Artificial Sequence
  Description of Artificial Sequence: Synthetic peptide
  Seed: GDFGLATEK (BRAF V600E)
GVFGLATEM

SEQ ID NO: 2106 - protein, 9 aa, Artificial Sequence
  Description of Artificial Sequence: Synthetic peptide
  Seed: GDFGLATEK (BRAF V600E)
GVFGLATER

SEQ ID NO: 2107 - protein, 9 aa, Artificial Sequence
  Description of Artificial Sequence: Synthetic peptide
  Seed: GDFGLATEK (BRAF V600E)
GVFGLATEV

SEQ ID NO: 2108 - protein, 9 aa, Artificial Sequence
  Description of Artificial Sequence: Synthetic peptide
  Seed: GDFGLATEK (BRAF V600E)
GVFGLATEY

SEQ ID NO: 2109 - protein, 9 aa, Artificial Sequence
  Description of Artificial Sequence: Synthetic peptide
  Seed: GDFGLATEK (BRAF V600E)
GWFGLATEK

SEQ ID NO: 2110 - protein, 9 aa, Artificial Sequence
  Description of Artificial Sequence: Synthetic peptide
  Seed: GDFGLATEK (BRAF V600E)
GYFGLATEK

SEQ ID NO: 2111 - protein, 10 aa, Artificial Sequence
  Description of Artificial Sequence: Synthetic peptide
  Seed: IGDFGLATEK (BRAF V600E)
IADFGLATEF

SEQ ID NO: 2112 - protein, 10 aa, Artificial Sequence
  Description of Artificial Sequence: Synthetic peptide
  Seed: IGDFGLATEK (BRAF V600E)
IADFGLATEH

SEQ ID NO: 2113 - protein, 10 aa, Artificial Sequence
  Description of Artificial Sequence: Synthetic peptide
  Seed: IGDFGLATEK (BRAF V600E)
IADFGLATEI

SEQ ID NO: 2114 - protein, 10 aa, Artificial Sequence
  Description of Artificial Sequence: Synthetic peptide
  Seed: IGDFGLATEK (BRAF V600E)
IADFGLATEK

SEQ ID NO: 2115 - protein, 10 aa, Artificial Sequence
  Description of Artificial Sequence: Synthetic peptide
  Seed: IGDFGLATEK (BRAF V600E)
IADFGLATEL

SEQ ID NO: 2116 - protein, 10 aa, Artificial Sequence
  Description of Artificial Sequence: Synthetic peptide
  Seed: IGDFGLATEK (BRAF V600E)
IADFGLATEM

SEQ ID NO: 2117 - protein, 10 aa, Artificial Sequence
  Description of Artificial Sequence: Synthetic peptide
  Seed: IGDFGLATEK (BRAF V600E)
IADFGLATER

SEQ ID NO: 2118 - protein, 10 aa, Artificial Sequence
  Description of Artificial Sequence: Synthetic peptide
  Seed: IGDFGLATEK (BRAF V600E)
IADFGLATEV

SEQ ID NO: 2119 - protein, 10 aa, Artificial Sequence
  Description of Artificial Sequence: Synthetic peptide
  Seed: IGDFGLATEK (BRAF V600E)
IADFGLATEW

SEQ ID NO: 2120 - protein, 10 aa, Artificial Sequence
  Description of Artificial Sequence: Synthetic peptide
  Seed: IGDFGLATEK (BRAF V600E)
ICDFGLATEF

SEQ ID NO: 2121 - protein, 10 aa, Artificial Sequence
  Description of Artificial Sequence: Synthetic peptide
  Seed: IGDFGLATEK (BRAF V600E)
ICDFGLATEK

SEQ ID NO: 2122 - protein, 10 aa, Artificial Sequence
  Description of Artificial Sequence: Synthetic peptide
  Seed: IGDFGLATEK (BRAF V600E)
ICDFGLATER

SEQ ID NO: 2123 - protein, 10 aa, Artificial Sequence
  Description of Artificial Sequence: Synthetic peptide
  Seed: IGDFGLATEK (BRAF V600E)
ICDFGLATEY

SEQ ID NO: 2124 - protein, 10 aa, Artificial Sequence
  Description of Artificial Sequence: Synthetic peptide
  Seed: IGDFGLATEK (BRAF V600E)
IDDFGLATEK

SEQ ID NO: 2125 - protein, 10 aa, Artificial Sequence
  Description of Artificial Sequence: Synthetic peptide
  Seed: IGDFGLATEK (BRAF V600E)
IDDFGLATER

SEQ ID NO: 2126 - protein, 10 aa, Artificial Sequence
  Description of Artificial Sequence: Synthetic peptide
  Seed: IGDFGLATEK (BRAF V600E)
IDDFGLATEY

SEQ ID NO: 2127 - protein, 10 aa, Artificial Sequence
  Description of Artificial Sequence: Synthetic peptide
  Seed: IGDFGLATEK (BRAF V600E)
IEDFGLATEK

SEQ ID NO: 2128 - protein, 10 aa, Artificial Sequence
  Description of Artificial Sequence: Synthetic peptide
  Seed: IGDFGLATEK (BRAF V600E)
IEDFGLATER

SEQ ID NO: 2129 - protein, 10 aa, Artificial Sequence
  Description of Artificial Sequence: Synthetic peptide
  Seed: IGDFGLATEK (BRAF V600E)
IEDFGLATEY

SEQ ID NO: 2130 - protein, 10 aa, Artificial Sequence
  Description of Artificial Sequence: Synthetic peptide
  Seed: IGDFGLATEK (BRAF V600E)
IFDFGLATEF

SEQ ID NO: 2131 - protein, 10 aa, Artificial Sequence
  Description of Artificial Sequence: Synthetic peptide
  Seed: IGDFGLATEK (BRAF V600E)
IFDFGLATEK

SEQ ID NO: 2132 - protein, 10 aa, Artificial Sequence
  Description of Artificial Sequence: Synthetic peptide
  Seed: IGDFGLATEK (BRAF V600E)
IFDFGLATEL

SEQ ID NO: 2133 - protein, 10 aa, Artificial Sequence
  Description of Artificial Sequence: Synthetic peptide
  Seed: IGDFGLATEK (BRAF V600E)
IFDFGLATEM

SEQ ID NO: 2134 - protein, 10 aa, Artificial Sequence
  Description of Artificial Sequence: Synthetic peptide
  Seed: IGDFGLATEK (BRAF V600E)
IFDFGLATER

SEQ ID NO: 2135 - protein, 10 aa, Artificial Sequence
  Description of Artificial Sequence: Synthetic peptide
  Seed: IGDFGLATEK (BRAF V600E)
IFDFGLATEW

SEQ ID NO: 2136 - protein, 10 aa, Artificial Sequence
  Description of Artificial Sequence: Synthetic peptide
  Seed: IGDFGLATEK (BRAF V600E)
IFDFGLATEY

SEQ ID NO: 2137 - protein, 10 aa, Artificial Sequence
  Description of Artificial Sequence: Synthetic peptide
  Seed: IGDFGLATEK (BRAF V600E)
IGDFGLATEF

SEQ ID NO: 2138 - protein, 10 aa, Artificial Sequence
  Description of Artificial Sequence: Synthetic peptide
  Seed: IGDFGLATEK (BRAF V600E)
IGDFGLATEL

SEQ ID NO: 2139 - protein, 10 aa, Artificial Sequence
  Description of Artificial Sequence: Synthetic peptide
  Seed: IGDFGLATEK (BRAF V600E)
IGDFGLATEM

SEQ ID NO: 2140 - protein, 10 aa, Artificial Sequence
  Description of Artificial Sequence: Synthetic peptide
  Seed: IGDFGLATEK (BRAF V600E)
IGDFGLATER

SEQ ID NO: 2141 - protein, 10 aa, Artificial Sequence
  Description of Artificial Sequence: Synthetic peptide
  Seed: IGDFGLATEK (BRAF V600E)
IGDFGLATEY

SEQ ID NO: 2142 - protein, 10 aa, Artificial Sequence
  Description of Artificial Sequence: Synthetic peptide
  Seed: IGDFGLATEK (BRAF V600E)
IHDFGLATEK

SEQ ID NO: 2143 - protein, 10 aa, Artificial Sequence
  Description of Artificial Sequence: Synthetic peptide
  Seed: IGDFGLATEK (BRAF V600E)
IHDFGLATEY

SEQ ID NO: 2144 - protein, 10 aa, Artificial Sequence
  Description of Artificial Sequence: Synthetic peptide
  Seed: IGDFGLATEK (BRAF V600E)
IIDFGLATEF

SEQ ID NO: 2145 - protein, 10 aa, Artificial Sequence
  Description of Artificial Sequence: Synthetic peptide
  Seed: IGDFGLATEK (BRAF V600E)
IIDFGLATEH

SEQ ID NO: 2146 - protein, 10 aa, Artificial Sequence
  Description of Artificial Sequence: Synthetic peptide
  Seed: IGDFGLATEK (BRAF V600E)
IIDFGLATEK

SEQ ID NO: 2147 - protein, 10 aa, Artificial Sequence
  Description of Artificial Sequence: Synthetic peptide
  Seed: IGDFGLATEK (BRAF V600E)
IIDFGLATEL

SEQ ID NO: 2148 - protein, 10 aa, Artificial Sequence
  Description of Artificial Sequence: Synthetic peptide
  Seed: IGDFGLATEK (BRAF V600E)
IIDFGLATEM

SEQ ID NO: 2149 - protein, 10 aa, Artificial Sequence
  Description of Artificial Sequence: Synthetic peptide
  Seed: IGDFGLATEK (BRAF V600E)
IIDFGLATER

SEQ ID NO: 2150 - protein, 10 aa, Artificial Sequence
  Description of Artificial Sequence: Synthetic peptide
  Seed: IGDFGLATEK (BRAF V600E)
IIDFGLATEW

SEQ ID NO: 2151 - protein, 10 aa, Artificial Sequence
  Description of Artificial Sequence: Synthetic peptide
  Seed: IGDFGLATEK (BRAF V600E)
IIDFGLATEY

SEQ ID NO: 2152 - protein, 10 aa, Artificial Sequence
  Description of Artificial Sequence: Synthetic peptide
  Seed: IGDFGLATEK (BRAF V600E)
IKDFGLATEY

SEQ ID NO: 2153 - protein, 10 aa, Artificial Sequence
  Description of Artificial Sequence: Synthetic peptide
  Seed: IGDFGLATEK (BRAF V600E)
ILDFGLATEF

SEQ ID NO: 2154 - protein, 10 aa, Artificial Sequence
  Description of Artificial Sequence: Synthetic peptide
  Seed: IGDFGLATEK (BRAF V600E)
ILDFGLATEH

SEQ ID NO: 2155 - protein, 10 aa, Artificial Sequence
  Description of Artificial Sequence: Synthetic peptide
  Seed: IGDFGLATEK (BRAF V600E)
ILDFGLATEK

SEQ ID NO: 2156 - protein, 10 aa, Artificial Sequence
  Description of Artificial Sequence: Synthetic peptide
  Seed: IGDFGLATEK (BRAF V600E)
ILDFGLATEL

SEQ ID NO: 2157 - protein, 10 aa, Artificial Sequence
  Description of Artificial Sequence: Synthetic peptide
  Seed: IGDFGLATEK (BRAF V600E)
ILDFGLATEM

SEQ ID NO: 2158 - protein, 10 aa, Artificial Sequence
  Description of Artificial Sequence: Synthetic peptide
  Seed: IGDFGLATEK (BRAF V600E)
ILDFGLATER

SEQ ID NO: 2159 - protein, 10 aa, Artificial Sequence
  Description of Artificial Sequence: Synthetic peptide
  Seed: IGDFGLATEK (BRAF V600E)
ILDFGLATEW

SEQ ID NO: 2160 - protein, 10 aa, Artificial Sequence
  Description of Artificial Sequence: Synthetic peptide
  Seed: IGDFGLATEK (BRAF V600E)
ILDFGLATEY

SEQ ID NO: 2161 - protein, 10 aa, Artificial Sequence
  Description of Artificial Sequence: Synthetic peptide
  Seed: IGDFGLATEK (BRAF V600E)
IMDFGLATEF

SEQ ID NO: 2162 - protein, 10 aa, Artificial Sequence
  Description of Artificial Sequence: Synthetic peptide
  Seed: IGDFGLATEK (BRAF V600E)
IMDFGLATEH

SEQ ID NO: 2163 - protein, 10 aa, Artificial Sequence
  Description of Artificial Sequence: Synthetic peptide
  Seed: IGDFGLATEK (BRAF V600E)
IMDFGLATEK

SEQ ID NO: 2164 - protein, 10 aa, Artificial Sequence
  Description of Artificial Sequence: Synthetic peptide
  Seed: IGDFGLATEK (BRAF V600E)
IMDFGLATEL

SEQ ID NO: 2165 - protein, 10 aa, Artificial Sequence
  Description of Artificial Sequence: Synthetic peptide
  Seed: IGDFGLATEK (BRAF V600E)
IMDFGLATEM

SEQ ID NO: 2166 - protein, 10 aa, Artificial Sequence
  Description of Artificial Sequence: Synthetic peptide
  Seed: IGDFGLATEK (BRAF V600E)
IMDFGLATER

SEQ ID NO: 2167 - protein, 10 aa, Artificial Sequence
  Description of Artificial Sequence: Synthetic peptide
  Seed: IGDFGLATEK (BRAF V600E)
IMDFGLATEW

SEQ ID NO: 2168 - protein, 10 aa, Artificial Sequence
  Description of Artificial Sequence: Synthetic peptide
  Seed: IGDFGLATEK (BRAF V600E)
IMDFGLATEY

SEQ ID NO: 2169 - protein, 10 aa, Artificial Sequence
  Description of Artificial Sequence: Synthetic peptide
  Seed: IGDFGLATEK (BRAF V600E)
INDFGLATEK

SEQ ID NO: 2170 - protein, 10 aa, Artificial Sequence
  Description of Artificial Sequence: Synthetic peptide
  Seed: IGDFGLATEK (BRAF V600E)
INDFGLATER

SEQ ID NO: 2171 - protein, 10 aa, Artificial Sequence
  Description of Artificial Sequence: Synthetic peptide
  Seed: IGDFGLATEK (BRAF V600E)
INDFGLATEY

SEQ ID NO: 2172 - protein, 10 aa, Artificial Sequence
  Description of Artificial Sequence: Synthetic peptide
  Seed: IGDFGLATEK (BRAF V600E)
IPDFGLATEK

SEQ ID NO: 2173 - protein, 10 aa, Artificial Sequence
  Description of Artificial Sequence: Synthetic peptide
  Seed: IGDFGLATEK (BRAF V600E)
IPDFGLATEY

SEQ ID NO: 2174 - protein, 10 aa, Artificial Sequence
  Description of Artificial Sequence: Synthetic peptide
  Seed: IGDFGLATEK (BRAF V600E)
IQDFGLATEF

SEQ ID NO: 2175 - protein, 10 aa, Artificial Sequence
  Description of Artificial Sequence: Synthetic peptide
  Seed: IGDFGLATEK (BRAF V600E)
IQDFGLATEK

SEQ ID NO: 2176 - protein, 10 aa, Artificial Sequence
  Description of Artificial Sequence: Synthetic peptide
  Seed: IGDFGLATEK (BRAF V600E)
IQDFGLATER

SEQ ID NO: 2177 - protein, 10 aa, Artificial Sequence
  Description of Artificial Sequence: Synthetic peptide
  Seed: IGDFGLATEK (BRAF V600E)
IQDFGLATEY

SEQ ID NO: 2178 - protein, 10 aa, Artificial Sequence
  Description of Artificial Sequence: Synthetic peptide
  Seed: IGDFGLATEK (BRAF V600E)
IRDFGLATEL

SEQ ID NO: 2179 - protein, 10 aa, Artificial Sequence
  Description of Artificial Sequence: Synthetic peptide
  Seed: IGDFGLATEK (BRAF V600E)
ISDFGLATEF

SEQ ID NO: 2180 - protein, 10 aa, Artificial Sequence
  Description of Artificial Sequence: Synthetic peptide
  Seed: IGDFGLATEK (BRAF V600E)
ISDFGLATEH

SEQ ID NO: 2181 - protein, 10 aa, Artificial Sequence
  Description of Artificial Sequence: Synthetic peptide
  Seed: IGDFGLATEK (BRAF V600E)
ISDFGLATEI

SEQ ID NO: 2182 - protein, 10 aa, Artificial Sequence
  Description of Artificial Sequence: Synthetic peptide
  Seed: IGDFGLATEK (BRAF V600E)
ISDFGLATEK

SEQ ID NO: 2183 - protein, 10 aa, Artificial Sequence
  Description of Artificial Sequence: Synthetic peptide
  Seed: IGDFGLATEK (BRAF V600E)
ISDFGLATEL

SEQ ID NO: 2184 - protein, 10 aa, Artificial Sequence
  Description of Artificial Sequence: Synthetic peptide
  Seed: IGDFGLATEK (BRAF V600E)
ISDFGLATEM

SEQ ID NO: 2185 - protein, 10 aa, Artificial Sequence
  Description of Artificial Sequence: Synthetic peptide
  Seed: IGDFGLATEK (BRAF V600E)
ISDFGLATEQ

SEQ ID NO: 2186 - protein, 10 aa, Artificial Sequence
  Description of Artificial Sequence: Synthetic peptide
  Seed: IGDFGLATEK (BRAF V600E)
ISDFGLATER

SEQ ID NO: 2187 - protein, 10 aa, Artificial Sequence
  Description of Artificial Sequence: Synthetic peptide
  Seed: IGDFGLATEK (BRAF V600E)
ISDFGLATEV

SEQ ID NO: 2188 - protein, 10 aa, Artificial Sequence
  Description of Artificial Sequence: Synthetic peptide
  Seed: IGDFGLATEK (BRAF V600E)
ISDFGLATEW

SEQ ID NO: 2189 - protein, 10 aa, Artificial Sequence
  Description of Artificial Sequence: Synthetic peptide
  Seed: IGDFGLATEK (BRAF V600E)
ITDFGLATEF

SEQ ID NO: 2190 - protein, 10 aa, Artificial Sequence
  Description of Artificial Sequence: Synthetic peptide
  Seed: IGDFGLATEK (BRAF V600E)
ITDFGLATEH

SEQ ID NO: 2191 - protein, 10 aa, Artificial Sequence
  Description of Artificial Sequence: Synthetic peptide
  Seed: IGDFGLATEK (BRAF V600E)
ITDFGLATEI

SEQ ID NO: 2192 - protein, 10 aa, Artificial Sequence
  Description of Artificial Sequence: Synthetic peptide
  Seed: IGDFGLATEK (BRAF V600E)
ITDFGLATEK

SEQ ID NO: 2193 - protein, 10 aa, Artificial Sequence
  Description of Artificial Sequence: Synthetic peptide
  Seed: IGDFGLATEK (BRAF V600E)
ITDFGLATEL

SEQ ID NO: 2194 - protein, 10 aa, Artificial Sequence
  Description of Artificial Sequence: Synthetic peptide
  Seed: IGDFGLATEK (BRAF V600E)
ITDFGLATEM

SEQ ID NO: 2195 - protein, 10 aa, Artificial Sequence
  Description of Artificial Sequence: Synthetic peptide
  Seed: IGDFGLATEK (BRAF V600E)
ITDFGLATEQ

SEQ ID NO: 2196 - protein, 10 aa, Artificial Sequence
  Description of Artificial Sequence: Synthetic peptide
  Seed: IGDFGLATEK (BRAF V600E)
ITDFGLATER

SEQ ID NO: 2197 - protein, 10 aa, Artificial Sequence
  Description of Artificial Sequence: Synthetic peptide
  Seed: IGDFGLATEK (BRAF V600E)
ITDFGLATEV

SEQ ID NO: 2198 - protein, 10 aa, Artificial Sequence
  Description of Artificial Sequence: Synthetic peptide
  Seed: IGDFGLATEK (BRAF V600E)
ITDFGLATEW

SEQ ID NO: 2199 - protein, 10 aa, Artificial Sequence
  Description of Artificial Sequence: Synthetic peptide
  Seed: IGDFGLATEK (BRAF V600E)
ITDFGLATEY

SEQ ID NO: 2200 - protein, 10 aa, Artificial Sequence
  Description of Artificial Sequence: Synthetic peptide
  Seed: IGDFGLATEK (BRAF V600E)
IVDFGLATEF

SEQ ID NO: 2201 - protein, 10 aa, Artificial Sequence
  Description of Artificial Sequence: Synthetic peptide
  Seed: IGDFGLATEK (BRAF V600E)
IVDFGLATEH

SEQ ID NO: 2202 - protein, 10 aa, Artificial Sequence
  Description of Artificial Sequence: Synthetic peptide
  Seed: IGDFGLATEK (BRAF V600E)
IVDFGLATEK

SEQ ID NO: 2203 - protein, 10 aa, Artificial Sequence
  Description of Artificial Sequence: Synthetic peptide
  Seed: IGDFGLATEK (BRAF V600E)
IVDFGLATEL

SEQ ID NO: 2204 - protein, 10 aa, Artificial Sequence
  Description of Artificial Sequence: Synthetic peptide
  Seed: IGDFGLATEK (BRAF V600E)
IVDFGLATEM

SEQ ID NO: 2205 - protein, 10 aa, Artificial Sequence
  Description of Artificial Sequence: Synthetic peptide
  Seed: IGDFGLATEK (BRAF V600E)
IVDFGLATER

SEQ ID NO: 2206 - protein, 10 aa, Artificial Sequence
  Description of Artificial Sequence: Synthetic peptide
  Seed: IGDFGLATEK (BRAF V600E)
IVDFGLATEW

SEQ ID NO: 2207 - protein, 10 aa, Artificial Sequence
  Description of Artificial Sequence: Synthetic peptide
  Seed: IGDFGLATEK (BRAF V600E)
IVDFGLATEY

SEQ ID NO: 2208 - protein, 10 aa, Artificial Sequence
  Description of Artificial Sequence: Synthetic peptide
  Seed: IGDFGLATEK (BRAF V600E)
IWDFGLATEF

SEQ ID NO: 2209 - protein, 10 aa, Artificial Sequence
  Description of Artificial Sequence: Synthetic peptide
  Seed: IGDFGLATEK (BRAF V600E)
IWDFGLATEK

SEQ ID NO: 2210 - protein, 10 aa, Artificial Sequence
  Description of Artificial Sequence: Synthetic peptide
  Seed: IGDFGLATEK (BRAF V600E)
IWDFGLATEL

SEQ ID NO: 2211 - protein, 10 aa, Artificial Sequence
  Description of Artificial Sequence: Synthetic peptide
  Seed: IGDFGLATEK (BRAF V600E)
IWDFGLATEM

SEQ ID NO: 2212 - protein, 10 aa, Artificial Sequence
  Description of Artificial Sequence: Synthetic peptide
  Seed: IGDFGLATEK (BRAF V600E)
IWDFGLATEY

SEQ ID NO: 2213 - protein, 10 aa, Artificial Sequence
  Description of Artificial Sequence: Synthetic peptide
  Seed: IGDFGLATEK (BRAF V600E)
IYDFGLATEF

SEQ ID NO: 2214 - protein, 10 aa, Artificial Sequence
  Description of Artificial Sequence: Synthetic peptide
  Seed: IGDFGLATEK (BRAF V600E)
IYDFGLATEK

SEQ ID NO: 2215 - protein, 10 aa, Artificial Sequence
  Description of Artificial Sequence: Synthetic peptide
  Seed: IGDFGLATEK (BRAF V600E)
IYDFGLATEL

SEQ ID NO: 2216 - protein, 10 aa, Artificial Sequence
  Description of Artificial Sequence: Synthetic peptide
  Seed: IGDFGLATEK (BRAF V600E)
IYDFGLATEM

SEQ ID NO: 2217 - protein, 10 aa, Artificial Sequence
  Description of Artificial Sequence: Synthetic peptide
  Seed: IGDFGLATEK (BRAF V600E)
IYDFGLATER

SEQ ID NO: 2218 - protein, 10 aa, Artificial Sequence
  Description of Artificial Sequence: Synthetic peptide
  Seed: IGDFGLATEK (BRAF V600E)
IYDFGLATEW

SEQ ID NO: 2219 - protein, 10 aa, Artificial Sequence
  Description of Artificial Sequence: Synthetic peptide
  Seed: IGDFGLATEK (BRAF V600E)
IYDFGLATEY

SEQ ID NO: 2220 - protein, 11 aa, Artificial Sequence
  Description of Artificial Sequence: Synthetic peptide
  Seed: KIGDFGLATEK (BRAF V600E)
KAGDFGLATEA

SEQ ID NO: 2221 - protein, 11 aa, Artificial Sequence
  Description of Artificial Sequence: Synthetic peptide
  Seed: KIGDFGLATEK (BRAF V600E)
KAGDFGLATEC

SEQ ID NO: 2222 - protein, 11 aa, Artificial Sequence
  Description of Artificial Sequence: Synthetic peptide
  Seed: KIGDFGLATEK (BRAF V600E)
KAGDFGLATEF

SEQ ID NO: 2223 - protein, 11 aa, Artificial Sequence
  Description of Artificial Sequence: Synthetic peptide
  Seed: KIGDFGLATEK (BRAF V600E)
KAGDFGLATEH

SEQ ID NO: 2224 - protein, 11 aa, Artificial Sequence
  Description of Artificial Sequence: Synthetic peptide
  Seed: KIGDFGLATEK (BRAF V600E)
KAGDFGLATEI

SEQ ID NO: 2225 - protein, 11 aa, Artificial Sequence
  Description of Artificial Sequence: Synthetic peptide
  Seed: KIGDFGLATEK (BRAF V600E)
KAGDFGLATEL

SEQ ID NO: 2226 - protein, 11 aa, Artificial Sequence
  Description of Artificial Sequence: Synthetic peptide
  Seed: KIGDFGLATEK (BRAF V600E)
KAGDFGLATEM

SEQ ID NO: 2227 - protein, 11 aa, Artificial Sequence
  Description of Artificial Sequence: Synthetic peptide
  Seed: KIGDFGLATEK (BRAF V600E)
KAGDFGLATEQ

SEQ ID NO: 2228 - protein, 11 aa, Artificial Sequence
  Description of Artificial Sequence: Synthetic peptide
  Seed: KIGDFGLATEK (BRAF V600E)
KAGDFGLATEV

SEQ ID NO: 2229 - protein, 11 aa, Artificial Sequence
  Description of Artificial Sequence: Synthetic peptide
  Seed: KIGDFGLATEK (BRAF V600E)
KAGDFGLATEW

SEQ ID NO: 2230 - protein, 11 aa, Artificial Sequence
  Description of Artificial Sequence: Synthetic peptide
  Seed: KIGDFGLATEK (BRAF V600E)
KCGDFGLATEF

SEQ ID NO: 2231 - protein, 11 aa, Artificial Sequence
  Description of Artificial Sequence: Synthetic peptide
  Seed: KIGDFGLATEK (BRAF V600E)
KCGDFGLATEK

SEQ ID NO: 2232 - protein, 11 aa, Artificial Sequence
  Description of Artificial Sequence: Synthetic peptide
  Seed: KIGDFGLATEK (BRAF V600E)
KCGDFGLATEL

SEQ ID NO: 2233 - protein, 11 aa, Artificial Sequence
  Description of Artificial Sequence: Synthetic peptide
  Seed: KIGDFGLATEK (BRAF V600E)
KCGDFGLATEM

SEQ ID NO: 2234 - protein, 11 aa, Artificial Sequence
  Description of Artificial Sequence: Synthetic peptide
  Seed: KIGDFGLATEK (BRAF V600E)
KCGDFGLATER

SEQ ID NO: 2235 - protein, 11 aa, Artificial Sequence
  Description of Artificial Sequence: Synthetic peptide
  Seed: KIGDFGLATEK (BRAF V600E)
KCGDFGLATEY

SEQ ID NO: 2236 - protein, 11 aa, Artificial Sequence
  Description of Artificial Sequence: Synthetic peptide
  Seed: KIGDFGLATEK (BRAF V600E)
KDGDFGLATEK

SEQ ID NO: 2237 - protein, 11 aa, Artificial Sequence
  Description of Artificial Sequence: Synthetic peptide
  Seed: KIGDFGLATEK (BRAF V600E)
KDGDFGLATER

SEQ ID NO: 2238 - protein, 11 aa, Artificial Sequence
  Description of Artificial Sequence: Synthetic peptide
  Seed: KIGDFGLATEK (BRAF V600E)
KDGDFGLATEY

SEQ ID NO: 2239 - protein, 11 aa, Artificial Sequence
  Description of Artificial Sequence: Synthetic peptide
  Seed: KIGDFGLATEK (BRAF V600E)
KEGDFGLATEF

SEQ ID NO: 2240 - protein, 11 aa, Artificial Sequence
  Description of Artificial Sequence: Synthetic peptide
  Seed: KIGDFGLATEK (BRAF V600E)
KEGDFGLATEK

SEQ ID NO: 2241 - protein, 11 aa, Artificial Sequence
  Description of Artificial Sequence: Synthetic peptide
  Seed: KIGDFGLATEK (BRAF V600E)
KEGDFGLATEM

SEQ ID NO: 2242 - protein, 11 aa, Artificial Sequence
  Description of Artificial Sequence: Synthetic peptide
  Seed: KIGDFGLATEK (BRAF V600E)
KEGDFGLATER

SEQ ID NO: 2243 - protein, 11 aa, Artificial Sequence
  Description of Artificial Sequence: Synthetic peptide
  Seed: KIGDFGLATEK (BRAF V600E)
KEGDFGLATEW

SEQ ID NO: 2244 - protein, 11 aa, Artificial Sequence
  Description of Artificial Sequence: Synthetic peptide
  Seed: KIGDFGLATEK (BRAF V600E)
KEGDFGLATEY

SEQ ID NO: 2245 - protein, 11 aa, Artificial Sequence
  Description of Artificial Sequence: Synthetic peptide
  Seed: KIGDFGLATEK (BRAF V600E)
KFGDFGLATEF

SEQ ID NO: 2246 - protein, 11 aa, Artificial Sequence
  Description of Artificial Sequence: Synthetic peptide
  Seed: KIGDFGLATEK (BRAF V600E)
KFGDFGLATEY

SEQ ID NO: 2247 - protein, 11 aa, Artificial Sequence
  Description of Artificial Sequence: Synthetic peptide
  Seed: KIGDFGLATEK (BRAF V600E)
KGGDFGLATEF

SEQ ID NO: 2248 - protein, 11 aa, Artificial Sequence
  Description of Artificial Sequence: Synthetic peptide
  Seed: KIGDFGLATEK (BRAF V600E)
KGGDFGLATEH

SEQ ID NO: 2249 - protein, 11 aa, Artificial Sequence
  Description of Artificial Sequence: Synthetic peptide
  Seed: KIGDFGLATEK (BRAF V600E)
KGGDFGLATEK

SEQ ID NO: 2250 - protein, 11 aa, Artificial Sequence
  Description of Artificial Sequence: Synthetic peptide
  Seed: KIGDFGLATEK (BRAF V600E)
KGGDFGLATEL

SEQ ID NO: 2251 - protein, 11 aa, Artificial Sequence
  Description of Artificial Sequence: Synthetic peptide
  Seed: KIGDFGLATEK (BRAF V600E)
KGGDFGLATEM

SEQ ID NO: 2252 - protein, 11 aa, Artificial Sequence
  Description of Artificial Sequence: Synthetic peptide
  Seed: KIGDFGLATEK (BRAF V600E)
KGGDFGLATEW

SEQ ID NO: 2253 - protein, 11 aa, Artificial Sequence
  Description of Artificial Sequence: Synthetic peptide
  Seed: KIGDFGLATEK (BRAF V600E)
KGGDFGLATEY

SEQ ID NO: 2254 - protein, 11 aa, Artificial Sequence
  Description of Artificial Sequence: Synthetic peptide
  Seed: KIGDFGLATEK (BRAF V600E)
KIGDFGLATEF

SEQ ID NO: 2255 - protein, 11 aa, Artificial Sequence
  Description of Artificial Sequence: Synthetic peptide
  Seed: KIGDFGLATEK (BRAF V600E)
KIGDFGLATEH

SEQ ID NO: 2256 - protein, 11 aa, Artificial Sequence
  Description of Artificial Sequence: Synthetic peptide
  Seed: KIGDFGLATEK (BRAF V600E)
KIGDFGLATEL

SEQ ID NO: 2257 - protein, 11 aa, Artificial Sequence
  Description of Artificial Sequence: Synthetic peptide
  Seed: KIGDFGLATEK (BRAF V600E)
KIGDFGLATEM

SEQ ID NO: 2258 - protein, 11 aa, Artificial Sequence
  Description of Artificial Sequence: Synthetic peptide
  Seed: KIGDFGLATEK (BRAF V600E)
KIGDFGLATEW

SEQ ID NO: 2259 - protein, 11 aa, Artificial Sequence
  Description of Artificial Sequence: Synthetic peptide
  Seed: KIGDFGLATEK (BRAF V600E)
KIGDFGLATEY

SEQ ID NO: 2260 - protein, 11 aa, Artificial Sequence
  Description of Artificial Sequence: Synthetic peptide
  Seed: KIGDFGLATEK (BRAF V600E)
KLGDFGLATEF

SEQ ID NO: 2261 - protein, 11 aa, Artificial Sequence
  Description of Artificial Sequence: Synthetic peptide
  Seed: KIGDFGLATEK (BRAF V600E)
KLGDFGLATEH

SEQ ID NO: 2262 - protein, 11 aa, Artificial Sequence
  Description of Artificial Sequence: Synthetic peptide
  Seed: KIGDFGLATEK (BRAF V600E)
KLGDFGLATEL

SEQ ID NO: 2263 - protein, 11 aa, Artificial Sequence
  Description of Artificial Sequence: Synthetic peptide
  Seed: KIGDFGLATEK (BRAF V600E)
KLGDFGLATEM

SEQ ID NO: 2264 - protein, 11 aa, Artificial Sequence
  Description of Artificial Sequence: Synthetic peptide
  Seed: KIGDFGLATEK (BRAF V600E)
KLGDFGLATEW

SEQ ID NO: 2265 - protein, 11 aa, Artificial Sequence
  Description of Artificial Sequence: Synthetic peptide
  Seed: KIGDFGLATEK (BRAF V600E)
KLGDFGLATEY

SEQ ID NO: 2266 - protein, 11 aa, Artificial Sequence
  Description of Artificial Sequence: Synthetic peptide
  Seed: KIGDFGLATEK (BRAF V600E)
KMGDFGLATEF

SEQ ID NO: 2267 - protein, 11 aa, Artificial Sequence
  Description of Artificial Sequence: Synthetic peptide
  Seed: KIGDFGLATEK (BRAF V600E)
KMGDFGLATEH

SEQ ID NO: 2268 - protein, 11 aa, Artificial Sequence
  Description of Artificial Sequence: Synthetic peptide
  Seed: KIGDFGLATEK (BRAF V600E)
KMGDFGLATEL

SEQ ID NO: 2269 - protein, 11 aa, Artificial Sequence
  Description of Artificial Sequence: Synthetic peptide
  Seed: KIGDFGLATEK (BRAF V600E)
KMGDFGLATEM

SEQ ID NO: 2270 - protein, 11 aa, Artificial Sequence
  Description of Artificial Sequence: Synthetic peptide
  Seed: KIGDFGLATEK (BRAF V600E)
KMGDFGLATEW

SEQ ID NO: 2271 - protein, 11 aa, Artificial Sequence
  Description of Artificial Sequence: Synthetic peptide
  Seed: KIGDFGLATEK (BRAF V600E)
KNGDFGLATEF

SEQ ID NO: 2272 - protein, 11 aa, Artificial Sequence
  Description of Artificial Sequence: Synthetic peptide
  Seed: KIGDFGLATEK (BRAF V600E)
KNGDFGLATEK

SEQ ID NO: 2273 - protein, 11 aa, Artificial Sequence
  Description of Artificial Sequence: Synthetic peptide
  Seed: KIGDFGLATEK (BRAF V600E)
KNGDFGLATEY

SEQ ID NO: 2274 - protein, 11 aa, Artificial Sequence
  Description of Artificial Sequence: Synthetic peptide
  Seed: KIGDFGLATEK (BRAF V600E)
KPGDFGLATEF

SEQ ID NO: 2275 - protein, 11 aa, Artificial Sequence
  Description of Artificial Sequence: Synthetic peptide
  Seed: KIGDFGLATEK (BRAF V600E)
KPGDFGLATEK

SEQ ID NO: 2276 - protein, 11 aa, Artificial Sequence
  Description of Artificial Sequence: Synthetic peptide
  Seed: KIGDFGLATEK (BRAF V600E)
KPGDFGLATER

SEQ ID NO: 2277 - protein, 11 aa, Artificial Sequence
  Description of Artificial Sequence: Synthetic peptide
  Seed: KIGDFGLATEK (BRAF V600E)
KPGDFGLATEY

SEQ ID NO: 2278 - protein, 11 aa, Artificial Sequence
  Description of Artificial Sequence: Synthetic peptide
  Seed: KIGDFGLATEK (BRAF V600E)
KQGDFGLATEF

SEQ ID NO: 2279 - protein, 11 aa, Artificial Sequence
  Description of Artificial Sequence: Synthetic peptide
  Seed: KIGDFGLATEK (BRAF V600E)
KQGDFGLATEH

SEQ ID NO: 2280 - protein, 11 aa, Artificial Sequence
  Description of Artificial Sequence: Synthetic peptide
  Seed: KIGDFGLATEK (BRAF V600E)
KQGDFGLATEK

SEQ ID NO: 2281 - protein, 11 aa, Artificial Sequence
  Description of Artificial Sequence: Synthetic peptide
  Seed: KIGDFGLATEK (BRAF V600E)
KQGDFGLATEL

SEQ ID NO: 2282 - protein, 11 aa, Artificial Sequence
  Description of Artificial Sequence: Synthetic peptide
  Seed: KIGDFGLATEK (BRAF V600E)
KQGDFGLATEM

SEQ ID NO: 2283 - protein, 11 aa, Artificial Sequence
  Description of Artificial Sequence: Synthetic peptide
  Seed: KIGDFGLATEK (BRAF V600E)
KQGDFGLATEW

SEQ ID NO: 2284 - protein, 11 aa, Artificial Sequence
  Description of Artificial Sequence: Synthetic peptide
  Seed: KIGDFGLATEK (BRAF V600E)
KQGDFGLATEY

SEQ ID NO: 2285 - protein, 11 aa, Artificial Sequence
  Description of Artificial Sequence: Synthetic peptide
  Seed: KIGDFGLATEK (BRAF V600E)
KSGDFGLATEF

SEQ ID NO: 2286 - protein, 11 aa, Artificial Sequence
  Description of Artificial Sequence: Synthetic peptide
  Seed: KIGDFGLATEK (BRAF V600E)
KSGDFGLATEH

SEQ ID NO: 2287 - protein, 11 aa, Artificial Sequence
  Description of Artificial Sequence: Synthetic peptide
  Seed: KIGDFGLATEK (BRAF V600E)
KSGDFGLATEI

SEQ ID NO: 2288 - protein, 11 aa, Artificial Sequence
  Description of Artificial Sequence: Synthetic peptide
  Seed: KIGDFGLATEK (BRAF V600E)
KSGDFGLATEL

SEQ ID NO: 2289 - protein, 11 aa, Artificial Sequence
  Description of Artificial Sequence: Synthetic peptide
  Seed: KIGDFGLATEK (BRAF V600E)
KSGDFGLATEM

SEQ ID NO: 2290 - protein, 11 aa, Artificial Sequence
  Description of Artificial Sequence: Synthetic peptide
  Seed: KIGDFGLATEK (BRAF V600E)
KSGDFGLATEV

SEQ ID NO: 2291 - protein, 11 aa, Artificial Sequence
  Description of Artificial Sequence: Synthetic peptide
  Seed: KIGDFGLATEK (BRAF V600E)
KSGDFGLATEW

SEQ ID NO: 2292 - protein, 11 aa, Artificial Sequence
  Description of Artificial Sequence: Synthetic peptide
  Seed: KIGDFGLATEK (BRAF V600E)
KSGDFGLATEY

SEQ ID NO: 2293 - protein, 11 aa, Artificial Sequence
  Description of Artificial Sequence: Synthetic peptide
  Seed: KIGDFGLATEK (BRAF V600E)
KTGDFGLATEF

SEQ ID NO: 2294 - protein, 11 aa, Artificial Sequence
  Description of Artificial Sequence: Synthetic peptide
  Seed: KIGDFGLATEK (BRAF V600E)
KTGDFGLATEH

SEQ ID NO: 2295 - protein, 11 aa, Artificial Sequence
  Description of Artificial Sequence: Synthetic peptide
  Seed: KIGDFGLATEK (BRAF V600E)
KTGDFGLATEI

SEQ ID NO: 2296 - protein, 11 aa, Artificial Sequence
  Description of Artificial Sequence: Synthetic peptide
  Seed: KIGDFGLATEK (BRAF V600E)
KTGDFGLATEL

SEQ ID NO: 2297 - protein, 11 aa, Artificial Sequence
  Description of Artificial Sequence: Synthetic peptide
  Seed: KIGDFGLATEK (BRAF V600E)
KTGDFGLATEM

SEQ ID NO: 2298 - protein, 11 aa, Artificial Sequence
  Description of Artificial Sequence: Synthetic peptide
  Seed: KIGDFGLATEK (BRAF V600E)
KTGDFGLATEV

SEQ ID NO: 2299 - protein, 11 aa, Artificial Sequence
  Description of Artificial Sequence: Synthetic peptide
  Seed: KIGDFGLATEK (BRAF V600E)
KTGDFGLATEW

SEQ ID NO: 2300 - protein, 11 aa, Artificial Sequence
  Description of Artificial Sequence: Synthetic peptide
  Seed: KIGDFGLATEK (BRAF V600E)
KTGDFGLATEY

SEQ ID NO: 2301 - protein, 11 aa, Artificial Sequence
  Description of Artificial Sequence: Synthetic peptide
  Seed: KIGDFGLATEK (BRAF V600E)
KVGDFGLATEF

SEQ ID NO: 2302 - protein, 11 aa, Artificial Sequence
  Description of Artificial Sequence: Synthetic peptide
  Seed: KIGDFGLATEK (BRAF V600E)
KVGDFGLATEH

SEQ ID NO: 2303 - protein, 11 aa, Artificial Sequence
  Description of Artificial Sequence: Synthetic peptide
  Seed: KIGDFGLATEK (BRAF V600E)
KVGDFGLATEI

SEQ ID NO: 2304 - protein, 11 aa, Artificial Sequence
  Description of Artificial Sequence: Synthetic peptide
  Seed: KIGDFGLATEK (BRAF V600E)
KVGDFGLATEL

SEQ ID NO: 2305 - protein, 11 aa, Artificial Sequence
  Description of Artificial Sequence: Synthetic peptide
  Seed: KIGDFGLATEK (BRAF V600E)
KVGDFGLATEM

SEQ ID NO: 2306 - protein, 11 aa, Artificial Sequence
  Description of Artificial Sequence: Synthetic peptide
  Seed: KIGDFGLATEK (BRAF V600E)
KVGDFGLATEW

SEQ ID NO: 2307 - protein, 11 aa, Artificial Sequence
  Description of Artificial Sequence: Synthetic peptide
  Seed: KIGDFGLATEK (BRAF V600E)
KVGDFGLATEY

SEQ ID NO: 2308 - protein, 11 aa, Artificial Sequence
  Description of Artificial Sequence: Synthetic peptide
  Seed: KIGDFGLATEK (BRAF V600E)
KWGDFGLATEY

SEQ ID NO: 2309 - protein, 11 aa, Artificial Sequence
  Description of Artificial Sequence: Synthetic peptide
  Seed: KIGDFGLATEK (BRAF V600E)
KYGDFGLATEF

SEQ ID NO: 2310 - protein, 11 aa, Artificial Sequence
  Description of Artificial Sequence: Synthetic peptide
  Seed: KIGDFGLATEK (BRAF V600E)
KYGDFGLATEY

SEQ ID NO: 2311 - protein, 8 aa, Artificial Sequence
  Description of Artificial Sequence: Synthetic peptide
  Seed: LATEKSRW (BRAF V600E)
LCTEKSRW

SEQ ID NO: 2312 - protein, 8 aa, Artificial Sequence
  Description of Artificial Sequence: Synthetic peptide
  Seed: LATEKSRW (BRAF V600E)
LDTEKSRW

SEQ ID NO: 2313 - protein, 8 aa, Artificial Sequence
  Description of Artificial Sequence: Synthetic peptide
  Seed: LATEKSRW (BRAF V600E)
LGTEKSRW

SEQ ID NO: 2314 - protein, 8 aa, Artificial Sequence
  Description of Artificial Sequence: Synthetic peptide
  Seed: LATEKSRW (BRAF V600E)
LITEKSRW

SEQ ID NO: 2315 - protein, 8 aa, Artificial Sequence
  Description of Artificial Sequence: Synthetic peptide
  Seed: LATEKSRW (BRAF V600E)
LLTEKSRW

SEQ ID NO: 2316 - protein, 8 aa, Artificial Sequence
  Description of Artificial Sequence: Synthetic peptide
  Seed: LATEKSRW (BRAF V600E)
LMTEKSRW

SEQ ID NO: 2317 - protein, 8 aa, Artificial Sequence
  Description of Artificial Sequence: Synthetic peptide
  Seed: LATEKSRW (BRAF V600E)
LNTEKSRW

SEQ ID NO: 2318 - protein, 8 aa, Artificial Sequence
  Description of Artificial Sequence: Synthetic peptide
  Seed: LATEKSRW (BRAF V600E)
LSTEKSRW

SEQ ID NO: 2319 - protein, 8 aa, Artificial Sequence
  Description of Artificial Sequence: Synthetic peptide
  Seed: LATEKSRW (BRAF V600E)
LTTEKSRW

SEQ ID NO: 2320 - protein, 8 aa, Artificial Sequence
  Description of Artificial Sequence: Synthetic peptide
  Seed: LATEKSRW (BRAF V600E)
LVTEKSRW

SEQ ID NO: 2321 - protein, 10 aa, Homo sapiens
  Native (BRAF V600E)
DFGLATEKSR

SEQ ID NO: 2322 - protein, 11 aa, Homo sapiens
  Native (BRAF V600E)
EKSRWSGSHQF

SEQ ID NO: 2323 - protein, 10 aa, Homo sapiens
  Native (BRAF V600E)
FGLATEKSRW

SEQ ID NO: 2324 - protein, 11 aa, Homo sapiens
  Native (BRAF V600E)
KIGDFGLATEK

SEQ ID NO: 2325 - protein, 9 aa, Homo sapiens
  Native (BRAF V600E)
FGLATEKSR

SEQ ID NO: 2326 - protein, 9 aa, Homo sapiens
  Native (BRAF V600E)
GDFGLATEK

SEQ ID NO: 2327 - protein, 9 aa, Homo sapiens
  Native (BRAF V600E)
GLATEKSRW

SEQ ID NO: 2328 - protein, 10 aa, Homo sapiens
  Native (BRAF V600E)
IGDFGLATEK

SEQ ID NO: 2329 - protein, 8 aa, Homo sapiens
  Native (BRAF V600E)
LATEKSRW

SEQ ID NO: 2330 - protein, 9 aa, Artificial Sequence
  Description of Artificial Sequence: Synthetic peptide
  Seed: ATMKSRWSG (BRAF V600M)
AAMKSRWSA

SEQ ID NO: 2331 - protein, 9 aa, Artificial Sequence
  Description of Artificial Sequence: Synthetic peptide
  Seed: ATMKSRWSG (BRAF V600M)
AAMKSRWSG

SEQ ID NO: 2332 - protein, 10 aa, Artificial Sequence
  Description of Artificial Sequence: Synthetic peptide
  Seed: ATMKSRWSGS (BRAF V600M)
AAMKSRWSGA

SEQ ID NO: 2333 - protein, 10 aa, Artificial Sequence
  Description of Artificial Sequence: Synthetic peptide
  Seed: ATMKSRWSGS (BRAF V600M)
AAMKSRWSGI

SEQ ID NO: 2334 - protein, 10 aa, Artificial Sequence
  Description of Artificial Sequence: Synthetic peptide
  Seed: ATMKSRWSGS (BRAF V600M)
AAMKSRWSGK

SEQ ID NO: 2335 - protein, 10 aa, Artificial Sequence
  Description of Artificial Sequence: Synthetic peptide
  Seed: ATMKSRWSGS (BRAF V600M)
AAMKSRWSGL

SEQ ID NO: 2336 - protein, 10 aa, Artificial Sequence
  Description of Artificial Sequence: Synthetic peptide
  Seed: ATMKSRWSGS (BRAF V600M)
AAMKSRWSGM

SEQ ID NO: 2337 - protein, 10 aa, Artificial Sequence
  Description of Artificial Sequence: Synthetic peptide
  Seed: ATMKSRWSGS (BRAF V600M)
AAMKSRWSGV

SEQ ID NO: 2338 - protein, 9 aa, Artificial Sequence
  Description of Artificial Sequence: Synthetic peptide
  Seed: ATMKSRWSG (BRAF V600M)
AAMKSRWSI

SEQ ID NO: 2339 - protein, 9 aa, Artificial Sequence
  Description of Artificial Sequence: Synthetic peptide
  Seed: ATMKSRWSG (BRAF V600M)
AAMKSRWSK

SEQ ID NO: 2340 - protein, 9 aa, Artificial Sequence
  Description of Artificial Sequence: Synthetic peptide
  Seed: ATMKSRWSG (BRAF V600M)
AAMKSRWSL

SEQ ID NO: 2341 - protein, 9 aa, Artificial Sequence
  Description of Artificial Sequence: Synthetic peptide
  Seed: ATMKSRWSG (BRAF V600M)
AAMKSRWSM

SEQ ID NO: 2342 - protein, 9 aa, Artificial Sequence
  Description of Artificial Sequence: Synthetic peptide
  Seed: ATMKSRWSG (BRAF V600M)
AAMKSRWSR

SEQ ID NO: 2343 - protein, 9 aa, Artificial Sequence
  Description of Artificial Sequence: Synthetic peptide
  Seed: ATMKSRWSG (BRAF V600M)
AAMKSRWSS

SEQ ID NO: 2344 - protein, 9 aa, Artificial Sequence
  Description of Artificial Sequence: Synthetic peptide
  Seed: ATMKSRWSG (BRAF V600M)
AAMKSRWST

SEQ ID NO: 2345 - protein, 9 aa, Artificial Sequence
  Description of Artificial Sequence: Synthetic peptide
  Seed: ATMKSRWSG (BRAF V600M)
AAMKSRWSV

SEQ ID NO: 2346 - protein, 9 aa, Artificial Sequence
  Description of Artificial Sequence: Synthetic peptide
  Seed: ATMKSRWSG (BRAF V600M)
AAMKSRWSY

SEQ ID NO: 2347 - protein, 10 aa, Artificial Sequence
  Description of Artificial Sequence: Synthetic peptide
  Seed: ATMKSRWSGS (BRAF V600M)
ACMKSRWSGA

SEQ ID NO: 2348 - protein, 10 aa, Artificial Sequence
  Description of Artificial Sequence: Synthetic peptide
  Seed: ATMKSRWSGS (BRAF V600M)
ACMKSRWSGK

SEQ ID NO: 2349 - protein, 9 aa, Artificial Sequence
  Description of Artificial Sequence: Synthetic peptide
  Seed: ATMKSRWSG (BRAF V600M)
ACMKSRWSK

SEQ ID NO: 2350 - protein, 10 aa, Artificial Sequence
  Description of Artificial Sequence: Synthetic peptide
  Seed: ATMKSRWSGS (BRAF V600M)
ADMKSRWSGK

SEQ ID NO: 2351 - protein, 10 aa, Artificial Sequence
  Description of Artificial Sequence: Synthetic peptide
  Seed: ATMKSRWSGS (BRAF V600M)
AEMKSRWSGK

SEQ ID NO: 2352 - protein, 9 aa, Artificial Sequence
  Description of Artificial Sequence: Synthetic peptide
  Seed: ATMKSRWSG (BRAF V600M)
AFMKSRWSA

SEQ ID NO: 2353 - protein, 10 aa, Artificial Sequence
  Description of Artificial Sequence: Synthetic peptide
  Seed: ATMKSRWSGS (BRAF V600M)
AFMKSRWSGA

SEQ ID NO: 2354 - protein, 10 aa, Artificial Sequence
  Description of Artificial Sequence: Synthetic peptide
  Seed: ATMKSRWSGS (BRAF V600M)
AFMKSRWSGI

SEQ ID NO: 2355 - protein, 10 aa, Artificial Sequence
  Description of Artificial Sequence: Synthetic peptide
  Seed: ATMKSRWSGS (BRAF V600M)
AFMKSRWSGK

SEQ ID NO: 2356 - protein, 10 aa, Artificial Sequence
  Description of Artificial Sequence: Synthetic peptide
  Seed: ATMKSRWSGS (BRAF V600M)
AFMKSRWSGV

SEQ ID NO: 2357 - protein, 9 aa, Artificial Sequence
  Description of Artificial Sequence: Synthetic peptide
  Seed: ATMKSRWSG (BRAF V600M)
AFMKSRWSI

SEQ ID NO: 2358 - protein, 9 aa, Artificial Sequence
  Description of Artificial Sequence: Synthetic peptide
  Seed: ATMKSRWSG (BRAF V600M)
AFMKSRWSK

SEQ ID NO: 2359 - protein, 9 aa, Artificial Sequence
  Description of Artificial Sequence: Synthetic peptide
  Seed: ATMKSRWSG (BRAF V600M)
AFMKSRWSM

SEQ ID NO: 2360 - protein, 9 aa, Artificial Sequence
  Description of Artificial Sequence: Synthetic peptide
  Seed: ATMKSRWSG (BRAF V600M)
AFMKSRWSR

SEQ ID NO: 2361 - protein, 9 aa, Artificial Sequence
  Description of Artificial Sequence: Synthetic peptide
  Seed: ATMKSRWSG (BRAF V600M)
AFMKSRWSS

SEQ ID NO: 2362 - protein, 9 aa, Artificial Sequence
  Description of Artificial Sequence: Synthetic peptide
  Seed: ATMKSRWSG (BRAF V600M)
AFMKSRWSV

SEQ ID NO: 2363 - protein, 9 aa, Artificial Sequence
  Description of Artificial Sequence: Synthetic peptide
  Seed: ATMKSRWSG (BRAF V600M)
AGMKSRWSA

SEQ ID NO: 2364 - protein, 10 aa, Artificial Sequence
  Description of Artificial Sequence: Synthetic peptide
  Seed: ATMKSRWSGS (BRAF V600M)
AGMKSRWSGA

SEQ ID NO: 2365 - protein, 10 aa, Artificial Sequence
  Description of Artificial Sequence: Synthetic peptide
  Seed: ATMKSRWSGS (BRAF V600M)
AGMKSRWSGK

SEQ ID NO: 2366 - protein, 10 aa, Artificial Sequence
  Description of Artificial Sequence: Synthetic peptide
  Seed: ATMKSRWSGS (BRAF V600M)
AGMKSRWSGV

SEQ ID NO: 2367 - protein, 9 aa, Artificial Sequence
  Description of Artificial Sequence: Synthetic peptide
  Seed: ATMKSRWSG (BRAF V600M)
AGMKSRWSI

SEQ ID NO: 2368 - protein, 9 aa, Artificial Sequence
  Description of Artificial Sequence: Synthetic peptide
  Seed: ATMKSRWSG (BRAF V600M)
AGMKSRWSK

SEQ ID NO: 2369 - protein, 9 aa, Artificial Sequence
  Description of Artificial Sequence: Synthetic peptide
  Seed: ATMKSRWSG (BRAF V600M)
AGMKSRWSV

SEQ ID NO: 2370 - protein, 10 aa, Artificial Sequence
  Description of Artificial Sequence: Synthetic peptide
  Seed: ATMKSRWSGS (BRAF V600M)
AHMKSRWSGK

SEQ ID NO: 2371 - protein, 9 aa, Artificial Sequence
  Description of Artificial Sequence: Synthetic peptide
  Seed: ATMKSRWSG (BRAF V600M)
AHMKSRWSK

SEQ ID NO: 2372 - protein, 9 aa, Artificial Sequence
  Description of Artificial Sequence: Synthetic peptide
  Seed: ATMKSRWSG (BRAF V600M)
AIMKSRWSA

SEQ ID NO: 2373 - protein, 9 aa, Artificial Sequence
  Description of Artificial Sequence: Synthetic peptide
  Seed: ATMKSRWSG (BRAF V600M)
AIMKSRWSG

SEQ ID NO: 2374 - protein, 10 aa, Artificial Sequence
  Description of Artificial Sequence: Synthetic peptide
  Seed: ATMKSRWSGS (BRAF V600M)
AIMKSRWSGA

SEQ ID NO: 2375 - protein, 10 aa, Artificial Sequence
  Description of Artificial Sequence: Synthetic peptide
  Seed: ATMKSRWSGS (BRAF V600M)
AIMKSRWSGI

SEQ ID NO: 2376 - protein, 10 aa, Artificial Sequence
  Description of Artificial Sequence: Synthetic peptide
  Seed: ATMKSRWSGS (BRAF V600M)
AIMKSRWSGK

SEQ ID NO: 2377 - protein, 10 aa, Artificial Sequence
  Description of Artificial Sequence: Synthetic peptide
  Seed: ATMKSRWSGS (BRAF V600M)
AIMKSRWSGV

SEQ ID NO: 2378 - protein, 9 aa, Artificial Sequence
  Description of Artificial Sequence: Synthetic peptide
  Seed: ATMKSRWSG (BRAF V600M)
AIMKSRWSI

SEQ ID NO: 2379 - protein, 9 aa, Artificial Sequence
  Description of Artificial Sequence: Synthetic peptide
  Seed: ATMKSRWSG (BRAF V600M)
AIMKSRWSK

SEQ ID NO: 2380 - protein, 9 aa, Artificial Sequence
  Description of Artificial Sequence: Synthetic peptide
  Seed: ATMKSRWSG (BRAF V600M)
AIMKSRWSL

SEQ ID NO: 2381 - protein, 9 aa, Artificial Sequence
  Description of Artificial Sequence: Synthetic peptide
  Seed: ATMKSRWSG (BRAF V600M)
AIMKSRWSM

SEQ ID NO: 2382 - protein, 9 aa, Artificial Sequence
  Description of Artificial Sequence: Synthetic peptide
  Seed: ATMKSRWSG (BRAF V600M)
AIMKSRWSR

SEQ ID NO: 2383 - protein, 9 aa, Artificial Sequence
  Description of Artificial Sequence: Synthetic peptide
  Seed: ATMKSRWSG (BRAF V600M)
AIMKSRWSS

SEQ ID NO: 2384 - protein, 9 aa, Artificial Sequence
  Description of Artificial Sequence: Synthetic peptide
  Seed: ATMKSRWSG (BRAF V600M)
AIMKSRWSV

SEQ ID NO: 2385 - protein, 10 aa, Artificial Sequence
  Description of Artificial Sequence: Synthetic peptide
  Seed: ATMKSRWSGS (BRAF V600M)
AKMKSRWSGA

SEQ ID NO: 2386 - protein, 10 aa, Artificial Sequence
  Description of Artificial Sequence: Synthetic peptide
  Seed: ATMKSRWSGS (BRAF V600M)
AKMKSRWSGK

SEQ ID NO: 2387 - protein, 10 aa, Artificial Sequence
  Description of Artificial Sequence: Synthetic peptide
  Seed: ATMKSRWSGS (BRAF V600M)
AKMKSRWSGV

SEQ ID NO: 2388 - protein, 9 aa, Artificial Sequence
  Description of Artificial Sequence: Synthetic peptide
  Seed: ATMKSRWSG (BRAF V600M)
AKMKSRWSK

SEQ ID NO: 2389 - protein, 9 aa, Artificial Sequence
  Description of Artificial Sequence: Synthetic peptide
  Seed: ATMKSRWSG (BRAF V600M)
ALMKSRWSA

SEQ ID NO: 2390 - protein, 10 aa, Artificial Sequence
  Description of Artificial Sequence: Synthetic peptide
  Seed: ATMKSRWSGS (BRAF V600M)
ALMKSRWSGA

SEQ ID NO: 2391 - protein, 10 aa, Artificial Sequence
  Description of Artificial Sequence: Synthetic peptide
  Seed: ATMKSRWSGS (BRAF V600M)
ALMKSRWSGK

SEQ ID NO: 2392 - protein, 9 aa, Artificial Sequence
  Description of Artificial Sequence: Synthetic peptide
  Seed: ATMKSRWSG (BRAF V600M)
ALMKSRWSI

SEQ ID NO: 2393 - protein, 9 aa, Artificial Sequence
  Description of Artificial Sequence: Synthetic peptide
  Seed: ATMKSRWSG (BRAF V600M)
ALMKSRWSK

SEQ ID NO: 2394 - protein, 9 aa, Artificial Sequence
  Description of Artificial Sequence: Synthetic peptide
  Seed: ATMKSRWSG (BRAF V600M)
ALMKSRWSV

SEQ ID NO: 2395 - protein, 9 aa, Artificial Sequence
  Description of Artificial Sequence: Synthetic peptide
  Seed: ATMKSRWSG (BRAF V600M)
AMMKSRWSA

SEQ ID NO: 2396 - protein, 9 aa, Artificial Sequence
  Description of Artificial Sequence: Synthetic peptide
  Seed: ATMKSRWSG (BRAF V600M)
AMMKSRWSG

SEQ ID NO: 2397 - protein, 10 aa, Artificial Sequence
  Description of Artificial Sequence: Synthetic peptide
  Seed: ATMKSRWSGS (BRAF V600M)
AMMKSRWSGA

SEQ ID NO: 2398 - protein, 10 aa, Artificial Sequence
  Description of Artificial Sequence: Synthetic peptide
  Seed: ATMKSRWSGS (BRAF V600M)
AMMKSRWSGI

SEQ ID NO: 2399 - protein, 10 aa, Artificial Sequence
  Description of Artificial Sequence: Synthetic peptide
  Seed: ATMKSRWSGS (BRAF V600M)
AMMKSRWSGK

SEQ ID NO: 2400 - protein, 10 aa, Artificial Sequence
  Description of Artificial Sequence: Synthetic peptide
  Seed: ATMKSRWSGS (BRAF V600M)
AMMKSRWSGV

SEQ ID NO: 2401 - protein, 9 aa, Artificial Sequence
  Description of Artificial Sequence: Synthetic peptide
  Seed: ATMKSRWSG (BRAF V600M)
AMMKSRWSI

SEQ ID NO: 2402 - protein, 9 aa, Artificial Sequence
  Description of Artificial Sequence: Synthetic peptide
  Seed: ATMKSRWSG (BRAF V600M)
AMMKSRWSK

SEQ ID NO: 2403 - protein, 9 aa, Artificial Sequence
  Description of Artificial Sequence: Synthetic peptide
  Seed: ATMKSRWSG (BRAF V600M)
AMMKSRWSL

SEQ ID NO: 2404 - protein, 9 aa, Artificial Sequence
  Description of Artificial Sequence: Synthetic peptide
  Seed: ATMKSRWSG (BRAF V600M)
AMMKSRWSM

SEQ ID NO: 2405 - protein, 9 aa, Artificial Sequence
  Description of Artificial Sequence: Synthetic peptide
  Seed: ATMKSRWSG (BRAF V600M)
AMMKSRWSR

SEQ ID NO: 2406 - protein, 9 aa, Artificial Sequence
  Description of Artificial Sequence: Synthetic peptide
  Seed: ATMKSRWSG (BRAF V600M)
AMMKSRWSS

SEQ ID NO: 2407 - protein, 9 aa, Artificial Sequence
  Description of Artificial Sequence: Synthetic peptide
  Seed: ATMKSRWSG (BRAF V600M)
AMMKSRWSV

SEQ ID NO: 2408 - protein, 9 aa, Artificial Sequence
  Description of Artificial Sequence: Synthetic peptide
  Seed: ATMKSRWSG (BRAF V600M)
AMMKSRWSY

SEQ ID NO: 2409 - protein, 9 aa, Artificial Sequence
  Description of Artificial Sequence: Synthetic peptide
  Seed: ATMKSRWSG (BRAF V600M)
ANMKSRWSA

SEQ ID NO: 2410 - protein, 10 aa, Artificial Sequence
  Description of Artificial Sequence: Synthetic peptide
  Seed: ATMKSRWSGS (BRAF V600M)
ANMKSRWSGA

SEQ ID NO: 2411 - protein, 10 aa, Artificial Sequence
  Description of Artificial Sequence: Synthetic peptide
  Seed: ATMKSRWSGS (BRAF V600M)
ANMKSRWSGK

SEQ ID NO: 2412 - protein, 9 aa, Artificial Sequence
  Description of Artificial Sequence: Synthetic peptide
  Seed: ATMKSRWSG (BRAF V600M)
ANMKSRWSK

SEQ ID NO: 2413 - protein, 9 aa, Artificial Sequence
  Description of Artificial Sequence: Synthetic peptide
  Seed: ATMKSRWSG (BRAF V600M)
ANMKSRWSV

SEQ ID NO: 2414 - protein, 10 aa, Artificial Sequence
  Description of Artificial Sequence: Synthetic peptide
  Seed: ATMKSRWSGS (BRAF V600M)
APMKSRWSGK

SEQ ID NO: 2415 - protein, 9 aa, Artificial Sequence
  Description of Artificial Sequence: Synthetic peptide
  Seed: ATMKSRWSG (BRAF V600M)
AQMKSRWSA

SEQ ID NO: 2416 - protein, 10 aa, Artificial Sequence
  Description of Artificial Sequence: Synthetic peptide
  Seed: ATMKSRWSGS (BRAF V600M)
AQMKSRWSGA

SEQ ID NO: 2417 - protein, 10 aa, Artificial Sequence
  Description of Artificial Sequence: Synthetic peptide
  Seed: ATMKSRWSGS (BRAF V600M)
AQMKSRWSGK

SEQ ID NO: 2418 - protein, 10 aa, Artificial Sequence
  Description of Artificial Sequence: Synthetic peptide
  Seed: ATMKSRWSGS (BRAF V600M)
AQMKSRWSGV

SEQ ID NO: 2419 - protein, 9 aa, Artificial Sequence
  Description of Artificial Sequence: Synthetic peptide
  Seed: ATMKSRWSG (BRAF V600M)
AQMKSRWSI

SEQ ID NO: 2420 - protein, 9 aa, Artificial Sequence
  Description of Artificial Sequence: Synthetic peptide
  Seed: ATMKSRWSG (BRAF V600M)
AQMKSRWSK

SEQ ID NO: 2421 - protein, 9 aa, Artificial Sequence
  Description of Artificial Sequence: Synthetic peptide
  Seed: ATMKSRWSG (BRAF V600M)
AQMKSRWSR

SEQ ID NO: 2422 - protein, 9 aa, Artificial Sequence
  Description of Artificial Sequence: Synthetic peptide
  Seed: ATMKSRWSG (BRAF V600M)
AQMKSRWSV

SEQ ID NO: 2423 - protein, 10 aa, Artificial Sequence
  Description of Artificial Sequence: Synthetic peptide
  Seed: ATMKSRWSGS (BRAF V600M)
ARMKSRWSGA

SEQ ID NO: 2424 - protein, 10 aa, Artificial Sequence
  Description of Artificial Sequence: Synthetic peptide
  Seed: ATMKSRWSGS (BRAF V600M)
ARMKSRWSGK

SEQ ID NO: 2425 - protein, 10 aa, Artificial Sequence
  Description of Artificial Sequence: Synthetic peptide
  Seed: ATMKSRWSGS (BRAF V600M)
ARMKSRWSGM

SEQ ID NO: 2426 - protein, 10 aa, Artificial Sequence
  Description of Artificial Sequence: Synthetic peptide
  Seed: ATMKSRWSGS (BRAF V600M)
ARMKSRWSGV

SEQ ID NO: 2427 - protein, 9 aa, Artificial Sequence
  Description of Artificial Sequence: Synthetic peptide
  Seed: ATMKSRWSG (BRAF V600M)
ARMKSRWSK

SEQ ID NO: 2428 - protein, 9 aa, Artificial Sequence
  Description of Artificial Sequence: Synthetic peptide
  Seed: ATMKSRWSG (BRAF V600M)
ASMKSRWSA

SEQ ID NO: 2429 - protein, 9 aa, Artificial Sequence
  Description of Artificial Sequence: Synthetic peptide
  Seed: ATMKSRWSG (BRAF V600M)
ASMKSRWSC

SEQ ID NO: 2430 - protein, 9 aa, Artificial Sequence
  Description of Artificial Sequence: Synthetic peptide
  Seed: ATMKSRWSG (BRAF V600M)
ASMKSRWSF

SEQ ID NO: 2431 - protein, 9 aa, Artificial Sequence
  Description of Artificial Sequence: Synthetic peptide
  Seed: ATMKSRWSG (BRAF V600M)
ASMKSRWSG

SEQ ID NO: 2432 - protein, 10 aa, Artificial Sequence
  Description of Artificial Sequence: Synthetic peptide
  Seed: ATMKSRWSGS (BRAF V600M)
ASMKSRWSGA

SEQ ID NO: 2433 - protein, 10 aa, Artificial Sequence
  Description of Artificial Sequence: Synthetic peptide
  Seed: ATMKSRWSGS (BRAF V600M)
ASMKSRWSGI

SEQ ID NO: 2434 - protein, 10 aa, Artificial Sequence
  Description of Artificial Sequence: Synthetic peptide
  Seed: ATMKSRWSGS (BRAF V600M)
ASMKSRWSGK

SEQ ID NO: 2435 - protein, 10 aa, Artificial Sequence
  Description of Artificial Sequence: Synthetic peptide
  Seed: ATMKSRWSGS (BRAF V600M)
ASMKSRWSGL

SEQ ID NO: 2436 - protein, 10 aa, Artificial Sequence
  Description of Artificial Sequence: Synthetic peptide
  Seed: ATMKSRWSGS (BRAF V600M)
ASMKSRWSGM

SEQ ID NO: 2437 - protein, 10 aa, Artificial Sequence
  Description of Artificial Sequence: Synthetic peptide
  Seed: ATMKSRWSGS (BRAF V600M)
ASMKSRWSGR

SEQ ID NO: 2438 - protein, 10 aa, Artificial Sequence
  Description of Artificial Sequence: Synthetic peptide
  Seed: ATMKSRWSGS (BRAF V600M)
ASMKSRWSGS

SEQ ID NO: 2439 - protein, 10 aa, Artificial Sequence
  Description of Artificial Sequence: Synthetic peptide
  Seed: ATMKSRWSGS (BRAF V600M)
ASMKSRWSGT

SEQ ID NO: 2440 - protein, 10 aa, Artificial Sequence
  Description of Artificial Sequence: Synthetic peptide
  Seed: ATMKSRWSGS (BRAF V600M)
ASMKSRWSGV

SEQ ID NO: 2441 - protein, 10 aa, Artificial Sequence
  Description of Artificial Sequence: Synthetic peptide
  Seed: ATMKSRWSGS (BRAF V600M)
ASMKSRWSGY

SEQ ID NO: 2442 - protein, 9 aa, Artificial Sequence
  Description of Artificial Sequence: Synthetic peptide
  Seed: ATMKSRWSG (BRAF V600M)
ASMKSRWSH

SEQ ID NO: 2443 - protein, 9 aa, Artificial Sequence
  Description of Artificial Sequence: Synthetic peptide
  Seed: ATMKSRWSG (BRAF V600M)
ASMKSRWSI

SEQ ID NO: 2444 - protein, 9 aa, Artificial Sequence
  Description of Artificial Sequence: Synthetic peptide
  Seed: ATMKSRWSG (BRAF V600M)
ASMKSRWSK

SEQ ID NO: 2445 - protein, 9 aa, Artificial Sequence
  Description of Artificial Sequence: Synthetic peptide
  Seed: ATMKSRWSG (BRAF V600M)
ASMKSRWSL

SEQ ID NO: 2446 - protein, 9 aa, Artificial Sequence
  Description of Artificial Sequence: Synthetic peptide
  Seed: ATMKSRWSG (BRAF V600M)
ASMKSRWSM

SEQ ID NO: 2447 - protein, 9 aa, Artificial Sequence
  Description of Artificial Sequence: Synthetic peptide
  Seed: ATMKSRWSG (BRAF V600M)
ASMKSRWSN

SEQ ID NO: 2448 - protein, 9 aa, Artificial Sequence
  Description of Artificial Sequence: Synthetic peptide
  Seed: ATMKSRWSG (BRAF V600M)
ASMKSRWSP

SEQ ID NO: 2449 - protein, 9 aa, Artificial Sequence
  Description of Artificial Sequence: Synthetic peptide
  Seed: ATMKSRWSG (BRAF V600M)
ASMKSRWSQ

SEQ ID NO: 2450 - protein, 9 aa, Artificial Sequence
  Description of Artificial Sequence: Synthetic peptide
  Seed: ATMKSRWSG (BRAF V600M)
ASMKSRWSR

SEQ ID NO: 2451 - protein, 9 aa, Artificial Sequence
  Description of Artificial Sequence: Synthetic peptide
  Seed: ATMKSRWSG (BRAF V600M)
ASMKSRWSS

SEQ ID NO: 2452 - protein, 9 aa, Artificial Sequence
  Description of Artificial Sequence: Synthetic peptide
  Seed: ATMKSRWSG (BRAF V600M)
ASMKSRWST

SEQ ID NO: 2453 - protein, 9 aa, Artificial Sequence
  Description of Artificial Sequence: Synthetic peptide
  Seed: ATMKSRWSG (BRAF V600M)
ASMKSRWSV

SEQ ID NO: 2454 - protein, 9 aa, Artificial Sequence
  Description of Artificial Sequence: Synthetic peptide
  Seed: ATMKSRWSG (BRAF V600M)
ASMKSRWSY

SEQ ID NO: 2455 - protein, 9 aa, Artificial Sequence
  Description of Artificial Sequence: Synthetic peptide
  Seed: ATMKSRWSG (BRAF V600M)
ATMKSRWSA

SEQ ID NO: 2456 - protein, 9 aa, Artificial Sequence
  Description of Artificial Sequence: Synthetic peptide
  Seed: ATMKSRWSG (BRAF V600M)
ATMKSRWSC

SEQ ID NO: 2457 - protein, 9 aa, Artificial Sequence
  Description of Artificial Sequence: Synthetic peptide
  Seed: ATMKSRWSG (BRAF V600M)
ATMKSRWSE

SEQ ID NO: 2458 - protein, 9 aa, Artificial Sequence
  Description of Artificial Sequence: Synthetic peptide
  Seed: ATMKSRWSG (BRAF V600M)
ATMKSRWSF

SEQ ID NO: 2459 - protein, 10 aa, Artificial Sequence
  Description of Artificial Sequence: Synthetic peptide
  Seed: ATMKSRWSGS (BRAF V600M)
ATMKSRWSGA

SEQ ID NO: 2460 - protein, 10 aa, Artificial Sequence
  Description of Artificial Sequence: Synthetic peptide
  Seed: ATMKSRWSGS (BRAF V600M)
ATMKSRWSGF

SEQ ID NO: 2461 - protein, 10 aa, Artificial Sequence
  Description of Artificial Sequence: Synthetic peptide
  Seed: ATMKSRWSGS (BRAF V600M)
ATMKSRWSGG

SEQ ID NO: 2462 - protein, 10 aa, Artificial Sequence
  Description of Artificial Sequence: Synthetic peptide
  Seed: ATMKSRWSGS (BRAF V600M)
ATMKSRWSGI

SEQ ID NO: 2463 - protein, 10 aa, Artificial Sequence
  Description of Artificial Sequence: Synthetic peptide
  Seed: ATMKSRWSGS (BRAF V600M)
ATMKSRWSGK

SEQ ID NO: 2464 - protein, 10 aa, Artificial Sequence
  Description of Artificial Sequence: Synthetic peptide
  Seed: ATMKSRWSGS (BRAF V600M)
ATMKSRWSGL

SEQ ID NO: 2465 - protein, 10 aa, Artificial Sequence
  Description of Artificial Sequence: Synthetic peptide
  Seed: ATMKSRWSGS (BRAF V600M)
ATMKSRWSGM

SEQ ID NO: 2466 - protein, 10 aa, Artificial Sequence
  Description of Artificial Sequence: Synthetic peptide
  Seed: ATMKSRWSGS (BRAF V600M)
ATMKSRWSGR

SEQ ID NO: 2467 - protein, 10 aa, Artificial Sequence
  Description of Artificial Sequence: Synthetic peptide
  Seed: ATMKSRWSGS (BRAF V600M)
ATMKSRWSGT

SEQ ID NO: 2468 - protein, 10 aa, Artificial Sequence
  Description of Artificial Sequence: Synthetic peptide
  Seed: ATMKSRWSGS (BRAF V600M)
ATMKSRWSGV

SEQ ID NO: 2469 - protein, 10 aa, Artificial Sequence
  Description of Artificial Sequence: Synthetic peptide
  Seed: ATMKSRWSGS (BRAF V600M)
ATMKSRWSGY

SEQ ID NO: 2470 - protein, 9 aa, Artificial Sequence
  Description of Artificial Sequence: Synthetic peptide
  Seed: ATMKSRWSG (BRAF V600M)
ATMKSRWSH

SEQ ID NO: 2471 - protein, 9 aa, Artificial Sequence
  Description of Artificial Sequence: Synthetic peptide
  Seed: ATMKSRWSG (BRAF V600M)
ATMKSRWSI

SEQ ID NO: 2472 - protein, 9 aa, Artificial Sequence
  Description of Artificial Sequence: Synthetic peptide
  Seed: ATMKSRWSG (BRAF V600M)
ATMKSRWSL

SEQ ID NO: 2473 - protein, 9 aa, Artificial Sequence
  Description of Artificial Sequence: Synthetic peptide
  Seed: ATMKSRWSG (BRAF V600M)
ATMKSRWSM

SEQ ID NO: 2474 - protein, 9 aa, Artificial Sequence
  Description of Artificial Sequence: Synthetic peptide
  Seed: ATMKSRWSG (BRAF V600M)
ATMKSRWSN

SEQ ID NO: 2475 - protein, 9 aa, Artificial Sequence
  Description of Artificial Sequence: Synthetic peptide
  Seed: ATMKSRWSG (BRAF V600M)
ATMKSRWSP

SEQ ID NO: 2476 - protein, 9 aa, Artificial Sequence
  Description of Artificial Sequence: Synthetic peptide
  Seed: ATMKSRWSG (BRAF V600M)
ATMKSRWSQ

SEQ ID NO: 2477 - protein, 9 aa, Artificial Sequence
  Description of Artificial Sequence: Synthetic peptide
  Seed: ATMKSRWSG (BRAF V600M)
ATMKSRWSR

SEQ ID NO: 2478 - protein, 9 aa, Artificial Sequence
  Description of Artificial Sequence: Synthetic peptide
  Seed: ATMKSRWSG (BRAF V600M)
ATMKSRWSS

SEQ ID NO: 2479 - protein, 9 aa, Artificial Sequence
  Description of Artificial Sequence: Synthetic peptide
  Seed: ATMKSRWSG (BRAF V600M)
ATMKSRWST

SEQ ID NO: 2480 - protein, 9 aa, Artificial Sequence
  Description of Artificial Sequence: Synthetic peptide
  Seed: ATMKSRWSG (BRAF V600M)
ATMKSRWSV

SEQ ID NO: 2481 - protein, 9 aa, Artificial Sequence
  Description of Artificial Sequence: Synthetic peptide
  Seed: ATMKSRWSG (BRAF V600M)
ATMKSRWSY

SEQ ID NO: 2482 - protein, 9 aa, Artificial Sequence
  Description of Artificial Sequence: Synthetic peptide
  Seed: ATMKSRWSG (BRAF V600M)
AVMKSRWSA

SEQ ID NO: 2483 - protein, 9 aa, Artificial Sequence
  Description of Artificial Sequence: Synthetic peptide
  Seed: ATMKSRWSG (BRAF V600M)
AVMKSRWSG

SEQ ID NO: 2484 - protein, 10 aa, Artificial Sequence
  Description of Artificial Sequence: Synthetic peptide
  Seed: ATMKSRWSGS (BRAF V600M)
AVMKSRWSGA

SEQ ID NO: 2485 - protein, 10 aa, Artificial Sequence
  Description of Artificial Sequence: Synthetic peptide
  Seed: ATMKSRWSGS (BRAF V600M)
AVMKSRWSGI

SEQ ID NO: 2486 - protein, 10 aa, Artificial Sequence
  Description of Artificial Sequence: Synthetic peptide
  Seed: ATMKSRWSGS (BRAF V600M)
AVMKSRWSGK

SEQ ID NO: 2487 - protein, 10 aa, Artificial Sequence
  Description of Artificial Sequence: Synthetic peptide
  Seed: ATMKSRWSGS (BRAF V600M)
AVMKSRWSGL

SEQ ID NO: 2488 - protein, 10 aa, Artificial Sequence
  Description of Artificial Sequence: Synthetic peptide
  Seed: ATMKSRWSGS (BRAF V600M)
AVMKSRWSGM

SEQ ID NO: 2489 - protein, 10 aa, Artificial Sequence
  Description of Artificial Sequence: Synthetic peptide
  Seed: ATMKSRWSGS (BRAF V600M)
AVMKSRWSGV

SEQ ID NO: 2490 - protein, 9 aa, Artificial Sequence
  Description of Artificial Sequence: Synthetic peptide
  Seed: ATMKSRWSG (BRAF V600M)
AVMKSRWSI

SEQ ID NO: 2491 - protein, 9 aa, Artificial Sequence
  Description of Artificial Sequence: Synthetic peptide
  Seed: ATMKSRWSG (BRAF V600M)
AVMKSRWSK

SEQ ID NO: 2492 - protein, 9 aa, Artificial Sequence
  Description of Artificial Sequence: Synthetic peptide
  Seed: ATMKSRWSG (BRAF V600M)
AVMKSRWSL

SEQ ID NO: 2493 - protein, 9 aa, Artificial Sequence
  Description of Artificial Sequence: Synthetic peptide
  Seed: ATMKSRWSG (BRAF V600M)
AVMKSRWSM

SEQ ID NO: 2494 - protein, 9 aa, Artificial Sequence
  Description of Artificial Sequence: Synthetic peptide
  Seed: ATMKSRWSG (BRAF V600M)
AVMKSRWSR

SEQ ID NO: 2495 - protein, 9 aa, Artificial Sequence
  Description of Artificial Sequence: Synthetic peptide
  Seed: ATMKSRWSG (BRAF V600M)
AVMKSRWSS

SEQ ID NO: 2496 - protein, 9 aa, Artificial Sequence
  Description of Artificial Sequence: Synthetic peptide
  Seed: ATMKSRWSG (BRAF V600M)
AVMKSRWST

SEQ ID NO: 2497 - protein, 9 aa, Artificial Sequence
  Description of Artificial Sequence: Synthetic peptide
  Seed: ATMKSRWSG (BRAF V600M)
AVMKSRWSV

SEQ ID NO: 2498 - protein, 9 aa, Artificial Sequence
  Description of Artificial Sequence: Synthetic peptide
  Seed: ATMKSRWSG (BRAF V600M)
AVMKSRWSY

SEQ ID NO: 2499 - protein, 9 aa, Artificial Sequence
  Description of Artificial Sequence: Synthetic peptide
  Seed: ATMKSRWSG (BRAF V600M)
AWMKSRWSA

SEQ ID NO: 2500 - protein, 10 aa, Artificial Sequence
  Description of Artificial Sequence: Synthetic peptide
  Seed: ATMKSRWSGS (BRAF V600M)
AWMKSRWSGA

SEQ ID NO: 2501 - protein, 10 aa, Artificial Sequence
  Description of Artificial Sequence: Synthetic peptide
  Seed: ATMKSRWSGS (BRAF V600M)
AWMKSRWSGI

SEQ ID NO: 2502 - protein, 10 aa, Artificial Sequence
  Description of Artificial Sequence: Synthetic peptide
  Seed: ATMKSRWSGS (BRAF V600M)
AWMKSRWSGK

SEQ ID NO: 2503 - protein, 10 aa, Artificial Sequence
  Description of Artificial Sequence: Synthetic peptide
  Seed: ATMKSRWSGS (BRAF V600M)
AWMKSRWSGV

SEQ ID NO: 2504 - protein, 9 aa, Artificial Sequence
  Description of Artificial Sequence: Synthetic peptide
  Seed: ATMKSRWSG (BRAF V600M)
AWMKSRWSI

SEQ ID NO: 2505 - protein, 9 aa, Artificial Sequence
  Description of Artificial Sequence: Synthetic peptide
  Seed: ATMKSRWSG (BRAF V600M)
AWMKSRWSK

SEQ ID NO: 2506 - protein, 9 aa, Artificial Sequence
  Description of Artificial Sequence: Synthetic peptide
  Seed: ATMKSRWSG (BRAF V600M)
AWMKSRWSV

SEQ ID NO: 2507 - protein, 9 aa, Artificial Sequence
  Description of Artificial Sequence: Synthetic peptide
  Seed: ATMKSRWSG (BRAF V600M)
AYMKSRWSA

SEQ ID NO: 2508 - protein, 9 aa, Artificial Sequence
  Description of Artificial Sequence: Synthetic peptide
  Seed: ATMKSRWSG (BRAF V600M)
AYMKSRWSG

SEQ ID NO: 2509 - protein, 10 aa, Artificial Sequence
  Description of Artificial Sequence: Synthetic peptide
  Seed: ATMKSRWSGS (BRAF V600M)
AYMKSRWSGA

SEQ ID NO: 2510 - protein, 10 aa, Artificial Sequence
  Description of Artificial Sequence: Synthetic peptide
  Seed: ATMKSRWSGS (BRAF V600M)
AYMKSRWSGI

SEQ ID NO: 2511 - protein, 10 aa, Artificial Sequence
  Description of Artificial Sequence: Synthetic peptide
  Seed: ATMKSRWSGS (BRAF V600M)
AYMKSRWSGL

SEQ ID NO: 2512 - protein, 10 aa, Artificial Sequence
  Description of Artificial Sequence: Synthetic peptide
  Seed: ATMKSRWSGS (BRAF V600M)
AYMKSRWSGM

SEQ ID NO: 2513 - protein, 10 aa, Artificial Sequence
  Description of Artificial Sequence: Synthetic peptide
  Seed: ATMKSRWSGS (BRAF V600M)
AYMKSRWSGV

SEQ ID NO: 2514 - protein, 9 aa, Artificial Sequence
  Description of Artificial Sequence: Synthetic peptide
  Seed: ATMKSRWSG (BRAF V600M)
AYMKSRWSI

SEQ ID NO: 2515 - protein, 9 aa, Artificial Sequence
  Description of Artificial Sequence: Synthetic peptide
  Seed: ATMKSRWSG (BRAF V600M)
AYMKSRWSK

SEQ ID NO: 2516 - protein, 9 aa, Artificial Sequence
  Description of Artificial Sequence: Synthetic peptide
  Seed: ATMKSRWSG (BRAF V600M)
AYMKSRWSL

SEQ ID NO: 2517 - protein, 9 aa, Artificial Sequence
  Description of Artificial Sequence: Synthetic peptide
  Seed: ATMKSRWSG (BRAF V600M)
AYMKSRWSM

SEQ ID NO: 2518 - protein, 9 aa, Artificial Sequence
  Description of Artificial Sequence: Synthetic peptide
  Seed: ATMKSRWSG (BRAF V600M)
AYMKSRWSR

SEQ ID NO: 2519 - protein, 9 aa, Artificial Sequence
  Description of Artificial Sequence: Synthetic peptide
  Seed: ATMKSRWSG (BRAF V600M)
AYMKSRWSS

SEQ ID NO: 2520 - protein, 9 aa, Artificial Sequence
  Description of Artificial Sequence: Synthetic peptide
  Seed: ATMKSRWSG (BRAF V600M)
AYMKSRWSV

SEQ ID NO: 2521 - protein, 10 aa, Artificial Sequence
  Description of Artificial Sequence: Synthetic peptide
  Seed: DFGLATMKSR (BRAF V600M)
DIGLATMKSR

SEQ ID NO: 2522 - protein, 10 aa, Artificial Sequence
  Description of Artificial Sequence: Synthetic peptide
  Seed: DFGLATMKSR (BRAF V600M)
DMGLATMKSR

SEQ ID NO: 2523 - protein, 10 aa, Artificial Sequence
  Description of Artificial Sequence: Synthetic peptide
  Seed: DFGLATMKSR (BRAF V600M)
DSGLATMKSR

SEQ ID NO: 2524 - protein, 10 aa, Artificial Sequence
  Description of Artificial Sequence: Synthetic peptide
  Seed: DFGLATMKSR (BRAF V600M)
DTGLATMKSR

SEQ ID NO: 2525 - protein, 10 aa, Artificial Sequence
  Description of Artificial Sequence: Synthetic peptide
  Seed: DFGLATMKSR (BRAF V600M)
DVGLATMKSR

SEQ ID NO: 2526 - protein, 10 aa, Artificial Sequence
  Description of Artificial Sequence: Synthetic peptide
  Seed: DFGLATMKSR (BRAF V600M)
DWGLATMKSR

SEQ ID NO: 2527 - protein, 10 aa, Artificial Sequence
  Description of Artificial Sequence: Synthetic peptide
  Seed: DFGLATMKSR (BRAF V600M)
DYGLATMKSR

SEQ ID NO: 2528 - protein, 9 aa, Artificial Sequence
  Description of Artificial Sequence: Synthetic peptide
  Seed: FGLATMKSR (BRAF V600M)
FALATMKSR

SEQ ID NO: 2529 - protein, 10 aa, Artificial Sequence
  Description of Artificial Sequence: Synthetic peptide
  Seed: FGLATMKSRW (BRAF V600M)
FALATMKSRF

SEQ ID NO: 2530 - protein, 10 aa, Artificial Sequence
  Description of Artificial Sequence: Synthetic peptide
  Seed: FGLATMKSRW (BRAF V600M)
FALATMKSRW

SEQ ID NO: 2531 - protein, 10 aa, Artificial Sequence
  Description of Artificial Sequence: Synthetic peptide
  Seed: FGLATMKSRW (BRAF V600M)
FALATMKSRY

SEQ ID NO: 2532 - protein, 10 aa, Artificial Sequence
  Description of Artificial Sequence: Synthetic peptide
  Seed: FGLATMKSRW (BRAF V600M)
FCLATMKSRW

SEQ ID NO: 2533 - protein, 9 aa, Artificial Sequence
  Description of Artificial Sequence: Synthetic peptide
  Seed: FGLATMKSR (BRAF V600M)
FFLATMKSK

SEQ ID NO: 2534 - protein, 9 aa, Artificial Sequence
  Description of Artificial Sequence: Synthetic peptide
  Seed: FGLATMKSR (BRAF V600M)
FFLATMKSR

SEQ ID NO: 2535 - protein, 9 aa, Artificial Sequence
  Description of Artificial Sequence: Synthetic peptide
  Seed: FGLATMKSR (BRAF V600M)
FILATMKSR

SEQ ID NO: 2536 - protein, 10 aa, Artificial Sequence
  Description of Artificial Sequence: Synthetic peptide
  Seed: FGLATMKSRW (BRAF V600M)
FILATMKSRW

SEQ ID NO: 2537 - protein, 9 aa, Artificial Sequence
  Description of Artificial Sequence: Synthetic peptide
  Seed: FGLATMKSR (BRAF V600M)
FLLATMKSR

SEQ ID NO: 2538 - protein, 10 aa, Artificial Sequence
  Description of Artificial Sequence: Synthetic peptide
  Seed: FGLATMKSRW (BRAF V600M)
FLLATMKSRW

SEQ ID NO: 2539 - protein, 9 aa, Artificial Sequence
  Description of Artificial Sequence: Synthetic peptide
  Seed: FGLATMKSR (BRAF V600M)
FMLATMKSK

SEQ ID NO: 2540 - protein, 9 aa, Artificial Sequence
  Description of Artificial Sequence: Synthetic peptide
  Seed: FGLATMKSR (BRAF V600M)
FMLATMKSR

SEQ ID NO: 2541 - protein, 10 aa, Artificial Sequence
  Description of Artificial Sequence: Synthetic peptide
  Seed: FGLATMKSRW (BRAF V600M)
FMLATMKSRW

SEQ ID NO: 2542 - protein, 9 aa, Artificial Sequence
  Description of Artificial Sequence: Synthetic peptide
  Seed: FGLATMKSR (BRAF V600M)
FNLATMKSR

SEQ ID NO: 2543 - protein, 10 aa, Artificial Sequence
  Description of Artificial Sequence: Synthetic peptide
  Seed: FGLATMKSRW (BRAF V600M)
FNLATMKSRW

SEQ ID NO: 2544 - protein, 9 aa, Artificial Sequence
  Description of Artificial Sequence: Synthetic peptide
  Seed: FGLATMKSR (BRAF V600M)
FQLATMKSR

SEQ ID NO: 2545 - protein, 10 aa, Artificial Sequence
  Description of Artificial Sequence: Synthetic peptide
  Seed: FGLATMKSRW (BRAF V600M)
FQLATMKSRW

SEQ ID NO: 2546 - protein, 9 aa, Artificial Sequence
  Description of Artificial Sequence: Synthetic peptide
  Seed: FGLATMKSR (BRAF V600M)
FSLATMKSR

SEQ ID NO: 2547 - protein, 10 aa, Artificial Sequence
  Description of Artificial Sequence: Synthetic peptide
  Seed: FGLATMKSRW (BRAF V600M)
FSLATMKSRF

SEQ ID NO: 2548 - protein, 10 aa, Artificial Sequence
  Description of Artificial Sequence: Synthetic peptide
  Seed: FGLATMKSRW (BRAF V600M)
FSLATMKSRI

SEQ ID NO: 2549 - protein, 10 aa, Artificial Sequence
  Description of Artificial Sequence: Synthetic peptide
  Seed: FGLATMKSRW (BRAF V600M)
FSLATMKSRL

SEQ ID NO: 2550 - protein, 10 aa, Artificial Sequence
  Description of Artificial Sequence: Synthetic peptide
  Seed: FGLATMKSRW (BRAF V600M)
FSLATMKSRM

SEQ ID NO: 2551 - protein, 10 aa, Artificial Sequence
  Description of Artificial Sequence: Synthetic peptide
  Seed: FGLATMKSRW (BRAF V600M)
FSLATMKSRY

SEQ ID NO: 2552 - protein, 10 aa, Artificial Sequence
  Description of Artificial Sequence: Synthetic peptide
  Seed: FGLATMKSRW (BRAF V600M)
FTLATMKSRF

SEQ ID NO: 2553 - protein, 10 aa, Artificial Sequence
  Description of Artificial Sequence: Synthetic peptide
  Seed: FGLATMKSRW (BRAF V600M)
FTLATMKSRI

SEQ ID NO: 2554 - protein, 10 aa, Artificial Sequence
  Description of Artificial Sequence: Synthetic peptide
  Seed: FGLATMKSRW (BRAF V600M)
FTLATMKSRL

SEQ ID NO: 2555 - protein, 10 aa, Artificial Sequence
  Description of Artificial Sequence: Synthetic peptide
  Seed: FGLATMKSRW (BRAF V600M)
FTLATMKSRM

SEQ ID NO: 2556 - protein, 10 aa, Artificial Sequence
  Description of Artificial Sequence: Synthetic peptide
  Seed: FGLATMKSRW (BRAF V600M)
FTLATMKSRY

SEQ ID NO: 2557 - protein, 10 aa, Artificial Sequence
  Description of Artificial Sequence: Synthetic peptide
  Seed: FGLATMKSRW (BRAF V600M)
FVLATMKSRF

SEQ ID NO: 2558 - protein, 10 aa, Artificial Sequence
  Description of Artificial Sequence: Synthetic peptide
  Seed: FGLATMKSRW (BRAF V600M)
FVLATMKSRW

SEQ ID NO: 2559 - protein, 10 aa, Artificial Sequence
  Description of Artificial Sequence: Synthetic peptide
  Seed: FGLATMKSRW (BRAF V600M)
FVLATMKSRY

SEQ ID NO: 2560 - protein, 9 aa, Artificial Sequence
  Description of Artificial Sequence: Synthetic peptide
  Seed: FGLATMKSR (BRAF V600M)
FWLATMKSR

SEQ ID NO: 2561 - protein, 9 aa, Artificial Sequence
  Description of Artificial Sequence: Synthetic peptide
  Seed: FGLATMKSR (BRAF V600M)
FYLATMKSK

SEQ ID NO: 2562 - protein, 9 aa, Artificial Sequence
  Description of Artificial Sequence: Synthetic peptide
  Seed: FGLATMKSR (BRAF V600M)
FYLATMKSR

SEQ ID NO: 2563 - protein, 11 aa, Artificial Sequence
  Description of Artificial Sequence: Synthetic peptide
  Seed: KIGDFGLATMK (BRAF V600M)
KAGDFGLATMK

SEQ ID NO: 2564 - protein, 11 aa, Artificial Sequence
  Description of Artificial Sequence: Synthetic peptide
  Seed: KIGDFGLATMK (BRAF V600M)
KAGDFGLATMR

SEQ ID NO: 2565 - protein, 11 aa, Artificial Sequence
  Description of Artificial Sequence: Synthetic peptide
  Seed: KIGDFGLATMK (BRAF V600M)
KFGDFGLATMK

SEQ ID NO: 2566 - protein, 11 aa, Artificial Sequence
  Description of Artificial Sequence: Synthetic peptide
  Seed: KIGDFGLATMK (BRAF V600M)
KFGDFGLATMR

SEQ ID NO: 2567 - protein, 11 aa, Artificial Sequence
  Description of Artificial Sequence: Synthetic peptide
  Seed: KIGDFGLATMK (BRAF V600M)
KGGDFGLATMR

SEQ ID NO: 2568 - protein, 11 aa, Artificial Sequence
  Description of Artificial Sequence: Synthetic peptide
  Seed: KIGDFGLATMK (BRAF V600M)
KIGDFGLATMR

SEQ ID NO: 2569 - protein, 11 aa, Artificial Sequence
  Description of Artificial Sequence: Synthetic peptide
  Seed: KIGDFGLATMK (BRAF V600M)
KLGDFGLATMK

SEQ ID NO: 2570 - protein, 11 aa, Artificial Sequence
  Description of Artificial Sequence: Synthetic peptide
  Seed: KIGDFGLATMK (BRAF V600M)
KLGDFGLATMR

SEQ ID NO: 2571 - protein, 11 aa, Artificial Sequence
  Description of Artificial Sequence: Synthetic peptide
  Seed: KIGDFGLATMK (BRAF V600M)
KLGDFGLATMY

SEQ ID NO: 2572 - protein, 11 aa, Artificial Sequence
  Description of Artificial Sequence: Synthetic peptide
  Seed: KIGDFGLATMK (BRAF V600M)
KMGDFGLATMR

SEQ ID NO: 2573 - protein, 11 aa, Artificial Sequence
  Description of Artificial Sequence: Synthetic peptide
  Seed: KIGDFGLATMK (BRAF V600M)
KMGDFGLATMY

SEQ ID NO: 2574 - protein, 11 aa, Artificial Sequence
  Description of Artificial Sequence: Synthetic peptide
  Seed: KIGDFGLATMK (BRAF V600M)
KNGDFGLATMR

SEQ ID NO: 2575 - protein, 11 aa, Artificial Sequence
  Description of Artificial Sequence: Synthetic peptide
  Seed: KIGDFGLATMK (BRAF V600M)
KQGDFGLATMK

SEQ ID NO: 2576 - protein, 11 aa, Artificial Sequence
  Description of Artificial Sequence: Synthetic peptide
  Seed: KIGDFGLATMK (BRAF V600M)
KQGDFGLATMR

SEQ ID NO: 2577 - protein, 11 aa, Artificial Sequence
  Description of Artificial Sequence: Synthetic peptide
  Seed: KIGDFGLATMK (BRAF V600M)
KSGDFGLATMK

SEQ ID NO: 2578 - protein, 11 aa, Artificial Sequence
  Description of Artificial Sequence: Synthetic peptide
  Seed: KIGDFGLATMK (BRAF V600M)
KSGDFGLATMR

SEQ ID NO: 2579 - protein, 11 aa, Artificial Sequence
  Description of Artificial Sequence: Synthetic peptide
  Seed: KIGDFGLATMK (BRAF V600M)
KVGDFGLATMR

SEQ ID NO: 2580 - protein, 11 aa, Artificial Sequence
  Description of Artificial Sequence: Synthetic peptide
  Seed: KIGDFGLATMK (BRAF V600M)
KWGDFGLATMK

SEQ ID NO: 2581 - protein, 11 aa, Artificial Sequence
  Description of Artificial Sequence: Synthetic peptide
  Seed: KIGDFGLATMK (BRAF V600M)
KWGDFGLATMR

SEQ ID NO: 2582 - protein, 11 aa, Artificial Sequence
  Description of Artificial Sequence: Synthetic peptide
  Seed: KIGDFGLATMK (BRAF V600M)
KYGDFGLATMK

SEQ ID NO: 2583 - protein, 9 aa, Artificial Sequence
  Description of Artificial Sequence: Synthetic peptide
  Seed: MKSRWSGSH (BRAF V600M)
MASRWSGSF

SEQ ID NO: 2584 - protein, 9 aa, Artificial Sequence
  Description of Artificial Sequence: Synthetic peptide
  Seed: MKSRWSGSH (BRAF V600M)
MASRWSGSH

SEQ ID NO: 2585 - protein, 11 aa, Artificial Sequence
  Description of Artificial Sequence: Synthetic peptide
  Seed: MKSRWSGSHQF (BRAF V600M)
MASRWSGSHQA

SEQ ID NO: 2586 - protein, 11 aa, Artificial Sequence
  Description of Artificial Sequence: Synthetic peptide
  Seed: MKSRWSGSHQF (BRAF V600M)
MASRWSGSHQF

SEQ ID NO: 2587 - protein, 11 aa, Artificial Sequence
  Description of Artificial Sequence: Synthetic peptide
  Seed: MKSRWSGSHQF (BRAF V600M)
MASRWSGSHQH

SEQ ID NO: 2588 - protein, 11 aa, Artificial Sequence
  Description of Artificial Sequence: Synthetic peptide
  Seed: MKSRWSGSHQF (BRAF V600M)
MASRWSGSHQI

SEQ ID NO: 2589 - protein, 11 aa, Artificial Sequence
  Description of Artificial Sequence: Synthetic peptide
  Seed: MKSRWSGSHQF (BRAF V600M)
MASRWSGSHQK

SEQ ID NO: 2590 - protein, 11 aa, Artificial Sequence
  Description of Artificial Sequence: Synthetic peptide
  Seed: MKSRWSGSHQF (BRAF V600M)
MASRWSGSHQL

SEQ ID NO: 2591 - protein, 11 aa, Artificial Sequence
  Description of Artificial Sequence: Synthetic peptide
  Seed: MKSRWSGSHQF (BRAF V600M)
MASRWSGSHQM

SEQ ID NO: 2592 - protein, 11 aa, Artificial Sequence
  Description of Artificial Sequence: Synthetic peptide
  Seed: MKSRWSGSHQF (BRAF V600M)
MASRWSGSHQR

SEQ ID NO: 2593 - protein, 11 aa, Artificial Sequence
  Description of Artificial Sequence: Synthetic peptide
  Seed: MKSRWSGSHQF (BRAF V600M)
MASRWSGSHQV

SEQ ID NO: 2594 - protein, 11 aa, Artificial Sequence
  Description of Artificial Sequence: Synthetic peptide
  Seed: MKSRWSGSHQF (BRAF V600M)
MASRWSGSHQW

SEQ ID NO: 2595 - protein, 11 aa, Artificial Sequence
  Description of Artificial Sequence: Synthetic peptide
  Seed: MKSRWSGSHQF (BRAF V600M)
MASRWSGSHQY

SEQ ID NO: 2596 - protein, 9 aa, Artificial Sequence
  Description of Artificial Sequence: Synthetic peptide
  Seed: MKSRWSGSH (BRAF V600M)
MASRWSGSI

SEQ ID NO: 2597 - protein, 9 aa, Artificial Sequence
  Description of Artificial Sequence: Synthetic peptide
  Seed: MKSRWSGSH (BRAF V600M)
MASRWSGSL

SEQ ID NO: 2598 - protein, 9 aa, Artificial Sequence
  Description of Artificial Sequence: Synthetic peptide
  Seed: MKSRWSGSH (BRAF V600M)
MASRWSGSM

SEQ ID NO: 2599 - protein, 9 aa, Artificial Sequence
  Description of Artificial Sequence: Synthetic peptide
  Seed: MKSRWSGSH (BRAF V600M)
MASRWSGSW

SEQ ID NO: 2600 - protein, 9 aa, Artificial Sequence
  Description of Artificial Sequence: Synthetic peptide
  Seed: MKSRWSGSH (BRAF V600M)
MASRWSGSY

SEQ ID NO: 2601 - protein, 9 aa, Artificial Sequence
  Description of Artificial Sequence: Synthetic peptide
  Seed: MKSRWSGSH (BRAF V600M)
MCSRWSGSF

SEQ ID NO: 2602 - protein, 11 aa, Artificial Sequence
  Description of Artificial Sequence: Synthetic peptide
  Seed: MKSRWSGSHQF (BRAF V600M)
MCSRWSGSHQA

SEQ ID NO: 2603 - protein, 11 aa, Artificial Sequence
  Description of Artificial Sequence: Synthetic peptide
  Seed: MKSRWSGSHQF (BRAF V600M)
MCSRWSGSHQF

SEQ ID NO: 2604 - protein, 11 aa, Artificial Sequence
  Description of Artificial Sequence: Synthetic peptide
  Seed: MKSRWSGSHQF (BRAF V600M)
MCSRWSGSHQH

SEQ ID NO: 2605 - protein, 11 aa, Artificial Sequence
  Description of Artificial Sequence: Synthetic peptide
  Seed: MKSRWSGSHQF (BRAF V600M)
MCSRWSGSHQI

SEQ ID NO: 2606 - protein, 11 aa, Artificial Sequence
  Description of Artificial Sequence: Synthetic peptide
  Seed: MKSRWSGSHQF (BRAF V600M)
MCSRWSGSHQK

SEQ ID NO: 2607 - protein, 11 aa, Artificial Sequence
  Description of Artificial Sequence: Synthetic peptide
  Seed: MKSRWSGSHQF (BRAF V600M)
MCSRWSGSHQL

SEQ ID NO: 2608 - protein, 11 aa, Artificial Sequence
  Description of Artificial Sequence: Synthetic peptide
  Seed: MKSRWSGSHQF (BRAF V600M)
MCSRWSGSHQM

SEQ ID NO: 2609 - protein, 11 aa, Artificial Sequence
  Description of Artificial Sequence: Synthetic peptide
  Seed: MKSRWSGSHQF (BRAF V600M)
MCSRWSGSHQR

SEQ ID NO: 2610 - protein, 11 aa, Artificial Sequence
  Description of Artificial Sequence: Synthetic peptide
  Seed: MKSRWSGSHQF (BRAF V600M)
MCSRWSGSHQV

SEQ ID NO: 2611 - protein, 11 aa, Artificial Sequence
  Description of Artificial Sequence: Synthetic peptide
  Seed: MKSRWSGSHQF (BRAF V600M)
MCSRWSGSHQW

SEQ ID NO: 2612 - protein, 11 aa, Artificial Sequence
  Description of Artificial Sequence: Synthetic peptide
  Seed: MKSRWSGSHQF (BRAF V600M)
MCSRWSGSHQY

SEQ ID NO: 2613 - protein, 9 aa, Artificial Sequence
  Description of Artificial Sequence: Synthetic peptide
  Seed: MKSRWSGSH (BRAF V600M)
MCSRWSGSY

SEQ ID NO: 2614 - protein, 11 aa, Artificial Sequence
  Description of Artificial Sequence: Synthetic peptide
  Seed: MKSRWSGSHQF (BRAF V600M)
MDSRWSGSHQA

SEQ ID NO: 2615 - protein, 11 aa, Artificial Sequence
  Description of Artificial Sequence: Synthetic peptide
  Seed: MKSRWSGSHQF (BRAF V600M)
MDSRWSGSHQF

SEQ ID NO: 2616 - protein, 11 aa, Artificial Sequence
  Description of Artificial Sequence: Synthetic peptide
  Seed: MKSRWSGSHQF (BRAF V600M)
MDSRWSGSHQH

SEQ ID NO: 2617 - protein, 11 aa, Artificial Sequence
  Description of Artificial Sequence: Synthetic peptide
  Seed: MKSRWSGSHQF (BRAF V600M)
MDSRWSGSHQI

SEQ ID NO: 2618 - protein, 11 aa, Artificial Sequence
  Description of Artificial Sequence: Synthetic peptide
  Seed: MKSRWSGSHQF (BRAF V600M)
MDSRWSGSHQK

SEQ ID NO: 2619 - protein, 11 aa, Artificial Sequence
  Description of Artificial Sequence: Synthetic peptide
  Seed: MKSRWSGSHQF (BRAF V600M)
MDSRWSGSHQL

SEQ ID NO: 2620 - protein, 11 aa, Artificial Sequence
  Description of Artificial Sequence: Synthetic peptide
  Seed: MKSRWSGSHQF (BRAF V600M)
MDSRWSGSHQM

SEQ ID NO: 2621 - protein, 11 aa, Artificial Sequence
  Description of Artificial Sequence: Synthetic peptide
  Seed: MKSRWSGSHQF (BRAF V600M)
MDSRWSGSHQR

SEQ ID NO: 2622 - protein, 11 aa, Artificial Sequence
  Description of Artificial Sequence: Synthetic peptide
  Seed: MKSRWSGSHQF (BRAF V600M)
MDSRWSGSHQV

SEQ ID NO: 2623 - protein, 11 aa, Artificial Sequence
  Description of Artificial Sequence: Synthetic peptide
  Seed: MKSRWSGSHQF (BRAF V600M)
MDSRWSGSHQW

SEQ ID NO: 2624 - protein, 11 aa, Artificial Sequence
  Description of Artificial Sequence: Synthetic peptide
  Seed: MKSRWSGSHQF (BRAF V600M)
MDSRWSGSHQY

SEQ ID NO: 2625 - protein, 9 aa, Artificial Sequence
  Description of Artificial Sequence: Synthetic peptide
  Seed: MKSRWSGSH (BRAF V600M)
MESRWSGSF

SEQ ID NO: 2626 - protein, 9 aa, Artificial Sequence
  Description of Artificial Sequence: Synthetic peptide
  Seed: MKSRWSGSH (BRAF V600M)
MESRWSGSH

SEQ ID NO: 2627 - protein, 11 aa, Artificial Sequence
  Description of Artificial Sequence: Synthetic peptide
  Seed: MKSRWSGSHQF (BRAF V600M)
MESRWSGSHQA

SEQ ID NO: 2628 - protein, 11 aa, Artificial Sequence
  Description of Artificial Sequence: Synthetic peptide
  Seed: MKSRWSGSHQF (BRAF V600M)
MESRWSGSHQF

SEQ ID NO: 2629 - protein, 11 aa, Artificial Sequence
  Description of Artificial Sequence: Synthetic peptide
  Seed: MKSRWSGSHQF (BRAF V600M)
MESRWSGSHQH

SEQ ID NO: 2630 - protein, 11 aa, Artificial Sequence
  Description of Artificial Sequence: Synthetic peptide
  Seed: MKSRWSGSHQF (BRAF V600M)
MESRWSGSHQI

SEQ ID NO: 2631 - protein, 11 aa, Artificial Sequence
  Description of Artificial Sequence: Synthetic peptide
  Seed: MKSRWSGSHQF (BRAF V600M)
MESRWSGSHQK

SEQ ID NO: 2632 - protein, 11 aa, Artificial Sequence
  Description of Artificial Sequence: Synthetic peptide
  Seed: MKSRWSGSHQF (BRAF V600M)
MESRWSGSHQL

SEQ ID NO: 2633 - protein, 11 aa, Artificial Sequence
  Description of Artificial Sequence: Synthetic peptide
  Seed: MKSRWSGSHQF (BRAF V600M)
MESRWSGSHQM

SEQ ID NO: 2634 - protein, 11 aa, Artificial Sequence
  Description of Artificial Sequence: Synthetic peptide
  Seed: MKSRWSGSHQF (BRAF V600M)
MESRWSGSHQR

SEQ ID NO: 2635 - protein, 11 aa, Artificial Sequence
  Description of Artificial Sequence: Synthetic peptide
  Seed: MKSRWSGSHQF (BRAF V600M)
MESRWSGSHQV

SEQ ID NO: 2636 - protein, 11 aa, Artificial Sequence
  Description of Artificial Sequence: Synthetic peptide
  Seed: MKSRWSGSHQF (BRAF V600M)
MESRWSGSHQW

SEQ ID NO: 2637 - protein, 11 aa, Artificial Sequence
  Description of Artificial Sequence: Synthetic peptide
  Seed: MKSRWSGSHQF (BRAF V600M)
MESRWSGSHQY

SEQ ID NO: 2638 - protein, 9 aa, Artificial Sequence
  Description of Artificial Sequence: Synthetic peptide
  Seed: MKSRWSGSH (BRAF V600M)
MESRWSGSI

SEQ ID NO: 2639 - protein, 9 aa, Artificial Sequence
  Description of Artificial Sequence: Synthetic peptide
  Seed: MKSRWSGSH (BRAF V600M)
MESRWSGSL

SEQ ID NO: 2640 - protein, 9 aa, Artificial Sequence
  Description of Artificial Sequence: Synthetic peptide
  Seed: MKSRWSGSH (BRAF V600M)
MESRWSGSM

SEQ ID NO: 2641 - protein, 9 aa, Artificial Sequence
  Description of Artificial Sequence: Synthetic peptide
  Seed: MKSRWSGSH (BRAF V600M)
MESRWSGSW

SEQ ID NO: 2642 - protein, 9 aa, Artificial Sequence
  Description of Artificial Sequence: Synthetic peptide
  Seed: MKSRWSGSH (BRAF V600M)
MESRWSGSY

SEQ ID NO: 2643 - protein, 9 aa, Artificial Sequence
  Description of Artificial Sequence: Synthetic peptide
  Seed: MKSRWSGSH (BRAF V600M)
MFSRWSGSF

SEQ ID NO: 2644 - protein, 11 aa, Artificial Sequence
  Description of Artificial Sequence: Synthetic peptide
  Seed: MKSRWSGSHQF (BRAF V600M)
MFSRWSGSHQA

SEQ ID NO: 2645 - protein, 11 aa, Artificial Sequence
  Description of Artificial Sequence: Synthetic peptide
  Seed: MKSRWSGSHQF (BRAF V600M)
MFSRWSGSHQF

SEQ ID NO: 2646 - protein, 11 aa, Artificial Sequence
  Description of Artificial Sequence: Synthetic peptide
  Seed: MKSRWSGSHQF (BRAF V600M)
MFSRWSGSHQH

SEQ ID NO: 2647 - protein, 11 aa, Artificial Sequence
  Description of Artificial Sequence: Synthetic peptide
  Seed: MKSRWSGSHQF (BRAF V600M)
MFSRWSGSHQI

SEQ ID NO: 2648 - protein, 11 aa, Artificial Sequence
  Description of Artificial Sequence: Synthetic peptide
  Seed: MKSRWSGSHQF (BRAF V600M)
MFSRWSGSHQK

SEQ ID NO: 2649 - protein, 11 aa, Artificial Sequence
  Description of Artificial Sequence: Synthetic peptide
  Seed: MKSRWSGSHQF (BRAF V600M)
MFSRWSGSHQL

SEQ ID NO: 2650 - protein, 11 aa, Artificial Sequence
  Description of Artificial Sequence: Synthetic peptide
  Seed: MKSRWSGSHQF (BRAF V600M)
MFSRWSGSHQM

SEQ ID NO: 2651 - protein, 11 aa, Artificial Sequence
  Description of Artificial Sequence: Synthetic peptide
  Seed: MKSRWSGSHQF (BRAF V600M)
MFSRWSGSHQR

SEQ ID NO: 2652 - protein, 11 aa, Artificial Sequence
  Description of Artificial Sequence: Synthetic peptide
  Seed: MKSRWSGSHQF (BRAF V600M)
MFSRWSGSHQV

SEQ ID NO: 2653 - protein, 11 aa, Artificial Sequence
  Description of Artificial Sequence: Synthetic peptide
  Seed: MKSRWSGSHQF (BRAF V600M)
MFSRWSGSHQW

SEQ ID NO: 2654 - protein, 11 aa, Artificial Sequence
  Description of Artificial Sequence: Synthetic peptide
  Seed: MKSRWSGSHQF (BRAF V600M)
MFSRWSGSHQY

SEQ ID NO: 2655 - protein, 9 aa, Artificial Sequence
  Description of Artificial Sequence: Synthetic peptide
  Seed: MKSRWSGSH (BRAF V600M)
MFSRWSGSM

SEQ ID NO: 2656 - protein, 9 aa, Artificial Sequence
  Description of Artificial Sequence: Synthetic peptide
  Seed: MKSRWSGSH (BRAF V600M)
MFSRWSGSY

SEQ ID NO: 2657 - protein, 9 aa, Artificial Sequence
  Description of Artificial Sequence: Synthetic peptide
  Seed: MKSRWSGSH (BRAF V600M)
MGSRWSGSF

SEQ ID NO: 2658 - protein, 11 aa, Artificial Sequence
  Description of Artificial Sequence: Synthetic peptide
  Seed: MKSRWSGSHQF (BRAF V600M)
MGSRWSGSHQA

SEQ ID NO: 2659 - protein, 11 aa, Artificial Sequence
  Description of Artificial Sequence: Synthetic peptide
  Seed: MKSRWSGSHQF (BRAF V600M)
MGSRWSGSHQF

SEQ ID NO: 2660 - protein, 11 aa, Artificial Sequence
  Description of Artificial Sequence: Synthetic peptide
  Seed: MKSRWSGSHQF (BRAF V600M)
MGSRWSGSHQH

SEQ ID NO: 2661 - protein, 11 aa, Artificial Sequence
  Description of Artificial Sequence: Synthetic peptide
  Seed: MKSRWSGSHQF (BRAF V600M)
MGSRWSGSHQI

SEQ ID NO: 2662 - protein, 11 aa, Artificial Sequence
  Description of Artificial Sequence: Synthetic peptide
  Seed: MKSRWSGSHQF (BRAF V600M)
MGSRWSGSHQK

SEQ ID NO: 2663 - protein, 11 aa, Artificial Sequence
  Description of Artificial Sequence: Synthetic peptide
  Seed: MKSRWSGSHQF (BRAF V600M)
MGSRWSGSHQL

SEQ ID NO: 2664 - protein, 11 aa, Artificial Sequence
  Description of Artificial Sequence: Synthetic peptide
  Seed: MKSRWSGSHQF (BRAF V600M)
MGSRWSGSHQM

SEQ ID NO: 2665 - protein, 11 aa, Artificial Sequence
  Description of Artificial Sequence: Synthetic peptide
  Seed: MKSRWSGSHQF (BRAF V600M)
MGSRWSGSHQR

SEQ ID NO: 2666 - protein, 11 aa, Artificial Sequence
  Description of Artificial Sequence: Synthetic peptide
  Seed: MKSRWSGSHQF (BRAF V600M)
MGSRWSGSHQV

SEQ ID NO: 2667 - protein, 11 aa, Artificial Sequence
  Description of Artificial Sequence: Synthetic peptide
  Seed: MKSRWSGSHQF (BRAF V600M)
MGSRWSGSHQW

SEQ ID NO: 2668 - protein, 11 aa, Artificial Sequence
  Description of Artificial Sequence: Synthetic peptide
  Seed: MKSRWSGSHQF (BRAF V600M)
MGSRWSGSHQY

SEQ ID NO: 2669 - protein, 9 aa, Artificial Sequence
  Description of Artificial Sequence: Synthetic peptide
  Seed: MKSRWSGSH (BRAF V600M)
MGSRWSGSM

SEQ ID NO: 2670 - protein, 9 aa, Artificial Sequence
  Description of Artificial Sequence: Synthetic peptide
  Seed: MKSRWSGSH (BRAF V600M)
MGSRWSGSY

SEQ ID NO: 2671 - protein, 9 aa, Artificial Sequence
  Description of Artificial Sequence: Synthetic peptide
  Seed: MKSRWSGSH (BRAF V600M)
MHSRWSGSF

SEQ ID NO: 2672 - protein, 9 aa, Artificial Sequence
  Description of Artificial Sequence: Synthetic peptide
  Seed: MKSRWSGSH (BRAF V600M)
MHSRWSGSH

SEQ ID NO: 2673 - protein, 11 aa, Artificial Sequence
  Description of Artificial Sequence: Synthetic peptide
  Seed: MKSRWSGSHQF (BRAF V600M)
MHSRWSGSHQA

SEQ ID NO: 2674 - protein, 11 aa, Artificial Sequence
  Description of Artificial Sequence: Synthetic peptide
  Seed: MKSRWSGSHQF (BRAF V600M)
MHSRWSGSHQF

SEQ ID NO: 2675 - protein, 11 aa, Artificial Sequence
  Description of Artificial Sequence: Synthetic peptide
  Seed: MKSRWSGSHQF (BRAF V600M)
MHSRWSGSHQH

SEQ ID NO: 2676 - protein, 11 aa, Artificial Sequence
  Description of Artificial Sequence: Synthetic peptide
  Seed: MKSRWSGSHQF (BRAF V600M)
MHSRWSGSHQI

SEQ ID NO: 2677 - protein, 11 aa, Artificial Sequence
  Description of Artificial Sequence: Synthetic peptide
  Seed: MKSRWSGSHQF (BRAF V600M)
MHSRWSGSHQK

SEQ ID NO: 2678 - protein, 11 aa, Artificial Sequence
  Description of Artificial Sequence: Synthetic peptide
  Seed: MKSRWSGSHQF (BRAF V600M)
MHSRWSGSHQL

SEQ ID NO: 2679 - protein, 11 aa, Artificial Sequence
  Description of Artificial Sequence: Synthetic peptide
  Seed: MKSRWSGSHQF (BRAF V600M)
MHSRWSGSHQM

SEQ ID NO: 2680 - protein, 11 aa, Artificial Sequence
  Description of Artificial Sequence: Synthetic peptide
  Seed: MKSRWSGSHQF (BRAF V600M)
MHSRWSGSHQR

SEQ ID NO: 2681 - protein, 11 aa, Artificial Sequence
  Description of Artificial Sequence: Synthetic peptide
  Seed: MKSRWSGSHQF (BRAF V600M)
MHSRWSGSHQV

SEQ ID NO: 2682 - protein, 11 aa, Artificial Sequence
  Description of Artificial Sequence: Synthetic peptide
  Seed: MKSRWSGSHQF (BRAF V600M)
MHSRWSGSHQW

SEQ ID NO: 2683 - protein, 11 aa, Artificial Sequence
  Description of Artificial Sequence: Synthetic peptide
  Seed: MKSRWSGSHQF (BRAF V600M)
MHSRWSGSHQY

SEQ ID NO: 2684 - protein, 9 aa, Artificial Sequence
  Description of Artificial Sequence: Synthetic peptide
  Seed: MKSRWSGSH (BRAF V600M)
MHSRWSGSI

SEQ ID NO: 2685 - protein, 9 aa, Artificial Sequence
  Description of Artificial Sequence: Synthetic peptide
  Seed: MKSRWSGSH (BRAF V600M)
MHSRWSGSL

SEQ ID NO: 2686 - protein, 9 aa, Artificial Sequence
  Description of Artificial Sequence: Synthetic peptide
  Seed: MKSRWSGSH (BRAF V600M)
MHSRWSGSM

SEQ ID NO: 2687 - protein, 9 aa, Artificial Sequence
  Description of Artificial Sequence: Synthetic peptide
  Seed: MKSRWSGSH (BRAF V600M)
MHSRWSGSW

SEQ ID NO: 2688 - protein, 9 aa, Artificial Sequence
  Description of Artificial Sequence: Synthetic peptide
  Seed: MKSRWSGSH (BRAF V600M)
MHSRWSGSY

SEQ ID NO: 2689 - protein, 9 aa, Artificial Sequence
  Description of Artificial Sequence: Synthetic peptide
  Seed: MKSRWSGSH (BRAF V600M)
MISRWSGSF

SEQ ID NO: 2690 - protein, 11 aa, Artificial Sequence
  Description of Artificial Sequence: Synthetic peptide
  Seed: MKSRWSGSHQF (BRAF V600M)
MISRWSGSHQA

SEQ ID NO: 2691 - protein, 11 aa, Artificial Sequence
  Description of Artificial Sequence: Synthetic peptide
  Seed: MKSRWSGSHQF (BRAF V600M)
MISRWSGSHQF

SEQ ID NO: 2692 - protein, 11 aa, Artificial Sequence
  Description of Artificial Sequence: Synthetic peptide
  Seed: MKSRWSGSHQF (BRAF V600M)
MISRWSGSHQH

SEQ ID NO: 2693 - protein, 11 aa, Artificial Sequence
  Description of Artificial Sequence: Synthetic peptide
  Seed: MKSRWSGSHQF (BRAF V600M)
MISRWSGSHQI

SEQ ID NO: 2694 - protein, 11 aa, Artificial Sequence
  Description of Artificial Sequence: Synthetic peptide
  Seed: MKSRWSGSHQF (BRAF V600M)
MISRWSGSHQK

SEQ ID NO: 2695 - protein, 11 aa, Artificial Sequence
  Description of Artificial Sequence: Synthetic peptide
  Seed: MKSRWSGSHQF (BRAF V600M)
MISRWSGSHQL

SEQ ID NO: 2696 - protein, 11 aa, Artificial Sequence
  Description of Artificial Sequence: Synthetic peptide
  Seed: MKSRWSGSHQF (BRAF V600M)
MISRWSGSHQM

SEQ ID NO: 2697 - protein, 11 aa, Artificial Sequence
  Description of Artificial Sequence: Synthetic peptide
  Seed: MKSRWSGSHQF (BRAF V600M)
MISRWSGSHQR

SEQ ID NO: 2698 - protein, 11 aa, Artificial Sequence
  Description of Artificial Sequence: Synthetic peptide
  Seed: MKSRWSGSHQF (BRAF V600M)
MISRWSGSHQV

SEQ ID NO: 2699 - protein, 11 aa, Artificial Sequence
  Description of Artificial Sequence: Synthetic peptide
  Seed: MKSRWSGSHQF (BRAF V600M)
MISRWSGSHQW

SEQ ID NO: 2700 - protein, 11 aa, Artificial Sequence
  Description of Artificial Sequence: Synthetic peptide
  Seed: MKSRWSGSHQF (BRAF V600M)
MISRWSGSHQY

SEQ ID NO: 2701 - protein, 9 aa, Artificial Sequence
  Description of Artificial Sequence: Synthetic peptide
  Seed: MKSRWSGSH (BRAF V600M)
MISRWSGSL

SEQ ID NO: 2702 - protein, 9 aa, Artificial Sequence
  Description of Artificial Sequence: Synthetic peptide
  Seed: MKSRWSGSH (BRAF V600M)
MISRWSGSM

SEQ ID NO: 2703 - protein, 9 aa, Artificial Sequence
  Description of Artificial Sequence: Synthetic peptide
  Seed: MKSRWSGSH (BRAF V600M)
MISRWSGSY

SEQ ID NO: 2704 - protein, 9 aa, Artificial Sequence
  Description of Artificial Sequence: Synthetic peptide
  Seed: MKSRWSGSH (BRAF V600M)
MKSRWSGSA

SEQ ID NO: 2705 - protein, 9 aa, Artificial Sequence
  Description of Artificial Sequence: Synthetic peptide
  Seed: MKSRWSGSH (BRAF V600M)
MKSRWSGSF

SEQ ID NO: 2706 - protein, 11 aa, Artificial Sequence
  Description of Artificial Sequence: Synthetic peptide
  Seed: MKSRWSGSHQF (BRAF V600M)
MKSRWSGSHQA

SEQ ID NO: 2707 - protein, 11 aa, Artificial Sequence
  Description of Artificial Sequence: Synthetic peptide
  Seed: MKSRWSGSHQF (BRAF V600M)
MKSRWSGSHQH

SEQ ID NO: 2708 - protein, 11 aa, Artificial Sequence
  Description of Artificial Sequence: Synthetic peptide
  Seed: MKSRWSGSHQF (BRAF V600M)
MKSRWSGSHQI

SEQ ID NO: 2709 - protein, 11 aa, Artificial Sequence
  Description of Artificial Sequence: Synthetic peptide
  Seed: MKSRWSGSHQF (BRAF V600M)
MKSRWSGSHQK

SEQ ID NO: 2710 - protein, 11 aa, Artificial Sequence
  Description of Artificial Sequence: Synthetic peptide
  Seed: MKSRWSGSHQF (BRAF V600M)
MKSRWSGSHQL

SEQ ID NO: 2711 - protein, 11 aa, Artificial Sequence
  Description of Artificial Sequence: Synthetic peptide
  Seed: MKSRWSGSHQF (BRAF V600M)
MKSRWSGSHQM

SEQ ID NO: 2712 - protein, 11 aa, Artificial Sequence
  Description of Artificial Sequence: Synthetic peptide
  Seed: MKSRWSGSHQF (BRAF V600M)
MKSRWSGSHQR

SEQ ID NO: 2713 - protein, 11 aa, Artificial Sequence
  Description of Artificial Sequence: Synthetic peptide
  Seed: MKSRWSGSHQF (BRAF V600M)
MKSRWSGSHQV

SEQ ID NO: 2714 - protein, 11 aa, Artificial Sequence
  Description of Artificial Sequence: Synthetic peptide
  Seed: MKSRWSGSHQF (BRAF V600M)
MKSRWSGSHQW

SEQ ID NO: 2715 - protein, 11 aa, Artificial Sequence
  Description of Artificial Sequence: Synthetic peptide
  Seed: MKSRWSGSHQF (BRAF V600M)
MKSRWSGSHQY

SEQ ID NO: 2716 - protein, 9 aa, Artificial Sequence
  Description of Artificial Sequence: Synthetic peptide
  Seed: MKSRWSGSH (BRAF V600M)
MKSRWSGSI

SEQ ID NO: 2717 - protein, 9 aa, Artificial Sequence
  Description of Artificial Sequence: Synthetic peptide
  Seed: MKSRWSGSH (BRAF V600M)
MKSRWSGSL

SEQ ID NO: 2718 - protein, 9 aa, Artificial Sequence
  Description of Artificial Sequence: Synthetic peptide
  Seed: MKSRWSGSH (BRAF V600M)
MKSRWSGSM

SEQ ID NO: 2719 - protein, 9 aa, Artificial Sequence
  Description of Artificial Sequence: Synthetic peptide
  Seed: MKSRWSGSH (BRAF V600M)
MKSRWSGSV

SEQ ID NO: 2720 - protein, 9 aa, Artificial Sequence
  Description of Artificial Sequence: Synthetic peptide
  Seed: MKSRWSGSH (BRAF V600M)
MKSRWSGSW

SEQ ID NO: 2721 - protein, 9 aa, Artificial Sequence
  Description of Artificial Sequence: Synthetic peptide
  Seed: MKSRWSGSH (BRAF V600M)
MKSRWSGSY

SEQ ID NO: 2722 - protein, 9 aa, Artificial Sequence
  Description of Artificial Sequence: Synthetic peptide
  Seed: MKSRWSGSH (BRAF V600M)
MLSRWSGSF

SEQ ID NO: 2723 - protein, 9 aa, Artificial Sequence
  Description of Artificial Sequence: Synthetic peptide
  Seed: MKSRWSGSH (BRAF V600M)
MLSRWSGSH

SEQ ID NO: 2724 - protein, 11 aa, Artificial Sequence
  Description of Artificial Sequence: Synthetic peptide
  Seed: MKSRWSGSHQF (BRAF V600M)
MLSRWSGSHQA

SEQ ID NO: 2725 - protein, 11 aa, Artificial Sequence
  Description of Artificial Sequence: Synthetic peptide
  Seed: MKSRWSGSHQF (BRAF V600M)
MLSRWSGSHQF

SEQ ID NO: 2726 - protein, 11 aa, Artificial Sequence
  Description of Artificial Sequence: Synthetic peptide
  Seed: MKSRWSGSHQF (BRAF V600M)
MLSRWSGSHQH

SEQ ID NO: 2727 - protein, 11 aa, Artificial Sequence
  Description of Artificial Sequence: Synthetic peptide
  Seed: MKSRWSGSHQF (BRAF V600M)
MLSRWSGSHQI

SEQ ID NO: 2728 - protein, 11 aa, Artificial Sequence
  Description of Artificial Sequence: Synthetic peptide
  Seed: MKSRWSGSHQF (BRAF V600M)
MLSRWSGSHQK

SEQ ID NO: 2729 - protein, 11 aa, Artificial Sequence
  Description of Artificial Sequence: Synthetic peptide
  Seed: MKSRWSGSHQF (BRAF V600M)
MLSRWSGSHQL

SEQ ID NO: 2730 - protein, 11 aa, Artificial Sequence
  Description of Artificial Sequence: Synthetic peptide
  Seed: MKSRWSGSHQF (BRAF V600M)
MLSRWSGSHQM

SEQ ID NO: 2731 - protein, 11 aa, Artificial Sequence
  Description of Artificial Sequence: Synthetic peptide
  Seed: MKSRWSGSHQF (BRAF V600M)
MLSRWSGSHQR

SEQ ID NO: 2732 - protein, 11 aa, Artificial Sequence
  Description of Artificial Sequence: Synthetic peptide
  Seed: MKSRWSGSHQF (BRAF V600M)
MLSRWSGSHQV

SEQ ID NO: 2733 - protein, 11 aa, Artificial Sequence
  Description of Artificial Sequence: Synthetic peptide
  Seed: MKSRWSGSHQF (BRAF V600M)
MLSRWSGSHQW

SEQ ID NO: 2734 - protein, 11 aa, Artificial Sequence
  Description of Artificial Sequence: Synthetic peptide
  Seed: MKSRWSGSHQF (BRAF V600M)
MLSRWSGSHQY

SEQ ID NO: 2735 - protein, 9 aa, Artificial Sequence
  Description of Artificial Sequence: Synthetic peptide
  Seed: MKSRWSGSH (BRAF V600M)
MLSRWSGSI

SEQ ID NO: 2736 - protein, 9 aa, Artificial Sequence
  Description of Artificial Sequence: Synthetic peptide
  Seed: MKSRWSGSH (BRAF V600M)
MLSRWSGSL

SEQ ID NO: 2737 - protein, 9 aa, Artificial Sequence
  Description of Artificial Sequence: Synthetic peptide
  Seed: MKSRWSGSH (BRAF V600M)
MLSRWSGSM

SEQ ID NO: 2738 - protein, 9 aa, Artificial Sequence
  Description of Artificial Sequence: Synthetic peptide
  Seed: MKSRWSGSH (BRAF V600M)
MLSRWSGSW

SEQ ID NO: 2739 - protein, 9 aa, Artificial Sequence
  Description of Artificial Sequence: Synthetic peptide
  Seed: MKSRWSGSH (BRAF V600M)
MLSRWSGSY

SEQ ID NO: 2740 - protein, 9 aa, Artificial Sequence
  Description of Artificial Sequence: Synthetic peptide
  Seed: MKSRWSGSH (BRAF V600M)
MMSRWSGSA

SEQ ID NO: 2741 - protein, 9 aa, Artificial Sequence
  Description of Artificial Sequence: Synthetic peptide
  Seed: MKSRWSGSH (BRAF V600M)
MMSRWSGSF

SEQ ID NO: 2742 - protein, 9 aa, Artificial Sequence
  Description of Artificial Sequence: Synthetic peptide
  Seed: MKSRWSGSH (BRAF V600M)
MMSRWSGSH

SEQ ID NO: 2743 - protein, 11 aa, Artificial Sequence
  Description of Artificial Sequence: Synthetic peptide
  Seed: MKSRWSGSHQF (BRAF V600M)
MMSRWSGSHQA

SEQ ID NO: 2744 - protein, 11 aa, Artificial Sequence
  Description of Artificial Sequence: Synthetic peptide
  Seed: MKSRWSGSHQF (BRAF V600M)
MMSRWSGSHQH

SEQ ID NO: 2745 - protein, 11 aa, Artificial Sequence
  Description of Artificial Sequence: Synthetic peptide
  Seed: MKSRWSGSHQF (BRAF V600M)
MMSRWSGSHQI

SEQ ID NO: 2746 - protein, 11 aa, Artificial Sequence
  Description of Artificial Sequence: Synthetic peptide
  Seed: MKSRWSGSHQF (BRAF V600M)
MMSRWSGSHQK

SEQ ID NO: 2747 - protein, 11 aa, Artificial Sequence
  Description of Artificial Sequence: Synthetic peptide
  Seed: MKSRWSGSHQF (BRAF V600M)
MMSRWSGSHQL

SEQ ID NO: 2748 - protein, 11 aa, Artificial Sequence
  Description of Artificial Sequence: Synthetic peptide
  Seed: MKSRWSGSHQF (BRAF V600M)
MMSRWSGSHQM

SEQ ID NO: 2749 - protein, 11 aa, Artificial Sequence
  Description of Artificial Sequence: Synthetic peptide
  Seed: MKSRWSGSHQF (BRAF V600M)
MMSRWSGSHQR

SEQ ID NO: 2750 - protein, 11 aa, Artificial Sequence
  Description of Artificial Sequence: Synthetic peptide
  Seed: MKSRWSGSHQF (BRAF V600M)
MMSRWSGSHQV

SEQ ID NO: 2751 - protein, 11 aa, Artificial Sequence
  Description of Artificial Sequence: Synthetic peptide
  Seed: MKSRWSGSHQF (BRAF V600M)
MMSRWSGSHQW

SEQ ID NO: 2752 - protein, 11 aa, Artificial Sequence
  Description of Artificial Sequence: Synthetic peptide
  Seed: MKSRWSGSHQF (BRAF V600M)
MMSRWSGSHQY

SEQ ID NO: 2753 - protein, 9 aa, Artificial Sequence
  Description of Artificial Sequence: Synthetic peptide
  Seed: MKSRWSGSH (BRAF V600M)
MMSRWSGSI

SEQ ID NO: 2754 - protein, 9 aa, Artificial Sequence
  Description of Artificial Sequence: Synthetic peptide
  Seed: MKSRWSGSH (BRAF V600M)
MMSRWSGSL

SEQ ID NO: 2755 - protein, 9 aa, Artificial Sequence
  Description of Artificial Sequence: Synthetic peptide
  Seed: MKSRWSGSH (BRAF V600M)
MMSRWSGSM

SEQ ID NO: 2756 - protein, 9 aa, Artificial Sequence
  Description of Artificial Sequence: Synthetic peptide
  Seed: MKSRWSGSH (BRAF V600M)
MMSRWSGSV

SEQ ID NO: 2757 - protein, 9 aa, Artificial Sequence
  Description of Artificial Sequence: Synthetic peptide
  Seed: MKSRWSGSH (BRAF V600M)
MMSRWSGSW

SEQ ID NO: 2758 - protein, 9 aa, Artificial Sequence
  Description of Artificial Sequence: Synthetic peptide
  Seed: MKSRWSGSH (BRAF V600M)
MMSRWSGSY

SEQ ID NO: 2759 - protein, 9 aa, Artificial Sequence
  Description of Artificial Sequence: Synthetic peptide
  Seed: MKSRWSGSH (BRAF V600M)
MNSRWSGSF

SEQ ID NO: 2760 - protein, 11 aa, Artificial Sequence
  Description of Artificial Sequence: Synthetic peptide
  Seed: MKSRWSGSHQF (BRAF V600M)
MNSRWSGSHQA

SEQ ID NO: 2761 - protein, 11 aa, Artificial Sequence
  Description of Artificial Sequence: Synthetic peptide
  Seed: MKSRWSGSHQF (BRAF V600M)
MNSRWSGSHQF

SEQ ID NO: 2762 - protein, 11 aa, Artificial Sequence
  Description of Artificial Sequence: Synthetic peptide
  Seed: MKSRWSGSHQF (BRAF V600M)
MNSRWSGSHQH

SEQ ID NO: 2763 - protein, 11 aa, Artificial Sequence
  Description of Artificial Sequence: Synthetic peptide
  Seed: MKSRWSGSHQF (BRAF V600M)
MNSRWSGSHQI

SEQ ID NO: 2764 - protein, 11 aa, Artificial Sequence
  Description of Artificial Sequence: Synthetic peptide
  Seed: MKSRWSGSHQF (BRAF V600M)
MNSRWSGSHQK

SEQ ID NO: 2765 - protein, 11 aa, Artificial Sequence
  Description of Artificial Sequence: Synthetic peptide
  Seed: MKSRWSGSHQF (BRAF V600M)
MNSRWSGSHQL

SEQ ID NO: 2766 - protein, 11 aa, Artificial Sequence
  Description of Artificial Sequence: Synthetic peptide
  Seed: MKSRWSGSHQF (BRAF V600M)
MNSRWSGSHQM

SEQ ID NO: 2767 - protein, 11 aa, Artificial Sequence
  Description of Artificial Sequence: Synthetic peptide
  Seed: MKSRWSGSHQF (BRAF V600M)
MNSRWSGSHQR

SEQ ID NO: 2768 - protein, 11 aa, Artificial Sequence
  Description of Artificial Sequence: Synthetic peptide
  Seed: MKSRWSGSHQF (BRAF V600M)
MNSRWSGSHQV

SEQ ID NO: 2769 - protein, 11 aa, Artificial Sequence
  Description of Artificial Sequence: Synthetic peptide
  Seed: MKSRWSGSHQF (BRAF V600M)
MNSRWSGSHQW

SEQ ID NO: 2770 - protein, 11 aa, Artificial Sequence
  Description of Artificial Sequence: Synthetic peptide
  Seed: MKSRWSGSHQF (BRAF V600M)
MNSRWSGSHQY

SEQ ID NO: 2771 - protein, 9 aa, Artificial Sequence
  Description of Artificial Sequence: Synthetic peptide
  Seed: MKSRWSGSH (BRAF V600M)
MNSRWSGSM

SEQ ID NO: 2772 - protein, 9 aa, Artificial Sequence
  Description of Artificial Sequence: Synthetic peptide
  Seed: MKSRWSGSH (BRAF V600M)
MNSRWSGSY

SEQ ID NO: 2773 - protein, 9 aa, Artificial Sequence
  Description of Artificial Sequence: Synthetic peptide
  Seed: MKSRWSGSH (BRAF V600M)
MPSRWSGSF

SEQ ID NO: 2774 - protein, 11 aa, Artificial Sequence
  Description of Artificial Sequence: Synthetic peptide
  Seed: MKSRWSGSHQF (BRAF V600M)
MPSRWSGSHQA

SEQ ID NO: 2775 - protein, 11 aa, Artificial Sequence
  Description of Artificial Sequence: Synthetic peptide
  Seed: MKSRWSGSHQF (BRAF V600M)
MPSRWSGSHQF

SEQ ID NO: 2776 - protein, 11 aa, Artificial Sequence
  Description of Artificial Sequence: Synthetic peptide
  Seed: MKSRWSGSHQF (BRAF V600M)
MPSRWSGSHQH

SEQ ID NO: 2777 - protein, 11 aa, Artificial Sequence
  Description of Artificial Sequence: Synthetic peptide
  Seed: MKSRWSGSHQF (BRAF V600M)
MPSRWSGSHQI

SEQ ID NO: 2778 - protein, 11 aa, Artificial Sequence
  Description of Artificial Sequence: Synthetic peptide
  Seed: MKSRWSGSHQF (BRAF V600M)
MPSRWSGSHQK

SEQ ID NO: 2779 - protein, 11 aa, Artificial Sequence
  Description of Artificial Sequence: Synthetic peptide
  Seed: MKSRWSGSHQF (BRAF V600M)
MPSRWSGSHQL

SEQ ID NO: 2780 - protein, 11 aa, Artificial Sequence
  Description of Artificial Sequence: Synthetic peptide
  Seed: MKSRWSGSHQF (BRAF V600M)
MPSRWSGSHQM

SEQ ID NO: 2781 - protein, 11 aa, Artificial Sequence
  Description of Artificial Sequence: Synthetic peptide
  Seed: MKSRWSGSHQF (BRAF V600M)
MPSRWSGSHQR

SEQ ID NO: 2782 - protein, 11 aa, Artificial Sequence
  Description of Artificial Sequence: Synthetic peptide
  Seed: MKSRWSGSHQF (BRAF V600M)
MPSRWSGSHQV

SEQ ID NO: 2783 - protein, 11 aa, Artificial Sequence
  Description of Artificial Sequence: Synthetic peptide
  Seed: MKSRWSGSHQF (BRAF V600M)
MPSRWSGSHQW

SEQ ID NO: 2784 - protein, 11 aa, Artificial Sequence
  Description of Artificial Sequence: Synthetic peptide
  Seed: MKSRWSGSHQF (BRAF V600M)
MPSRWSGSHQY

SEQ ID NO: 2785 - protein, 9 aa, Artificial Sequence
  Description of Artificial Sequence: Synthetic peptide
  Seed: MKSRWSGSH (BRAF V600M)
MPSRWSGSY

SEQ ID NO: 2786 - protein, 9 aa, Artificial Sequence
  Description of Artificial Sequence: Synthetic peptide
  Seed: MKSRWSGSH (BRAF V600M)
MQSRWSGSA

SEQ ID NO: 2787 - protein, 9 aa, Artificial Sequence
  Description of Artificial Sequence: Synthetic peptide
  Seed: MKSRWSGSH (BRAF V600M)
MQSRWSGSC

SEQ ID NO: 2788 - protein, 9 aa, Artificial Sequence
  Description of Artificial Sequence: Synthetic peptide
  Seed: MKSRWSGSH (BRAF V600M)
MQSRWSGSF

SEQ ID NO: 2789 - protein, 9 aa, Artificial Sequence
  Description of Artificial Sequence: Synthetic peptide
  Seed: MKSRWSGSH (BRAF V600M)
MQSRWSGSG

SEQ ID NO: 2790 - protein, 9 aa, Artificial Sequence
  Description of Artificial Sequence: Synthetic peptide
  Seed: MKSRWSGSH (BRAF V600M)
MQSRWSGSH

SEQ ID NO: 2791 - protein, 11 aa, Artificial Sequence
  Description of Artificial Sequence: Synthetic peptide
  Seed: MKSRWSGSHQF (BRAF V600M)
MQSRWSGSHQA

SEQ ID NO: 2792 - protein, 11 aa, Artificial Sequence
  Description of Artificial Sequence: Synthetic peptide
  Seed: MKSRWSGSHQF (BRAF V600M)
MQSRWSGSHQH

SEQ ID NO: 2793 - protein, 11 aa, Artificial Sequence
  Description of Artificial Sequence: Synthetic peptide
  Seed: MKSRWSGSHQF (BRAF V600M)
MQSRWSGSHQI

SEQ ID NO: 2794 - protein, 11 aa, Artificial Sequence
  Description of Artificial Sequence: Synthetic peptide
  Seed: MKSRWSGSHQF (BRAF V600M)
MQSRWSGSHQK

SEQ ID NO: 2795 - protein, 11 aa, Artificial Sequence
  Description of Artificial Sequence: Synthetic peptide
  Seed: MKSRWSGSHQF (BRAF V600M)
MQSRWSGSHQL

SEQ ID NO: 2796 - protein, 11 aa, Artificial Sequence
  Description of Artificial Sequence: Synthetic peptide
  Seed: MKSRWSGSHQF (BRAF V600M)
MQSRWSGSHQM

SEQ ID NO: 2797 - protein, 11 aa, Artificial Sequence
  Description of Artificial Sequence: Synthetic peptide
  Seed: MKSRWSGSHQF (BRAF V600M)
MQSRWSGSHQR

SEQ ID NO: 2798 - protein, 11 aa, Artificial Sequence
  Description of Artificial Sequence: Synthetic peptide
  Seed: MKSRWSGSHQF (BRAF V600M)
MQSRWSGSHQV

SEQ ID NO: 2799 - protein, 11 aa, Artificial Sequence
  Description of Artificial Sequence: Synthetic peptide
  Seed: MKSRWSGSHQF (BRAF V600M)
MQSRWSGSHQW

SEQ ID NO: 2800 - protein, 11 aa, Artificial Sequence
  Description of Artificial Sequence: Synthetic peptide
  Seed: MKSRWSGSHQF (BRAF V600M)
MQSRWSGSHQY

SEQ ID NO: 2801 - protein, 9 aa, Artificial Sequence
  Description of Artificial Sequence: Synthetic peptide
  Seed: MKSRWSGSH (BRAF V600M)
MQSRWSGSI

SEQ ID NO: 2802 - protein, 9 aa, Artificial Sequence
  Description of Artificial Sequence: Synthetic peptide
  Seed: MKSRWSGSH (BRAF V600M)
MQSRWSGSL

SEQ ID NO: 2803 - protein, 9 aa, Artificial Sequence
  Description of Artificial Sequence: Synthetic peptide
  Seed: MKSRWSGSH (BRAF V600M)
MQSRWSGSM

SEQ ID NO: 2804 - protein, 9 aa, Artificial Sequence
  Description of Artificial Sequence: Synthetic peptide
  Seed: MKSRWSGSH (BRAF V600M)
MQSRWSGSQ

SEQ ID NO: 2805 - protein, 9 aa, Artificial Sequence
  Description of Artificial Sequence: Synthetic peptide
  Seed: MKSRWSGSH (BRAF V600M)
MQSRWSGSS

SEQ ID NO: 2806 - protein, 9 aa, Artificial Sequence
  Description of Artificial Sequence: Synthetic peptide
  Seed: MKSRWSGSH (BRAF V600M)
MQSRWSGST

SEQ ID NO: 2807 - protein, 9 aa, Artificial Sequence
  Description of Artificial Sequence: Synthetic peptide
  Seed: MKSRWSGSH (BRAF V600M)
MQSRWSGSV

SEQ ID NO: 2808 - protein, 9 aa, Artificial Sequence
  Description of Artificial Sequence: Synthetic peptide
  Seed: MKSRWSGSH (BRAF V600M)
MQSRWSGSW

SEQ ID NO: 2809 - protein, 9 aa, Artificial Sequence
  Description of Artificial Sequence: Synthetic peptide
  Seed: MKSRWSGSH (BRAF V600M)
MQSRWSGSY

SEQ ID NO: 2810 - protein, 9 aa, Artificial Sequence
  Description of Artificial Sequence: Synthetic peptide
  Seed: MKSRWSGSH (BRAF V600M)
MRSRWSGSF

SEQ ID NO: 2811 - protein, 11 aa, Artificial Sequence
  Description of Artificial Sequence: Synthetic peptide
  Seed: MKSRWSGSHQF (BRAF V600M)
MRSRWSGSHQA

SEQ ID NO: 2812 - protein, 11 aa, Artificial Sequence
  Description of Artificial Sequence: Synthetic peptide
  Seed: MKSRWSGSHQF (BRAF V600M)
MRSRWSGSHQC

SEQ ID NO: 2813 - protein, 11 aa, Artificial Sequence
  Description of Artificial Sequence: Synthetic peptide
  Seed: MKSRWSGSHQF (BRAF V600M)
MRSRWSGSHQF

SEQ ID NO: 2814 - protein, 11 aa, Artificial Sequence
  Description of Artificial Sequence: Synthetic peptide
  Seed: MKSRWSGSHQF (BRAF V600M)
MRSRWSGSHQH

SEQ ID NO: 2815 - protein, 11 aa, Artificial Sequence
  Description of Artificial Sequence: Synthetic peptide
  Seed: MKSRWSGSHQF (BRAF V600M)
MRSRWSGSHQI

SEQ ID NO: 2816 - protein, 11 aa, Artificial Sequence
  Description of Artificial Sequence: Synthetic peptide
  Seed: MKSRWSGSHQF (BRAF V600M)
MRSRWSGSHQK

SEQ ID NO: 2817 - protein, 11 aa, Artificial Sequence
  Description of Artificial Sequence: Synthetic peptide
  Seed: MKSRWSGSHQF (BRAF V600M)
MRSRWSGSHQL

SEQ ID NO: 2818 - protein, 11 aa, Artificial Sequence
  Description of Artificial Sequence: Synthetic peptide
  Seed: MKSRWSGSHQF (BRAF V600M)
MRSRWSGSHQM

SEQ ID NO: 2819 - protein, 11 aa, Artificial Sequence
  Description of Artificial Sequence: Synthetic peptide
  Seed: MKSRWSGSHQF (BRAF V600M)
MRSRWSGSHQR

SEQ ID NO: 2820 - protein, 11 aa, Artificial Sequence
  Description of Artificial Sequence: Synthetic peptide
  Seed: MKSRWSGSHQF (BRAF V600M)
MRSRWSGSHQV

SEQ ID NO: 2821 - protein, 11 aa, Artificial Sequence
  Description of Artificial Sequence: Synthetic peptide
  Seed: MKSRWSGSHQF (BRAF V600M)
MRSRWSGSHQW

SEQ ID NO: 2822 - protein, 11 aa, Artificial Sequence
  Description of Artificial Sequence: Synthetic peptide
  Seed: MKSRWSGSHQF (BRAF V600M)
MRSRWSGSHQY

SEQ ID NO: 2823 - protein, 9 aa, Artificial Sequence
  Description of Artificial Sequence: Synthetic peptide
  Seed: MKSRWSGSH (BRAF V600M)
MRSRWSGSI

SEQ ID NO: 2824 - protein, 9 aa, Artificial Sequence
  Description of Artificial Sequence: Synthetic peptide
  Seed: MKSRWSGSH (BRAF V600M)
MRSRWSGSL

SEQ ID NO: 2825 - protein, 9 aa, Artificial Sequence
  Description of Artificial Sequence: Synthetic peptide
  Seed: MKSRWSGSH (BRAF V600M)
MRSRWSGSM

SEQ ID NO: 2826 - protein, 9 aa, Artificial Sequence
  Description of Artificial Sequence: Synthetic peptide
  Seed: MKSRWSGSH (BRAF V600M)
MRSRWSGSW

SEQ ID NO: 2827 - protein, 9 aa, Artificial Sequence
  Description of Artificial Sequence: Synthetic peptide
  Seed: MKSRWSGSH (BRAF V600M)
MRSRWSGSY

SEQ ID NO: 2828 - protein, 9 aa, Artificial Sequence
  Description of Artificial Sequence: Synthetic peptide
  Seed: MKSRWSGSH (BRAF V600M)
MSSRWSGSF

SEQ ID NO: 2829 - protein, 11 aa, Artificial Sequence
  Description of Artificial Sequence: Synthetic peptide
  Seed: MKSRWSGSHQF (BRAF V600M)
MSSRWSGSHQA

SEQ ID NO: 2830 - protein, 11 aa, Artificial Sequence
  Description of Artificial Sequence: Synthetic peptide
  Seed: MKSRWSGSHQF (BRAF V600M)
MSSRWSGSHQF

SEQ ID NO: 2831 - protein, 11 aa, Artificial Sequence
  Description of Artificial Sequence: Synthetic peptide
  Seed: MKSRWSGSHQF (BRAF V600M)
MSSRWSGSHQH

SEQ ID NO: 2832 - protein, 11 aa, Artificial Sequence
  Description of Artificial Sequence: Synthetic peptide
  Seed: MKSRWSGSHQF (BRAF V600M)
MSSRWSGSHQI

SEQ ID NO: 2833 - protein, 11 aa, Artificial Sequence
  Description of Artificial Sequence: Synthetic peptide
  Seed: MKSRWSGSHQF (BRAF V600M)
MSSRWSGSHQK

SEQ ID NO: 2834 - protein, 11 aa, Artificial Sequence
  Description of Artificial Sequence: Synthetic peptide
  Seed: MKSRWSGSHQF (BRAF V600M)
MSSRWSGSHQL

SEQ ID NO: 2835 - protein, 11 aa, Artificial Sequence
  Description of Artificial Sequence: Synthetic peptide
  Seed: MKSRWSGSHQF (BRAF V600M)
MSSRWSGSHQM

SEQ ID NO: 2836 - protein, 11 aa, Artificial Sequence
  Description of Artificial Sequence: Synthetic peptide
  Seed: MKSRWSGSHQF (BRAF V600M)
MSSRWSGSHQR

SEQ ID NO: 2837 - protein, 11 aa, Artificial Sequence
  Description of Artificial Sequence: Synthetic peptide
  Seed: MKSRWSGSHQF (BRAF V600M)
MSSRWSGSHQV

SEQ ID NO: 2838 - protein, 11 aa, Artificial Sequence
  Description of Artificial Sequence: Synthetic peptide
  Seed: MKSRWSGSHQF (BRAF V600M)
MSSRWSGSHQW

SEQ ID NO: 2839 - protein, 11 aa, Artificial Sequence
  Description of Artificial Sequence: Synthetic peptide
  Seed: MKSRWSGSHQF (BRAF V600M)
MSSRWSGSHQY

SEQ ID NO: 2840 - protein, 9 aa, Artificial Sequence
  Description of Artificial Sequence: Synthetic peptide
  Seed: MKSRWSGSH (BRAF V600M)
MSSRWSGSL

SEQ ID NO: 2841 - protein, 9 aa, Artificial Sequence
  Description of Artificial Sequence: Synthetic peptide
  Seed: MKSRWSGSH (BRAF V600M)
MSSRWSGSM

SEQ ID NO: 2842 - protein, 9 aa, Artificial Sequence
  Description of Artificial Sequence: Synthetic peptide
  Seed: MKSRWSGSH (BRAF V600M)
MSSRWSGSY

SEQ ID NO: 2843 - protein, 9 aa, Artificial Sequence
  Description of Artificial Sequence: Synthetic peptide
  Seed: MKSRWSGSH (BRAF V600M)
MTSRWSGSF

SEQ ID NO: 2844 - protein, 11 aa, Artificial Sequence
  Description of Artificial Sequence: Synthetic peptide
  Seed: MKSRWSGSHQF (BRAF V600M)
MTSRWSGSHQA

SEQ ID NO: 2845 - protein, 11 aa, Artificial Sequence
  Description of Artificial Sequence: Synthetic peptide
  Seed: MKSRWSGSHQF (BRAF V600M)
MTSRWSGSHQF

SEQ ID NO: 2846 - protein, 11 aa, Artificial Sequence
  Description of Artificial Sequence: Synthetic peptide
  Seed: MKSRWSGSHQF (BRAF V600M)
MTSRWSGSHQH

SEQ ID NO: 2847 - protein, 11 aa, Artificial Sequence
  Description of Artificial Sequence: Synthetic peptide
  Seed: MKSRWSGSHQF (BRAF V600M)
MTSRWSGSHQI

SEQ ID NO: 2848 - protein, 11 aa, Artificial Sequence
  Description of Artificial Sequence: Synthetic peptide
  Seed: MKSRWSGSHQF (BRAF V600M)
MTSRWSGSHQK

SEQ ID NO: 2849 - protein, 11 aa, Artificial Sequence
  Description of Artificial Sequence: Synthetic peptide
  Seed: MKSRWSGSHQF (BRAF V600M)
MTSRWSGSHQL

SEQ ID NO: 2850 - protein, 11 aa, Artificial Sequence
  Description of Artificial Sequence: Synthetic peptide
  Seed: MKSRWSGSHQF (BRAF V600M)
MTSRWSGSHQM

SEQ ID NO: 2851 - protein, 11 aa, Artificial Sequence
  Description of Artificial Sequence: Synthetic peptide
  Seed: MKSRWSGSHQF (BRAF V600M)
MTSRWSGSHQR

SEQ ID NO: 2852 - protein, 11 aa, Artificial Sequence
  Description of Artificial Sequence: Synthetic peptide
  Seed: MKSRWSGSHQF (BRAF V600M)
MTSRWSGSHQV

SEQ ID NO: 2853 - protein, 11 aa, Artificial Sequence
  Description of Artificial Sequence: Synthetic peptide
  Seed: MKSRWSGSHQF (BRAF V600M)
MTSRWSGSHQW

SEQ ID NO: 2854 - protein, 11 aa, Artificial Sequence
  Description of Artificial Sequence: Synthetic peptide
  Seed: MKSRWSGSHQF (BRAF V600M)
MTSRWSGSHQY

SEQ ID NO: 2855 - protein, 9 aa, Artificial Sequence
  Description of Artificial Sequence: Synthetic peptide
  Seed: MKSRWSGSH (BRAF V600M)
MTSRWSGSM

SEQ ID NO: 2856 - protein, 9 aa, Artificial Sequence
  Description of Artificial Sequence: Synthetic peptide
  Seed: MKSRWSGSH (BRAF V600M)
MTSRWSGSY

SEQ ID NO: 2857 - protein, 9 aa, Artificial Sequence
  Description of Artificial Sequence: Synthetic peptide
  Seed: MKSRWSGSH (BRAF V600M)
MVSRWSGSF

SEQ ID NO: 2858 - protein, 11 aa, Artificial Sequence
  Description of Artificial Sequence: Synthetic peptide
  Seed: MKSRWSGSHQF (BRAF V600M)
MVSRWSGSHQA

SEQ ID NO: 2859 - protein, 11 aa, Artificial Sequence
  Description of Artificial Sequence: Synthetic peptide
  Seed: MKSRWSGSHQF (BRAF V600M)
MVSRWSGSHQF

SEQ ID NO: 2860 - protein, 11 aa, Artificial Sequence
  Description of Artificial Sequence: Synthetic peptide
  Seed: MKSRWSGSHQF (BRAF V600M)
MVSRWSGSHQH

SEQ ID NO: 2861 - protein, 11 aa, Artificial Sequence
  Description of Artificial Sequence: Synthetic peptide
  Seed: MKSRWSGSHQF (BRAF V600M)
MVSRWSGSHQI

SEQ ID NO: 2862 - protein, 11 aa, Artificial Sequence
  Description of Artificial Sequence: Synthetic peptide
  Seed: MKSRWSGSHQF (BRAF V600M)
MVSRWSGSHQK

SEQ ID NO: 2863 - protein, 11 aa, Artificial Sequence
  Description of Artificial Sequence: Synthetic peptide
  Seed: MKSRWSGSHQF (BRAF V600M)
MVSRWSGSHQL

SEQ ID NO: 2864 - protein, 11 aa, Artificial Sequence
  Description of Artificial Sequence: Synthetic peptide
  Seed: MKSRWSGSHQF (BRAF V600M)
MVSRWSGSHQM

SEQ ID NO: 2865 - protein, 11 aa, Artificial Sequence
  Description of Artificial Sequence: Synthetic peptide
  Seed: MKSRWSGSHQF (BRAF V600M)
MVSRWSGSHQR

SEQ ID NO: 2866 - protein, 11 aa, Artificial Sequence
  Description of Artificial Sequence: Synthetic peptide
  Seed: MKSRWSGSHQF (BRAF V600M)
MVSRWSGSHQV

SEQ ID NO: 2867 - protein, 11 aa, Artificial Sequence
  Description of Artificial Sequence: Synthetic peptide
  Seed: MKSRWSGSHQF (BRAF V600M)
MVSRWSGSHQW

SEQ ID NO: 2868 - protein, 11 aa, Artificial Sequence
  Description of Artificial Sequence: Synthetic peptide
  Seed: MKSRWSGSHQF (BRAF V600M)
MVSRWSGSHQY

SEQ ID NO: 2869 - protein, 9 aa, Artificial Sequence
  Description of Artificial Sequence: Synthetic peptide
  Seed: MKSRWSGSH (BRAF V600M)
MVSRWSGSL

SEQ ID NO: 2870 - protein, 9 aa, Artificial Sequence
  Description of Artificial Sequence: Synthetic peptide
  Seed: MKSRWSGSH (BRAF V600M)
MVSRWSGSM

SEQ ID NO: 2871 - protein, 9 aa, Artificial Sequence
  Description of Artificial Sequence: Synthetic peptide
  Seed: MKSRWSGSH (BRAF V600M)
MVSRWSGSY

SEQ ID NO: 2872 - protein, 9 aa, Artificial Sequence
  Description of Artificial Sequence: Synthetic peptide
  Seed: MKSRWSGSH (BRAF V600M)
MWSRWSGSF

SEQ ID NO: 2873 - protein, 11 aa, Artificial Sequence
  Description of Artificial Sequence: Synthetic peptide
  Seed: MKSRWSGSHQF (BRAF V600M)
MWSRWSGSHQA

SEQ ID NO: 2874 - protein, 11 aa, Artificial Sequence
  Description of Artificial Sequence: Synthetic peptide
  Seed: MKSRWSGSHQF (BRAF V600M)
MWSRWSGSHQF

SEQ ID NO: 2875 - protein, 11 aa, Artificial Sequence
  Description of Artificial Sequence: Synthetic peptide
  Seed: MKSRWSGSHQF (BRAF V600M)
MWSRWSGSHQH

SEQ ID NO: 2876 - protein, 11 aa, Artificial Sequence
  Description of Artificial Sequence: Synthetic peptide
  Seed: MKSRWSGSHQF (BRAF V600M)
MWSRWSGSHQI

SEQ ID NO: 2877 - protein, 11 aa, Artificial Sequence
  Description of Artificial Sequence: Synthetic peptide
  Seed: MKSRWSGSHQF (BRAF V600M)
MWSRWSGSHQK

SEQ ID NO: 2878 - protein, 11 aa, Artificial Sequence
  Description of Artificial Sequence: Synthetic peptide
  Seed: MKSRWSGSHQF (BRAF V600M)
MWSRWSGSHQL

SEQ ID NO: 2879 - protein, 11 aa, Artificial Sequence
  Description of Artificial Sequence: Synthetic peptide
  Seed: MKSRWSGSHQF (BRAF V600M)
MWSRWSGSHQM

SEQ ID NO: 2880 - protein, 11 aa, Artificial Sequence
  Description of Artificial Sequence: Synthetic peptide
  Seed: MKSRWSGSHQF (BRAF V600M)
MWSRWSGSHQR

SEQ ID NO: 2881 - protein, 11 aa, Artificial Sequence
  Description of Artificial Sequence: Synthetic peptide
  Seed: MKSRWSGSHQF (BRAF V600M)
MWSRWSGSHQV

SEQ ID NO: 2882 - protein, 11 aa, Artificial Sequence
  Description of Artificial Sequence: Synthetic peptide
  Seed: MKSRWSGSHQF (BRAF V600M)
MWSRWSGSHQW

SEQ ID NO: 2883 - protein, 11 aa, Artificial Sequence
  Description of Artificial Sequence: Synthetic peptide
  Seed: MKSRWSGSHQF (BRAF V600M)
MWSRWSGSHQY

SEQ ID NO: 2884 - protein, 9 aa, Artificial Sequence
  Description of Artificial Sequence: Synthetic peptide
  Seed: MKSRWSGSH (BRAF V600M)
MWSRWSGSY

SEQ ID NO: 2885 - protein, 9 aa, Artificial Sequence
  Description of Artificial Sequence: Synthetic peptide
  Seed: MKSRWSGSH (BRAF V600M)
MYSRWSGSF

SEQ ID NO: 2886 - protein, 11 aa, Artificial Sequence
  Description of Artificial Sequence: Synthetic peptide
  Seed: MKSRWSGSHQF (BRAF V600M)
MYSRWSGSHQA

SEQ ID NO: 2887 - protein, 11 aa, Artificial Sequence
  Description of Artificial Sequence: Synthetic peptide
  Seed: MKSRWSGSHQF (BRAF V600M)
MYSRWSGSHQF

SEQ ID NO: 2888 - protein, 11 aa, Artificial Sequence
  Description of Artificial Sequence: Synthetic peptide
  Seed: MKSRWSGSHQF (BRAF V600M)
MYSRWSGSHQH

SEQ ID NO: 2889 - protein, 11 aa, Artificial Sequence
  Description of Artificial Sequence: Synthetic peptide
  Seed: MKSRWSGSHQF (BRAF V600M)
MYSRWSGSHQI

SEQ ID NO: 2890 - protein, 11 aa, Artificial Sequence
  Description of Artificial Sequence: Synthetic peptide
  Seed: MKSRWSGSHQF (BRAF V600M)
MYSRWSGSHQK

SEQ ID NO: 2891 - protein, 11 aa, Artificial Sequence
  Description of Artificial Sequence: Synthetic peptide
  Seed: MKSRWSGSHQF (BRAF V600M)
MYSRWSGSHQL

SEQ ID NO: 2892 - protein, 11 aa, Artificial Sequence
  Description of Artificial Sequence: Synthetic peptide
  Seed: MKSRWSGSHQF (BRAF V600M)
MYSRWSGSHQM

SEQ ID NO: 2893 - protein, 11 aa, Artificial Sequence
  Description of Artificial Sequence: Synthetic peptide
  Seed: MKSRWSGSHQF (BRAF V600M)
MYSRWSGSHQR

SEQ ID NO: 2894 - protein, 11 aa, Artificial Sequence
  Description of Artificial Sequence: Synthetic peptide
  Seed: MKSRWSGSHQF (BRAF V600M)
MYSRWSGSHQV

SEQ ID NO: 2895 - protein, 11 aa, Artificial Sequence
  Description of Artificial Sequence: Synthetic peptide
  Seed: MKSRWSGSHQF (BRAF V600M)
MYSRWSGSHQW

SEQ ID NO: 2896 - protein, 11 aa, Artificial Sequence
  Description of Artificial Sequence: Synthetic peptide
  Seed: MKSRWSGSHQF (BRAF V600M)
MYSRWSGSHQY

SEQ ID NO: 2897 - protein, 9 aa, Artificial Sequence
  Description of Artificial Sequence: Synthetic peptide
  Seed: MKSRWSGSH (BRAF V600M)
MYSRWSGSM

SEQ ID NO: 2898 - protein, 9 aa, Artificial Sequence
  Description of Artificial Sequence: Synthetic peptide
  Seed: MKSRWSGSH (BRAF V600M)
MYSRWSGSY

SEQ ID NO: 2899 - protein, 10 aa, Artificial Sequence
  Description of Artificial Sequence: Synthetic peptide
  Seed: DFGLATMKSR (BRAF V600M)
DAGLATMKSR

SEQ ID NO: 2900 - protein, 10 aa, Artificial Sequence
  Description of Artificial Sequence: Synthetic peptide
  Seed: DFGLATMKSR (BRAF V600M)
DFGLATMKSK

SEQ ID NO: 2901 - protein, 10 aa, Artificial Sequence
  Description of Artificial Sequence: Synthetic peptide
  Seed: DFGLATMKSR (BRAF V600M)
DGGLATMKSR

SEQ ID NO: 2902 - protein, 10 aa, Artificial Sequence
  Description of Artificial Sequence: Synthetic peptide
  Seed: DFGLATMKSR (BRAF V600M)
DLGLATMKSR

SEQ ID NO: 2903 - protein, 10 aa, Artificial Sequence
  Description of Artificial Sequence: Synthetic peptide
  Seed: DFGLATMKSR (BRAF V600M)
DNGLATMKSR

SEQ ID NO: 2904 - protein, 10 aa, Artificial Sequence
  Description of Artificial Sequence: Synthetic peptide
  Seed: DFGLATMKSR (BRAF V600M)
DQGLATMKSR

SEQ ID NO: 2905 - protein, 10 aa, Artificial Sequence
  Description of Artificial Sequence: Synthetic peptide
  Seed: DFGLATMKSR (BRAF V600M)
DYGLATMKSK

SEQ ID NO: 2906 - protein, 9 aa, Artificial Sequence
  Description of Artificial Sequence: Synthetic peptide
  Seed: FGLATMKSR (BRAF V600M)
FALATMKSK

SEQ ID NO: 2907 - protein, 9 aa, Artificial Sequence
  Description of Artificial Sequence: Synthetic peptide
  Seed: FGLATMKSR (BRAF V600M)
FCLATMKSR

SEQ ID NO: 2908 - protein, 9 aa, Artificial Sequence
  Description of Artificial Sequence: Synthetic peptide
  Seed: FGLATMKSR (BRAF V600M)
FDLATMKSK

SEQ ID NO: 2909 - protein, 9 aa, Artificial Sequence
  Description of Artificial Sequence: Synthetic peptide
  Seed: FGLATMKSR (BRAF V600M)
FDLATMKSR

SEQ ID NO: 2910 - protein, 10 aa, Artificial Sequence
  Description of Artificial Sequence: Synthetic peptide
  Seed: FGLATMKSRW (BRAF V600M)
FDLATMKSRW

SEQ ID NO: 2911 - protein, 9 aa, Artificial Sequence
  Description of Artificial Sequence: Synthetic peptide
  Seed: FGLATMKSR (BRAF V600M)
FELATMKSR

SEQ ID NO: 2912 - protein, 9 aa, Artificial Sequence
  Description of Artificial Sequence: Synthetic peptide
  Seed: FGLATMKSR (BRAF V600M)
FGLATMKSK

SEQ ID NO: 2913 - protein, 9 aa, Artificial Sequence
  Description of Artificial Sequence: Synthetic peptide
  Seed: FGLATMKSR (BRAF V600M)
FHLATMKSR

SEQ ID NO: 2914 - protein, 9 aa, Artificial Sequence
  Description of Artificial Sequence: Synthetic peptide
  Seed: FGLATMKSR (BRAF V600M)
FILATMKSK

SEQ ID NO: 2915 - protein, 9 aa, Artificial Sequence
  Description of Artificial Sequence: Synthetic peptide
  Seed: FGLATMKSR (BRAF V600M)
FILATMKSL

SEQ ID NO: 2916 - protein, 9 aa, Artificial Sequence
  Description of Artificial Sequence: Synthetic peptide
  Seed: FGLATMKSR (BRAF V600M)
FILATMKSV

SEQ ID NO: 2917 - protein, 9 aa, Artificial Sequence
  Description of Artificial Sequence: Synthetic peptide
  Seed: FGLATMKSR (BRAF V600M)
FILATMKSY

SEQ ID NO: 2918 - protein, 9 aa, Artificial Sequence
  Description of Artificial Sequence: Synthetic peptide
  Seed: FGLATMKSR (BRAF V600M)
FLLATMKSI

SEQ ID NO: 2919 - protein, 9 aa, Artificial Sequence
  Description of Artificial Sequence: Synthetic peptide
  Seed: FGLATMKSR (BRAF V600M)
FLLATMKSK

SEQ ID NO: 2920 - protein, 9 aa, Artificial Sequence
  Description of Artificial Sequence: Synthetic peptide
  Seed: FGLATMKSR (BRAF V600M)
FLLATMKSL

SEQ ID NO: 2921 - protein, 9 aa, Artificial Sequence
  Description of Artificial Sequence: Synthetic peptide
  Seed: FGLATMKSR (BRAF V600M)
FLLATMKSM

SEQ ID NO: 2922 - protein, 9 aa, Artificial Sequence
  Description of Artificial Sequence: Synthetic peptide
  Seed: FGLATMKSR (BRAF V600M)
FLLATMKSV

SEQ ID NO: 2923 - protein, 9 aa, Artificial Sequence
  Description of Artificial Sequence: Synthetic peptide
  Seed: FGLATMKSR (BRAF V600M)
FLLATMKSY

SEQ ID NO: 2924 - protein, 9 aa, Artificial Sequence
  Description of Artificial Sequence: Synthetic peptide
  Seed: FGLATMKSR (BRAF V600M)
FMLATMKSF

SEQ ID NO: 2925 - protein, 9 aa, Artificial Sequence
  Description of Artificial Sequence: Synthetic peptide
  Seed: FGLATMKSR (BRAF V600M)
FMLATMKSI

SEQ ID NO: 2926 - protein, 9 aa, Artificial Sequence
  Description of Artificial Sequence: Synthetic peptide
  Seed: FGLATMKSR (BRAF V600M)
FMLATMKSL

SEQ ID NO: 2927 - protein, 9 aa, Artificial Sequence
  Description of Artificial Sequence: Synthetic peptide
  Seed: FGLATMKSR (BRAF V600M)
FMLATMKSM

SEQ ID NO: 2928 - protein, 9 aa, Artificial Sequence
  Description of Artificial Sequence: Synthetic peptide
  Seed: FGLATMKSR (BRAF V600M)
FMLATMKSV

SEQ ID NO: 2929 - protein, 9 aa, Artificial Sequence
  Description of Artificial Sequence: Synthetic peptide
  Seed: FGLATMKSR (BRAF V600M)
FMLATMKSY

SEQ ID NO: 2930 - protein, 9 aa, Artificial Sequence
  Description of Artificial Sequence: Synthetic peptide
  Seed: FGLATMKSR (BRAF V600M)
FNLATMKSK

SEQ ID NO: 2931 - protein, 9 aa, Artificial Sequence
  Description of Artificial Sequence: Synthetic peptide
  Seed: FGLATMKSR (BRAF V600M)
FPLATMKSK

SEQ ID NO: 2932 - protein, 9 aa, Artificial Sequence
  Description of Artificial Sequence: Synthetic peptide
  Seed: FGLATMKSR (BRAF V600M)
FPLATMKSR

SEQ ID NO: 2933 - protein, 10 aa, Artificial Sequence
  Description of Artificial Sequence: Synthetic peptide
  Seed: FGLATMKSRW (BRAF V600M)
FPLATMKSRW

SEQ ID NO: 2934 - protein, 9 aa, Artificial Sequence
  Description of Artificial Sequence: Synthetic peptide
  Seed: FGLATMKSR (BRAF V600M)
FQLATMKSK

SEQ ID NO: 2935 - protein, 9 aa, Artificial Sequence
  Description of Artificial Sequence: Synthetic peptide
  Seed: FGLATMKSR (BRAF V600M)
FSLATMKSK

SEQ ID NO: 2936 - protein, 9 aa, Artificial Sequence
  Description of Artificial Sequence: Synthetic peptide
  Seed: FGLATMKSR (BRAF V600M)
FTLATMKSH

SEQ ID NO: 2937 - protein, 9 aa, Artificial Sequence
  Description of Artificial Sequence: Synthetic peptide
  Seed: FGLATMKSR (BRAF V600M)
FTLATMKSL

SEQ ID NO: 2938 - protein, 9 aa, Artificial Sequence
  Description of Artificial Sequence: Synthetic peptide
  Seed: FGLATMKSR (BRAF V600M)
FTLATMKSM

SEQ ID NO: 2939 - protein, 9 aa, Artificial Sequence
  Description of Artificial Sequence: Synthetic peptide
  Seed: FGLATMKSR (BRAF V600M)
FTLATMKSY

SEQ ID NO: 2940 - protein, 9 aa, Artificial Sequence
  Description of Artificial Sequence: Synthetic peptide
  Seed: FGLATMKSR (BRAF V600M)
FVLATMKSH

SEQ ID NO: 2941 - protein, 9 aa, Artificial Sequence
  Description of Artificial Sequence: Synthetic peptide
  Seed: FGLATMKSR (BRAF V600M)
FVLATMKSK

SEQ ID NO: 2942 - protein, 9 aa, Artificial Sequence
  Description of Artificial Sequence: Synthetic peptide
  Seed: FGLATMKSR (BRAF V600M)
FVLATMKSL

SEQ ID NO: 2943 - protein, 9 aa, Artificial Sequence
  Description of Artificial Sequence: Synthetic peptide
  Seed: FGLATMKSR (BRAF V600M)
FVLATMKSY

SEQ ID NO: 2944 - protein, 9 aa, Artificial Sequence
  Description of Artificial Sequence: Synthetic peptide
  Seed: GLATMKSRW (BRAF V600M)
GAATMKSRF

SEQ ID NO: 2945 - protein, 9 aa, Artificial Sequence
  Description of Artificial Sequence: Synthetic peptide
  Seed: GLATMKSRW (BRAF V600M)
GAATMKSRW

SEQ ID NO: 2946 - protein, 9 aa, Artificial Sequence
  Description of Artificial Sequence: Synthetic peptide
  Seed: GDFGLATMK (BRAF V600M)
GAFGLATMH

SEQ ID NO: 2947 - protein, 9 aa, Artificial Sequence
  Description of Artificial Sequence: Synthetic peptide
  Seed: GDFGLATMK (BRAF V600M)
GAFGLATMK

SEQ ID NO: 2948 - protein, 9 aa, Artificial Sequence
  Description of Artificial Sequence: Synthetic peptide
  Seed: GDFGLATMK (BRAF V600M)
GAFGLATMR

SEQ ID NO: 2949 - protein, 9 aa, Artificial Sequence
  Description of Artificial Sequence: Synthetic peptide
  Seed: GDFGLATMK (BRAF V600M)
GAFGLATMY

SEQ ID NO: 2950 - protein, 9 aa, Artificial Sequence
  Description of Artificial Sequence: Synthetic peptide
  Seed: GLATMKSRW (BRAF V600M)
GCATMKSRW

SEQ ID NO: 2951 - protein, 9 aa, Artificial Sequence
  Description of Artificial Sequence: Synthetic peptide
  Seed: GDFGLATMK (BRAF V600M)
GCFGLATMK

SEQ ID NO: 2952 - protein, 9 aa, Artificial Sequence
  Description of Artificial Sequence: Synthetic peptide
  Seed: GLATMKSRW (BRAF V600M)
GDATMKSRW

SEQ ID NO: 2953 - protein, 9 aa, Artificial Sequence
  Description of Artificial Sequence: Synthetic peptide
  Seed: GDFGLATMK (BRAF V600M)
GDFGLATMR

SEQ ID NO: 2954 - protein, 9 aa, Artificial Sequence
  Description of Artificial Sequence: Synthetic peptide
  Seed: GLATMKSRW (BRAF V600M)
GEATMKSRF

SEQ ID NO: 2955 - protein, 9 aa, Artificial Sequence
  Description of Artificial Sequence: Synthetic peptide
  Seed: GDFGLATMK (BRAF V600M)
GEFGLATMK

SEQ ID NO: 2956 - protein, 9 aa, Artificial Sequence
  Description of Artificial Sequence: Synthetic peptide
  Seed: GDFGLATMK (BRAF V600M)
GFFGLATMK

SEQ ID NO: 2957 - protein, 9 aa, Artificial Sequence
  Description of Artificial Sequence: Synthetic peptide
  Seed: GLATMKSRW (BRAF V600M)
GGATMKSRW

SEQ ID NO: 2958 - protein, 9 aa, Artificial Sequence
  Description of Artificial Sequence: Synthetic peptide
  Seed: GDFGLATMK (BRAF V600M)
GGFGLATMK

SEQ ID NO: 2959 - protein, 9 aa, Artificial Sequence
  Description of Artificial Sequence: Synthetic peptide
  Seed: GDFGLATMK (BRAF V600M)
GGFGLATMR

SEQ ID NO: 2960 - protein, 9 aa, Artificial Sequence
  Description of Artificial Sequence: Synthetic peptide
  Seed: GLATMKSRW (BRAF V600M)
GIATMKSRF

SEQ ID NO: 2961 - protein, 9 aa, Artificial Sequence
  Description of Artificial Sequence: Synthetic peptide
  Seed: GLATMKSRW (BRAF V600M)
GIATMKSRW

SEQ ID NO: 2962 - protein, 9 aa, Artificial Sequence
  Description of Artificial Sequence: Synthetic peptide
  Seed: GDFGLATMK (BRAF V600M)
GIFGLATMH

SEQ ID NO: 2963 - protein, 9 aa, Artificial Sequence
  Description of Artificial Sequence: Synthetic peptide
  Seed: GDFGLATMK (BRAF V600M)
GIFGLATMK

SEQ ID NO: 2964 - protein, 9 aa, Artificial Sequence
  Description of Artificial Sequence: Synthetic peptide
  Seed: GDFGLATMK (BRAF V600M)
GIFGLATMR

SEQ ID NO: 2965 - protein, 9 aa, Artificial Sequence
  Description of Artificial Sequence: Synthetic peptide
  Seed: GDFGLATMK (BRAF V600M)
GIFGLATMY

SEQ ID NO: 2966 - protein, 9 aa, Artificial Sequence
  Description of Artificial Sequence: Synthetic peptide
  Seed: GLATMKSRW (BRAF V600M)
GLATMKSRF

SEQ ID NO: 2967 - protein, 9 aa, Artificial Sequence
  Description of Artificial Sequence: Synthetic peptide
  Seed: GLATMKSRW (BRAF V600M)
GLATMKSRI

SEQ ID NO: 2968 - protein, 9 aa, Artificial Sequence
  Description of Artificial Sequence: Synthetic peptide
  Seed: GLATMKSRW (BRAF V600M)
GLATMKSRL

SEQ ID NO: 2969 - protein, 9 aa, Artificial Sequence
  Description of Artificial Sequence: Synthetic peptide
  Seed: GDFGLATMK (BRAF V600M)
GLFGLATMK

SEQ ID NO: 2970 - protein, 9 aa, Artificial Sequence
  Description of Artificial Sequence: Synthetic peptide
  Seed: GDFGLATMK (BRAF V600M)
GLFGLATMR

SEQ ID NO: 2971 - protein, 9 aa, Artificial Sequence
  Description of Artificial Sequence: Synthetic peptide
  Seed: GLATMKSRW (BRAF V600M)
GMATMKSRF

SEQ ID NO: 2972 - protein, 9 aa, Artificial Sequence
  Description of Artificial Sequence: Synthetic peptide
  Seed: GLATMKSRW (BRAF V600M)
GMATMKSRI

SEQ ID NO: 2973 - protein, 9 aa, Artificial Sequence
  Description of Artificial Sequence: Synthetic peptide
  Seed: GLATMKSRW (BRAF V600M)
GMATMKSRL

SEQ ID NO: 2974 - protein, 9 aa, Artificial Sequence
  Description of Artificial Sequence: Synthetic peptide
  Seed: GLATMKSRW (BRAF V600M)
GMATMKSRW

SEQ ID NO: 2975 - protein, 9 aa, Artificial Sequence
  Description of Artificial Sequence: Synthetic peptide
  Seed: GLATMKSRW (BRAF V600M)
GMATMKSRY

SEQ ID NO: 2976 - protein, 9 aa, Artificial Sequence
  Description of Artificial Sequence: Synthetic peptide
  Seed: GDFGLATMK (BRAF V600M)
GMFGLATMK

SEQ ID NO: 2977 - protein, 9 aa, Artificial Sequence
  Description of Artificial Sequence: Synthetic peptide
  Seed: GDFGLATMK (BRAF V600M)
GMFGLATMR

SEQ ID NO: 2978 - protein, 9 aa, Artificial Sequence
  Description of Artificial Sequence: Synthetic peptide
  Seed: GDFGLATMK (BRAF V600M)
GMFGLATMY

SEQ ID NO: 2979 - protein, 9 aa, Artificial Sequence
  Description of Artificial Sequence: Synthetic peptide
  Seed: GLATMKSRW (BRAF V600M)
GNATMKSRW

SEQ ID NO: 2980 - protein, 9 aa, Artificial Sequence
  Description of Artificial Sequence: Synthetic peptide
  Seed: GDFGLATMK (BRAF V600M)
GNFGLATMK

SEQ ID NO: 2981 - protein, 9 aa, Artificial Sequence
  Description of Artificial Sequence: Synthetic peptide
  Seed: GDFGLATMK (BRAF V600M)
GNFGLATMR

SEQ ID NO: 2982 - protein, 9 aa, Artificial Sequence
  Description of Artificial Sequence: Synthetic peptide
  Seed: GLATMKSRW (BRAF V600M)
GPATMKSRW

SEQ ID NO: 2983 - protein, 9 aa, Artificial Sequence
  Description of Artificial Sequence: Synthetic peptide
  Seed: GDFGLATMK (BRAF V600M)
GPFGLATMK

SEQ ID NO: 2984 - protein, 9 aa, Artificial Sequence
  Description of Artificial Sequence: Synthetic peptide
  Seed: GDFGLATMK (BRAF V600M)
GPFGLATMR

SEQ ID NO: 2985 - protein, 9 aa, Artificial Sequence
  Description of Artificial Sequence: Synthetic peptide
  Seed: GLATMKSRW (BRAF V600M)
GQATMKSRF

SEQ ID NO: 2986 - protein, 9 aa, Artificial Sequence
  Description of Artificial Sequence: Synthetic peptide
  Seed: GLATMKSRW (BRAF V600M)
GQATMKSRI

SEQ ID NO: 2987 - protein, 9 aa, Artificial Sequence
  Description of Artificial Sequence: Synthetic peptide
  Seed: GLATMKSRW (BRAF V600M)
GQATMKSRL

SEQ ID NO: 2988 - protein, 9 aa, Artificial Sequence
  Description of Artificial Sequence: Synthetic peptide
  Seed: GLATMKSRW (BRAF V600M)
GQATMKSRM

SEQ ID NO: 2989 - protein, 9 aa, Artificial Sequence
  Description of Artificial Sequence: Synthetic peptide
  Seed: GLATMKSRW (BRAF V600M)
GQATMKSRV

SEQ ID NO: 2990 - protein, 9 aa, Artificial Sequence
  Description of Artificial Sequence: Synthetic peptide
  Seed: GLATMKSRW (BRAF V600M)
GQATMKSRW

SEQ ID NO: 2991 - protein, 9 aa, Artificial Sequence
  Description of Artificial Sequence: Synthetic peptide
  Seed: GDFGLATMK (BRAF V600M)
GQFGLATMK

SEQ ID NO: 2992 - protein, 9 aa, Artificial Sequence
  Description of Artificial Sequence: Synthetic peptide
  Seed: GDFGLATMK (BRAF V600M)
GQFGLATMR

SEQ ID NO: 2993 - protein, 9 aa, Artificial Sequence
  Description of Artificial Sequence: Synthetic peptide
  Seed: GLATMKSRW (BRAF V600M)
GSATMKSRF

SEQ ID NO: 2994 - protein, 9 aa, Artificial Sequence
  Description of Artificial Sequence: Synthetic peptide
  Seed: GLATMKSRW (BRAF V600M)
GSATMKSRL

SEQ ID NO: 2995 - protein, 9 aa, Artificial Sequence
  Description of Artificial Sequence: Synthetic peptide
  Seed: GDFGLATMK (BRAF V600M)
GSFGLATMH

SEQ ID NO: 2996 - protein, 9 aa, Artificial Sequence
  Description of Artificial Sequence: Synthetic peptide
  Seed: GDFGLATMK (BRAF V600M)
GSFGLATMK

SEQ ID NO: 2997 - protein, 9 aa, Artificial Sequence
  Description of Artificial Sequence: Synthetic peptide
  Seed: GDFGLATMK (BRAF V600M)
GSFGLATMR

SEQ ID NO: 2998 - protein, 9 aa, Artificial Sequence
  Description of Artificial Sequence: Synthetic peptide
  Seed: GDFGLATMK (BRAF V600M)
GSFGLATMY

SEQ ID NO: 2999 - protein, 9 aa, Artificial Sequence
  Description of Artificial Sequence: Synthetic peptide
  Seed: GLATMKSRW (BRAF V600M)
GTATMKSRF

SEQ ID NO: 3000 - protein, 9 aa, Artificial Sequence
  Description of Artificial Sequence: Synthetic peptide
  Seed: GLATMKSRW (BRAF V600M)
GTATMKSRY

SEQ ID NO: 3001 - protein, 9 aa, Artificial Sequence
  Description of Artificial Sequence: Synthetic peptide
  Seed: GDFGLATMK (BRAF V600M)
GTFGLATMH

SEQ ID NO: 3002 - protein, 9 aa, Artificial Sequence
  Description of Artificial Sequence: Synthetic peptide
  Seed: GDFGLATMK (BRAF V600M)
GTFGLATMK

SEQ ID NO: 3003 - protein, 9 aa, Artificial Sequence
  Description of Artificial Sequence: Synthetic peptide
  Seed: GDFGLATMK (BRAF V600M)
GTFGLATMR

SEQ ID NO: 3004 - protein, 9 aa, Artificial Sequence
  Description of Artificial Sequence: Synthetic peptide
  Seed: GDFGLATMK (BRAF V600M)
GTFGLATMY

SEQ ID NO: 3005 - protein, 9 aa, Artificial Sequence
  Description of Artificial Sequence: Synthetic peptide
  Seed: GLATMKSRW (BRAF V600M)
GVATMKSRF

SEQ ID NO: 3006 - protein, 9 aa, Artificial Sequence
  Description of Artificial Sequence: Synthetic peptide
  Seed: GLATMKSRW (BRAF V600M)
GVATMKSRW

SEQ ID NO: 3007 - protein, 9 aa, Artificial Sequence
  Description of Artificial Sequence: Synthetic peptide
  Seed: GDFGLATMK (BRAF V600M)
GVFGLATMH

SEQ ID NO: 3008 - protein, 9 aa, Artificial Sequence
  Description of Artificial Sequence: Synthetic peptide
  Seed: GDFGLATMK (BRAF V600M)
GVFGLATMK

SEQ ID NO: 3009 - protein, 9 aa, Artificial Sequence
  Description of Artificial Sequence: Synthetic peptide
  Seed: GDFGLATMK (BRAF V600M)
GVFGLATMR

SEQ ID NO: 3010 - protein, 9 aa, Artificial Sequence
  Description of Artificial Sequence: Synthetic peptide
  Seed: GDFGLATMK (BRAF V600M)
GVFGLATMY

SEQ ID NO: 3011 - protein, 9 aa, Artificial Sequence
  Description of Artificial Sequence: Synthetic peptide
  Seed: GDFGLATMK (BRAF V600M)
GYFGLATMK

SEQ ID NO: 3012 - protein, 10 aa, Artificial Sequence
  Description of Artificial Sequence: Synthetic peptide
  Seed: IGDFGLATMK (BRAF V600M)
IADFGLATMF

SEQ ID NO: 3013 - protein, 10 aa, Artificial Sequence
  Description of Artificial Sequence: Synthetic peptide
  Seed: IGDFGLATMK (BRAF V600M)
IADFGLATMH

SEQ ID NO: 3014 - protein, 10 aa, Artificial Sequence
  Description of Artificial Sequence: Synthetic peptide
  Seed: IGDFGLATMK (BRAF V600M)
IADFGLATMK

SEQ ID NO: 3015 - protein, 10 aa, Artificial Sequence
  Description of Artificial Sequence: Synthetic peptide
  Seed: IGDFGLATMK (BRAF V600M)
IADFGLATML

SEQ ID NO: 3016 - protein, 10 aa, Artificial Sequence
  Description of Artificial Sequence: Synthetic peptide
  Seed: IGDFGLATMK (BRAF V600M)
IADFGLATMM

SEQ ID NO: 3017 - protein, 10 aa, Artificial Sequence
  Description of Artificial Sequence: Synthetic peptide
  Seed: IGDFGLATMK (BRAF V600M)
IADFGLATMR

SEQ ID NO: 3018 - protein, 10 aa, Artificial Sequence
  Description of Artificial Sequence: Synthetic peptide
  Seed: IGDFGLATMK (BRAF V600M)
IADFGLATMW

SEQ ID NO: 3019 - protein, 10 aa, Artificial Sequence
  Description of Artificial Sequence: Synthetic peptide
  Seed: IGDFGLATMK (BRAF V600M)
IADFGLATMY

SEQ ID NO: 3020 - protein, 10 aa, Artificial Sequence
  Description of Artificial Sequence: Synthetic peptide
  Seed: IGDFGLATMK (BRAF V600M)
ICDFGLATMK

SEQ ID NO: 3021 - protein, 10 aa, Artificial Sequence
  Description of Artificial Sequence: Synthetic peptide
  Seed: IGDFGLATMK (BRAF V600M)
ICDFGLATMY

SEQ ID NO: 3022 - protein, 10 aa, Artificial Sequence
  Description of Artificial Sequence: Synthetic peptide
  Seed: IGDFGLATMK (BRAF V600M)
IDDFGLATMK

SEQ ID NO: 3023 - protein, 10 aa, Artificial Sequence
  Description of Artificial Sequence: Synthetic peptide
  Seed: IGDFGLATMK (BRAF V600M)
IDDFGLATMY

SEQ ID NO: 3024 - protein, 10 aa, Artificial Sequence
  Description of Artificial Sequence: Synthetic peptide
  Seed: IGDFGLATMK (BRAF V600M)
IEDFGLATMK

SEQ ID NO: 3025 - protein, 10 aa, Artificial Sequence
  Description of Artificial Sequence: Synthetic peptide
  Seed: IGDFGLATMK (BRAF V600M)
IEDFGLATMR

SEQ ID NO: 3026 - protein, 10 aa, Artificial Sequence
  Description of Artificial Sequence: Synthetic peptide
  Seed: IGDFGLATMK (BRAF V600M)
IEDFGLATMY

SEQ ID NO: 3027 - protein, 10 aa, Artificial Sequence
  Description of Artificial Sequence: Synthetic peptide
  Seed: IGDFGLATMK (BRAF V600M)
IFDFGLATMF

SEQ ID NO: 3028 - protein, 10 aa, Artificial Sequence
  Description of Artificial Sequence: Synthetic peptide
  Seed: IGDFGLATMK (BRAF V600M)
IFDFGLATMK

SEQ ID NO: 3029 - protein, 10 aa, Artificial Sequence
  Description of Artificial Sequence: Synthetic peptide
  Seed: IGDFGLATMK (BRAF V600M)
IFDFGLATMR

SEQ ID NO: 3030 - protein, 10 aa, Artificial Sequence
  Description of Artificial Sequence: Synthetic peptide
  Seed: IGDFGLATMK (BRAF V600M)
IFDFGLATMY

SEQ ID NO: 3031 - protein, 10 aa, Artificial Sequence
  Description of Artificial Sequence: Synthetic peptide
  Seed: IGDFGLATMK (BRAF V600M)
IGDFGLATMF

SEQ ID NO: 3032 - protein, 10 aa, Artificial Sequence
  Description of Artificial Sequence: Synthetic peptide
  Seed: IGDFGLATMK (BRAF V600M)
IGDFGLATMR

SEQ ID NO: 3033 - protein, 10 aa, Artificial Sequence
  Description of Artificial Sequence: Synthetic peptide
  Seed: IGDFGLATMK (BRAF V600M)
IGDFGLATMY

SEQ ID NO: 3034 - protein, 10 aa, Artificial Sequence
  Description of Artificial Sequence: Synthetic peptide
  Seed: IGDFGLATMK (BRAF V600M)
IHDFGLATMY

SEQ ID NO: 3035 - protein, 10 aa, Artificial Sequence
  Description of Artificial Sequence: Synthetic peptide
  Seed: IGDFGLATMK (BRAF V600M)
IIDFGLATMF

SEQ ID NO: 3036 - protein, 10 aa, Artificial Sequence
  Description of Artificial Sequence: Synthetic peptide
  Seed: IGDFGLATMK (BRAF V600M)
IIDFGLATMH

SEQ ID NO: 3037 - protein, 10 aa, Artificial Sequence
  Description of Artificial Sequence: Synthetic peptide
  Seed: IGDFGLATMK (BRAF V600M)
IIDFGLATMK

SEQ ID NO: 3038 - protein, 10 aa, Artificial Sequence
  Description of Artificial Sequence: Synthetic peptide
  Seed: IGDFGLATMK (BRAF V600M)
IIDFGLATMM

SEQ ID NO: 3039 - protein, 10 aa, Artificial Sequence
  Description of Artificial Sequence: Synthetic peptide
  Seed: IGDFGLATMK (BRAF V600M)
IIDFGLATMR

SEQ ID NO: 3040 - protein, 10 aa, Artificial Sequence
  Description of Artificial Sequence: Synthetic peptide
  Seed: IGDFGLATMK (BRAF V600M)
IIDFGLATMW

SEQ ID NO: 3041 - protein, 10 aa, Artificial Sequence
  Description of Artificial Sequence: Synthetic peptide
  Seed: IGDFGLATMK (BRAF V600M)
IIDFGLATMY

SEQ ID NO: 3042 - protein, 10 aa, Artificial Sequence
  Description of Artificial Sequence: Synthetic peptide
  Seed: IGDFGLATMK (BRAF V600M)
IKDFGLATMY

SEQ ID NO: 3043 - protein, 10 aa, Artificial Sequence
  Description of Artificial Sequence: Synthetic peptide
  Seed: IGDFGLATMK (BRAF V600M)
ILDFGLATMF

SEQ ID NO: 3044 - protein, 10 aa, Artificial Sequence
  Description of Artificial Sequence: Synthetic peptide
  Seed: IGDFGLATMK (BRAF V600M)
ILDFGLATMH

SEQ ID NO: 3045 - protein, 10 aa, Artificial Sequence
  Description of Artificial Sequence: Synthetic peptide
  Seed: IGDFGLATMK (BRAF V600M)
ILDFGLATMK

SEQ ID NO: 3046 - protein, 10 aa, Artificial Sequence
  Description of Artificial Sequence: Synthetic peptide
  Seed: IGDFGLATMK (BRAF V600M)
ILDFGLATMR

SEQ ID NO: 3047 - protein, 10 aa, Artificial Sequence
  Description of Artificial Sequence: Synthetic peptide
  Seed: IGDFGLATMK (BRAF V600M)
ILDFGLATMW

SEQ ID NO: 3048 - protein, 10 aa, Artificial Sequence
  Description of Artificial Sequence: Synthetic peptide
  Seed: IGDFGLATMK (BRAF V600M)
ILDFGLATMY

SEQ ID NO: 3049 - protein, 10 aa, Artificial Sequence
  Description of Artificial Sequence: Synthetic peptide
  Seed: IGDFGLATMK (BRAF V600M)
IMDFGLATMF

SEQ ID NO: 3050 - protein, 10 aa, Artificial Sequence
  Description of Artificial Sequence: Synthetic peptide
  Seed: IGDFGLATMK (BRAF V600M)
IMDFGLATMH

SEQ ID NO: 3051 - protein, 10 aa, Artificial Sequence
  Description of Artificial Sequence: Synthetic peptide
  Seed: IGDFGLATMK (BRAF V600M)
IMDFGLATMK

SEQ ID NO: 3052 - protein, 10 aa, Artificial Sequence
  Description of Artificial Sequence: Synthetic peptide
  Seed: IGDFGLATMK (BRAF V600M)
IMDFGLATML

SEQ ID NO: 3053 - protein, 10 aa, Artificial Sequence
  Description of Artificial Sequence: Synthetic peptide
  Seed: IGDFGLATMK (BRAF V600M)
IMDFGLATMM

SEQ ID NO: 3054 - protein, 10 aa, Artificial Sequence
  Description of Artificial Sequence: Synthetic peptide
  Seed: IGDFGLATMK (BRAF V600M)
IMDFGLATMR

SEQ ID NO: 3055 - protein, 10 aa, Artificial Sequence
  Description of Artificial Sequence: Synthetic peptide
  Seed: IGDFGLATMK (BRAF V600M)
IMDFGLATMW

SEQ ID NO: 3056 - protein, 10 aa, Artificial Sequence
  Description of Artificial Sequence: Synthetic peptide
  Seed: IGDFGLATMK (BRAF V600M)
IMDFGLATMY

SEQ ID NO: 3057 - protein, 10 aa, Artificial Sequence
  Description of Artificial Sequence: Synthetic peptide
  Seed: IGDFGLATMK (BRAF V600M)
INDFGLATMK

SEQ ID NO: 3058 - protein, 10 aa, Artificial Sequence
  Description of Artificial Sequence: Synthetic peptide
  Seed: IGDFGLATMK (BRAF V600M)
INDFGLATMR

SEQ ID NO: 3059 - protein, 10 aa, Artificial Sequence
  Description of Artificial Sequence: Synthetic peptide
  Seed: IGDFGLATMK (BRAF V600M)
INDFGLATMY

SEQ ID NO: 3060 - protein, 10 aa, Artificial Sequence
  Description of Artificial Sequence: Synthetic peptide
  Seed: IGDFGLATMK (BRAF V600M)
IPDFGLATMY

SEQ ID NO: 3061 - protein, 10 aa, Artificial Sequence
  Description of Artificial Sequence: Synthetic peptide
  Seed: IGDFGLATMK (BRAF V600M)
IQDFGLATMK

SEQ ID NO: 3062 - protein, 10 aa, Artificial Sequence
  Description of Artificial Sequence: Synthetic peptide
  Seed: IGDFGLATMK (BRAF V600M)
IQDFGLATMR

SEQ ID NO: 3063 - protein, 10 aa, Artificial Sequence
  Description of Artificial Sequence: Synthetic peptide
  Seed: IGDFGLATMK (BRAF V600M)
IQDFGLATMY

SEQ ID NO: 3064 - protein, 10 aa, Artificial Sequence
  Description of Artificial Sequence: Synthetic peptide
  Seed: IGDFGLATMK (BRAF V600M)
ISDFGLATMF

SEQ ID NO: 3065 - protein, 10 aa, Artificial Sequence
  Description of Artificial Sequence: Synthetic peptide
  Seed: IGDFGLATMK (BRAF V600M)
ISDFGLATMH

SEQ ID NO: 3066 - protein, 10 aa, Artificial Sequence
  Description of Artificial Sequence: Synthetic peptide
  Seed: IGDFGLATMK (BRAF V600M)
ISDFGLATMK

SEQ ID NO: 3067 - protein, 10 aa, Artificial Sequence
  Description of Artificial Sequence: Synthetic peptide
  Seed: IGDFGLATMK (BRAF V600M)
ISDFGLATML

SEQ ID NO: 3068 - protein, 10 aa, Artificial Sequence
  Description of Artificial Sequence: Synthetic peptide
  Seed: IGDFGLATMK (BRAF V600M)
ISDFGLATMM

SEQ ID NO: 3069 - protein, 10 aa, Artificial Sequence
  Description of Artificial Sequence: Synthetic peptide
  Seed: IGDFGLATMK (BRAF V600M)
ISDFGLATMQ

SEQ ID NO: 3070 - protein, 10 aa, Artificial Sequence
  Description of Artificial Sequence: Synthetic peptide
  Seed: IGDFGLATMK (BRAF V600M)
ISDFGLATMR

SEQ ID NO: 3071 - protein, 10 aa, Artificial Sequence
  Description of Artificial Sequence: Synthetic peptide
  Seed: IGDFGLATMK (BRAF V600M)
ISDFGLATMW

SEQ ID NO: 3072 - protein, 10 aa, Artificial Sequence
  Description of Artificial Sequence: Synthetic peptide
  Seed: IGDFGLATMK (BRAF V600M)
ISDFGLATMY

SEQ ID NO: 3073 - protein, 10 aa, Artificial Sequence
  Description of Artificial Sequence: Synthetic peptide
  Seed: IGDFGLATMK (BRAF V600M)
ITDFGLATMF

SEQ ID NO: 3074 - protein, 10 aa, Artificial Sequence
  Description of Artificial Sequence: Synthetic peptide
  Seed: IGDFGLATMK (BRAF V600M)
ITDFGLATMH

SEQ ID NO: 3075 - protein, 10 aa, Artificial Sequence
  Description of Artificial Sequence: Synthetic peptide
  Seed: IGDFGLATMK (BRAF V600M)
ITDFGLATMK

SEQ ID NO: 3076 - protein, 10 aa, Artificial Sequence
  Description of Artificial Sequence: Synthetic peptide
  Seed: IGDFGLATMK (BRAF V600M)
ITDFGLATML

SEQ ID NO: 3077 - protein, 10 aa, Artificial Sequence
  Description of Artificial Sequence: Synthetic peptide
  Seed: IGDFGLATMK (BRAF V600M)
ITDFGLATMM

SEQ ID NO: 3078 - protein, 10 aa, Artificial Sequence
  Description of Artificial Sequence: Synthetic peptide
  Seed: IGDFGLATMK (BRAF V600M)
ITDFGLATMQ

SEQ ID NO: 3079 - protein, 10 aa, Artificial Sequence
  Description of Artificial Sequence: Synthetic peptide
  Seed: IGDFGLATMK (BRAF V600M)
ITDFGLATMR

SEQ ID NO: 3080 - protein, 10 aa, Artificial Sequence
  Description of Artificial Sequence: Synthetic peptide
  Seed: IGDFGLATMK (BRAF V600M)
ITDFGLATMV

SEQ ID NO: 3081 - protein, 10 aa, Artificial Sequence
  Description of Artificial Sequence: Synthetic peptide
  Seed: IGDFGLATMK (BRAF V600M)
ITDFGLATMW

SEQ ID NO: 3082 - protein, 10 aa, Artificial Sequence
  Description of Artificial Sequence: Synthetic peptide
  Seed: IGDFGLATMK (BRAF V600M)
IVDFGLATMF

SEQ ID NO: 3083 - protein, 10 aa, Artificial Sequence
  Description of Artificial Sequence: Synthetic peptide
  Seed: IGDFGLATMK (BRAF V600M)
IVDFGLATMH

SEQ ID NO: 3084 - protein, 10 aa, Artificial Sequence
  Description of Artificial Sequence: Synthetic peptide
  Seed: IGDFGLATMK (BRAF V600M)
IVDFGLATMK

SEQ ID NO: 3085 - protein, 10 aa, Artificial Sequence
  Description of Artificial Sequence: Synthetic peptide
  Seed: IGDFGLATMK (BRAF V600M)
IVDFGLATML

SEQ ID NO: 3086 - protein, 10 aa, Artificial Sequence
  Description of Artificial Sequence: Synthetic peptide
  Seed: IGDFGLATMK (BRAF V600M)
IVDFGLATMM

SEQ ID NO: 3087 - protein, 10 aa, Artificial Sequence
  Description of Artificial Sequence: Synthetic peptide
  Seed: IGDFGLATMK (BRAF V600M)
IVDFGLATMQ

SEQ ID NO: 3088 - protein, 10 aa, Artificial Sequence
  Description of Artificial Sequence: Synthetic peptide
  Seed: IGDFGLATMK (BRAF V600M)
IVDFGLATMR

SEQ ID NO: 3089 - protein, 10 aa, Artificial Sequence
  Description of Artificial Sequence: Synthetic peptide
  Seed: IGDFGLATMK (BRAF V600M)
IVDFGLATMW

SEQ ID NO: 3090 - protein, 10 aa, Artificial Sequence
  Description of Artificial Sequence: Synthetic peptide
  Seed: IGDFGLATMK (BRAF V600M)
IVDFGLATMY

SEQ ID NO: 3091 - protein, 10 aa, Artificial Sequence
  Description of Artificial Sequence: Synthetic peptide
  Seed: IGDFGLATMK (BRAF V600M)
IWDFGLATMK

SEQ ID NO: 3092 - protein, 10 aa, Artificial Sequence
  Description of Artificial Sequence: Synthetic peptide
  Seed: IGDFGLATMK (BRAF V600M)
IWDFGLATMY

SEQ ID NO: 3093 - protein, 10 aa, Artificial Sequence
  Description of Artificial Sequence: Synthetic peptide
  Seed: IGDFGLATMK (BRAF V600M)
IYDFGLATMF

SEQ ID NO: 3094 - protein, 10 aa, Artificial Sequence
  Description of Artificial Sequence: Synthetic peptide
  Seed: IGDFGLATMK (BRAF V600M)
IYDFGLATMK

SEQ ID NO: 3095 - protein, 10 aa, Artificial Sequence
  Description of Artificial Sequence: Synthetic peptide
  Seed: IGDFGLATMK (BRAF V600M)
IYDFGLATMY

SEQ ID NO: 3096 - protein, 11 aa, Artificial Sequence
  Description of Artificial Sequence: Synthetic peptide
  Seed: KIGDFGLATMK (BRAF V600M)
KAGDFGLATMF

SEQ ID NO: 3097 - protein, 11 aa, Artificial Sequence
  Description of Artificial Sequence: Synthetic peptide
  Seed: KIGDFGLATMK (BRAF V600M)
KAGDFGLATMI

SEQ ID NO: 3098 - protein, 11 aa, Artificial Sequence
  Description of Artificial Sequence: Synthetic peptide
  Seed: KIGDFGLATMK (BRAF V600M)
KAGDFGLATML

SEQ ID NO: 3099 - protein, 11 aa, Artificial Sequence
  Description of Artificial Sequence: Synthetic peptide
  Seed: KIGDFGLATMK (BRAF V600M)
KAGDFGLATMM

SEQ ID NO: 3100 - protein, 11 aa, Artificial Sequence
  Description of Artificial Sequence: Synthetic peptide
  Seed: KIGDFGLATMK (BRAF V600M)
KAGDFGLATMV

SEQ ID NO: 3101 - protein, 11 aa, Artificial Sequence
  Description of Artificial Sequence: Synthetic peptide
  Seed: KIGDFGLATMK (BRAF V600M)
KAGDFGLATMW

SEQ ID NO: 3102 - protein, 11 aa, Artificial Sequence
  Description of Artificial Sequence: Synthetic peptide
  Seed: KIGDFGLATMK (BRAF V600M)
KAGDFGLATMY

SEQ ID NO: 3103 - protein, 11 aa, Artificial Sequence
  Description of Artificial Sequence: Synthetic peptide
  Seed: KIGDFGLATMK (BRAF V600M)
KCGDFGLATMF

SEQ ID NO: 3104 - protein, 11 aa, Artificial Sequence
  Description of Artificial Sequence: Synthetic peptide
  Seed: KIGDFGLATMK (BRAF V600M)
KCGDFGLATMK

SEQ ID NO: 3105 - protein, 11 aa, Artificial Sequence
  Description of Artificial Sequence: Synthetic peptide
  Seed: KIGDFGLATMK (BRAF V600M)
KCGDFGLATMR

SEQ ID NO: 3106 - protein, 11 aa, Artificial Sequence
  Description of Artificial Sequence: Synthetic peptide
  Seed: KIGDFGLATMK (BRAF V600M)
KCGDFGLATMY

SEQ ID NO: 3107 - protein, 11 aa, Artificial Sequence
  Description of Artificial Sequence: Synthetic peptide
  Seed: KIGDFGLATMK (BRAF V600M)
KDGDFGLATMK

SEQ ID NO: 3108 - protein, 11 aa, Artificial Sequence
  Description of Artificial Sequence: Synthetic peptide
  Seed: KIGDFGLATMK (BRAF V600M)
KDGDFGLATMR

SEQ ID NO: 3109 - protein, 11 aa, Artificial Sequence
  Description of Artificial Sequence: Synthetic peptide
  Seed: KIGDFGLATMK (BRAF V600M)
KDGDFGLATMY

SEQ ID NO: 3110 - protein, 11 aa, Artificial Sequence
  Description of Artificial Sequence: Synthetic peptide
  Seed: KIGDFGLATMK (BRAF V600M)
KEGDFGLATMK

SEQ ID NO: 3111 - protein, 11 aa, Artificial Sequence
  Description of Artificial Sequence: Synthetic peptide
  Seed: KIGDFGLATMK (BRAF V600M)
KEGDFGLATMR

SEQ ID NO: 3112 - protein, 11 aa, Artificial Sequence
  Description of Artificial Sequence: Synthetic peptide
  Seed: KIGDFGLATMK (BRAF V600M)
KEGDFGLATMY

SEQ ID NO: 3113 - protein, 11 aa, Artificial Sequence
  Description of Artificial Sequence: Synthetic peptide
  Seed: KIGDFGLATMK (BRAF V600M)
KFGDFGLATMY

SEQ ID NO: 3114 - protein, 11 aa, Artificial Sequence
  Description of Artificial Sequence: Synthetic peptide
  Seed: KIGDFGLATMK (BRAF V600M)
KGGDFGLATMF

SEQ ID NO: 3115 - protein, 11 aa, Artificial Sequence
  Description of Artificial Sequence: Synthetic peptide
  Seed: KIGDFGLATMK (BRAF V600M)
KGGDFGLATMK

SEQ ID NO: 3116 - protein, 11 aa, Artificial Sequence
  Description of Artificial Sequence: Synthetic peptide
  Seed: KIGDFGLATMK (BRAF V600M)
KGGDFGLATML

SEQ ID NO: 3117 - protein, 11 aa, Artificial Sequence
  Description of Artificial Sequence: Synthetic peptide
  Seed: KIGDFGLATMK (BRAF V600M)
KGGDFGLATMM

SEQ ID NO: 3118 - protein, 11 aa, Artificial Sequence
  Description of Artificial Sequence: Synthetic peptide
  Seed: KIGDFGLATMK (BRAF V600M)
KGGDFGLATMY

SEQ ID NO: 3119 - protein, 11 aa, Artificial Sequence
  Description of Artificial Sequence: Synthetic peptide
  Seed: KIGDFGLATMK (BRAF V600M)
KIGDFGLATMF

SEQ ID NO: 3120 - protein, 11 aa, Artificial Sequence
  Description of Artificial Sequence: Synthetic peptide
  Seed: KIGDFGLATMK (BRAF V600M)
KIGDFGLATML

SEQ ID NO: 3121 - protein, 11 aa, Artificial Sequence
  Description of Artificial Sequence: Synthetic peptide
  Seed: KIGDFGLATMK (BRAF V600M)
KIGDFGLATMM

SEQ ID NO: 3122 - protein, 11 aa, Artificial Sequence
  Description of Artificial Sequence: Synthetic peptide
  Seed: KIGDFGLATMK (BRAF V600M)
KIGDFGLATMY

SEQ ID NO: 3123 - protein, 11 aa, Artificial Sequence
  Description of Artificial Sequence: Synthetic peptide
  Seed: KIGDFGLATMK (BRAF V600M)
KLGDFGLATMF

SEQ ID NO: 3124 - protein, 11 aa, Artificial Sequence
  Description of Artificial Sequence: Synthetic peptide
  Seed: KIGDFGLATMK (BRAF V600M)
KLGDFGLATML

SEQ ID NO: 3125 - protein, 11 aa, Artificial Sequence
  Description of Artificial Sequence: Synthetic peptide
  Seed: KIGDFGLATMK (BRAF V600M)
KLGDFGLATMM

SEQ ID NO: 3126 - protein, 11 aa, Artificial Sequence
  Description of Artificial Sequence: Synthetic peptide
  Seed: KIGDFGLATMK (BRAF V600M)
KMGDFGLATMF

SEQ ID NO: 3127 - protein, 11 aa, Artificial Sequence
  Description of Artificial Sequence: Synthetic peptide
  Seed: KIGDFGLATMK (BRAF V600M)
KMGDFGLATML

SEQ ID NO: 3128 - protein, 11 aa, Artificial Sequence
  Description of Artificial Sequence: Synthetic peptide
  Seed: KIGDFGLATMK (BRAF V600M)
KMGDFGLATMM

SEQ ID NO: 3129 - protein, 11 aa, Artificial Sequence
  Description of Artificial Sequence: Synthetic peptide
  Seed: KIGDFGLATMK (BRAF V600M)
KNGDFGLATMK

SEQ ID NO: 3130 - protein, 11 aa, Artificial Sequence
  Description of Artificial Sequence: Synthetic peptide
  Seed: KIGDFGLATMK (BRAF V600M)
KNGDFGLATMY

SEQ ID NO: 3131 - protein, 11 aa, Artificial Sequence
  Description of Artificial Sequence: Synthetic peptide
  Seed: KIGDFGLATMK (BRAF V600M)
KPGDFGLATMK

SEQ ID NO: 3132 - protein, 11 aa, Artificial Sequence
  Description of Artificial Sequence: Synthetic peptide
  Seed: KIGDFGLATMK (BRAF V600M)
KPGDFGLATMR

SEQ ID NO: 3133 - protein, 11 aa, Artificial Sequence
  Description of Artificial Sequence: Synthetic peptide
  Seed: KIGDFGLATMK (BRAF V600M)
KQGDFGLATMY

SEQ ID NO: 3134 - protein, 11 aa, Artificial Sequence
  Description of Artificial Sequence: Synthetic peptide
  Seed: KIGDFGLATMK (BRAF V600M)
KSGDFGLATMF

SEQ ID NO: 3135 - protein, 11 aa, Artificial Sequence
  Description of Artificial Sequence: Synthetic peptide
  Seed: KIGDFGLATMK (BRAF V600M)
KSGDFGLATMH

SEQ ID NO: 3136 - protein, 11 aa, Artificial Sequence
  Description of Artificial Sequence: Synthetic peptide
  Seed: KIGDFGLATMK (BRAF V600M)
KSGDFGLATMI

SEQ ID NO: 3137 - protein, 11 aa, Artificial Sequence
  Description of Artificial Sequence: Synthetic peptide
  Seed: KIGDFGLATMK (BRAF V600M)
KSGDFGLATML

SEQ ID NO: 3138 - protein, 11 aa, Artificial Sequence
  Description of Artificial Sequence: Synthetic peptide
  Seed: KIGDFGLATMK (BRAF V600M)
KSGDFGLATMM

SEQ ID NO: 3139 - protein, 11 aa, Artificial Sequence
  Description of Artificial Sequence: Synthetic peptide
  Seed: KIGDFGLATMK (BRAF V600M)
KSGDFGLATMW

SEQ ID NO: 3140 - protein, 11 aa, Artificial Sequence
  Description of Artificial Sequence: Synthetic peptide
  Seed: KIGDFGLATMK (BRAF V600M)
KSGDFGLATMY

SEQ ID NO: 3141 - protein, 11 aa, Artificial Sequence
  Description of Artificial Sequence: Synthetic peptide
  Seed: KIGDFGLATMK (BRAF V600M)
KTGDFGLATMF

SEQ ID NO: 3142 - protein, 11 aa, Artificial Sequence
  Description of Artificial Sequence: Synthetic peptide
  Seed: KIGDFGLATMK (BRAF V600M)
KTGDFGLATMH

SEQ ID NO: 3143 - protein, 11 aa, Artificial Sequence
  Description of Artificial Sequence: Synthetic peptide
  Seed: KIGDFGLATMK (BRAF V600M)
KTGDFGLATMI

SEQ ID NO: 3144 - protein, 11 aa, Artificial Sequence
  Description of Artificial Sequence: Synthetic peptide
  Seed: KIGDFGLATMK (BRAF V600M)
KTGDFGLATML

SEQ ID NO: 3145 - protein, 11 aa, Artificial Sequence
  Description of Artificial Sequence: Synthetic peptide
  Seed: KIGDFGLATMK (BRAF V600M)
KTGDFGLATMM

SEQ ID NO: 3146 - protein, 11 aa, Artificial Sequence
  Description of Artificial Sequence: Synthetic peptide
  Seed: KIGDFGLATMK (BRAF V600M)
KTGDFGLATMW

SEQ ID NO: 3147 - protein, 11 aa, Artificial Sequence
  Description of Artificial Sequence: Synthetic peptide
  Seed: KIGDFGLATMK (BRAF V600M)
KTGDFGLATMY

SEQ ID NO: 3148 - protein, 11 aa, Artificial Sequence
  Description of Artificial Sequence: Synthetic peptide
  Seed: KIGDFGLATMK (BRAF V600M)
KVGDFGLATMF

SEQ ID NO: 3149 - protein, 11 aa, Artificial Sequence
  Description of Artificial Sequence: Synthetic peptide
  Seed: KIGDFGLATMK (BRAF V600M)
KVGDFGLATMH

SEQ ID NO: 3150 - protein, 11 aa, Artificial Sequence
  Description of Artificial Sequence: Synthetic peptide
  Seed: KIGDFGLATMK (BRAF V600M)
KVGDFGLATML

SEQ ID NO: 3151 - protein, 11 aa, Artificial Sequence
  Description of Artificial Sequence: Synthetic peptide
  Seed: KIGDFGLATMK (BRAF V600M)
KVGDFGLATMM

SEQ ID NO: 3152 - protein, 11 aa, Artificial Sequence
  Description of Artificial Sequence: Synthetic peptide
  Seed: KIGDFGLATMK (BRAF V600M)
KVGDFGLATMW

SEQ ID NO: 3153 - protein, 11 aa, Artificial Sequence
  Description of Artificial Sequence: Synthetic peptide
  Seed: KIGDFGLATMK (BRAF V600M)
KVGDFGLATMY

SEQ ID NO: 3154 - protein, 8 aa, Artificial Sequence
  Description of Artificial Sequence: Synthetic peptide
  Seed: LATMKSRW (BRAF V600M)
LCTMKSRW

SEQ ID NO: 3155 - protein, 8 aa, Artificial Sequence
  Description of Artificial Sequence: Synthetic peptide
  Seed: LATMKSRW (BRAF V600M)
LGTMKSRW

SEQ ID NO: 3156 - protein, 8 aa, Artificial Sequence
  Description of Artificial Sequence: Synthetic peptide
  Seed: LATMKSRW (BRAF V600M)
LSTMKSRW

SEQ ID NO: 3157 - protein, 8 aa, Artificial Sequence
  Description of Artificial Sequence: Synthetic peptide
  Seed: LATMKSRW (BRAF V600M)
LTTMKSRW

SEQ ID NO: 3158 - protein, 8 aa, Artificial Sequence
  Description of Artificial Sequence: Synthetic peptide
  Seed: LATMKSRW (BRAF V600M)
LVTMKSRW

SEQ ID NO: 3159 - protein, 9 aa, Homo sapiens
  Native (BRAF V600M)
ATMKSRWSG

SEQ ID NO: 3160 - protein, 10 aa, Homo sapiens
  Native (BRAF V600M)
ATMKSRWSGS

SEQ ID NO: 3161 - protein, 10 aa, Homo sapiens
  Native (BRAF V600M)
DFGLATMKSR

SEQ ID NO: 3162 - protein, 9 aa, Homo sapiens
  Native (BRAF V600M)
FGLATMKSR

SEQ ID NO: 3163 - protein, 10 aa, Homo sapiens
  Native (BRAF V600M)
FGLATMKSRW

SEQ ID NO: 3164 - protein, 11 aa, Homo sapiens
  Native (BRAF V600M)
KIGDFGLATMK

SEQ ID NO: 3165 - protein, 9 aa, Homo sapiens
  Native (BRAF V600M)
MKSRWSGSH

SEQ ID NO: 3166 - protein, 11 aa, Homo sapiens
  Native (BRAF V600M)
MKSRWSGSHQF

SEQ ID NO: 3167 - protein, 9 aa, Homo sapiens
  Native (BRAF V600M)
GDFGLATMK

SEQ ID NO: 3168 - protein, 9 aa, Homo sapiens
  Native (BRAF V600M)
GLATMKSRW

SEQ ID NO: 3169 - protein, 10 aa, Homo sapiens
  Native (BRAF V600M)
IGDFGLATMK

SEQ ID NO: 3170 - protein, 8 aa, Homo sapiens
  Native (BRAF V600M)
LATMKSRW

SEQ ID NO: 3171 - protein, 11 aa, Artificial Sequence
  Description of Artificial Sequence: Synthetic peptide
  Seed: FGVTCVKKCPR (EGFR A289V)
FAVTCVKKCPR

SEQ ID NO: 3172 - protein, 11 aa, Artificial Sequence
  Description of Artificial Sequence: Synthetic peptide
  Seed: FGVTCVKKCPR (EGFR A289V)
FCVTCVKKCPR

SEQ ID NO: 3173 - protein, 11 aa, Artificial Sequence
  Description of Artificial Sequence: Synthetic peptide
  Seed: FGVTCVKKCPR (EGFR A289V)
FDVTCVKKCPR

SEQ ID NO: 3174 - protein, 11 aa, Artificial Sequence
  Description of Artificial Sequence: Synthetic peptide
  Seed: FGVTCVKKCPR (EGFR A289V)
FEVTCVKKCPR

SEQ ID NO: 3175 - protein, 11 aa, Artificial Sequence
  Description of Artificial Sequence: Synthetic peptide
  Seed: FGVTCVKKCPR (EGFR A289V)
FFVTCVKKCPK

SEQ ID NO: 3176 - protein, 11 aa, Artificial Sequence
  Description of Artificial Sequence: Synthetic peptide
  Seed: FGVTCVKKCPR (EGFR A289V)
FFVTCVKKCPR

SEQ ID NO: 3177 - protein, 11 aa, Artificial Sequence
  Description of Artificial Sequence: Synthetic peptide
  Seed: FGVTCVKKCPR (EGFR A289V)
FHVTCVKKCPR

SEQ ID NO: 3178 - protein, 11 aa, Artificial Sequence
  Description of Artificial Sequence: Synthetic peptide
  Seed: FGVTCVKKCPR (EGFR A289V)
FIVTCVKKCPR

SEQ ID NO: 3179 - protein, 11 aa, Artificial Sequence
  Description of Artificial Sequence: Synthetic peptide
  Seed: FGVTCVKKCPR (EGFR A289V)
FKVTCVKKCPR

SEQ ID NO: 3180 - protein, 11 aa, Artificial Sequence
  Description of Artificial Sequence: Synthetic peptide
  Seed: FGVTCVKKCPR (EGFR A289V)
FLVTCVKKCPR

SEQ ID NO: 3181 - protein, 11 aa, Artificial Sequence
  Description of Artificial Sequence: Synthetic peptide
  Seed: FGVTCVKKCPR (EGFR A289V)
FMVTCVKKCPK

SEQ ID NO: 3182 - protein, 11 aa, Artificial Sequence
  Description of Artificial Sequence: Synthetic peptide
  Seed: FGVTCVKKCPR (EGFR A289V)
FMVTCVKKCPR

SEQ ID NO: 3183 - protein, 11 aa, Artificial Sequence
  Description of Artificial Sequence: Synthetic peptide
  Seed: FGVTCVKKCPR (EGFR A289V)
FNVTCVKKCPR

SEQ ID NO: 3184 - protein, 11 aa, Artificial Sequence
  Description of Artificial Sequence: Synthetic peptide
  Seed: FGVTCVKKCPR (EGFR A289V)
FPVTCVKKCPR

SEQ ID NO: 3185 - protein, 11 aa, Artificial Sequence
  Description of Artificial Sequence: Synthetic peptide
  Seed: FGVTCVKKCPR (EGFR A289V)
FQVTCVKKCPR

SEQ ID NO: 3186 - protein, 11 aa, Artificial Sequence
  Description of Artificial Sequence: Synthetic peptide
  Seed: FGVTCVKKCPR (EGFR A289V)
FRVTCVKKCPR

SEQ ID NO: 3187 - protein, 11 aa, Artificial Sequence
  Description of Artificial Sequence: Synthetic peptide
  Seed: FGVTCVKKCPR (EGFR A289V)
FSVTCVKKCPR

SEQ ID NO: 3188 - protein, 11 aa, Artificial Sequence
  Description of Artificial Sequence: Synthetic peptide
  Seed: FGVTCVKKCPR (EGFR A289V)
FTVTCVKKCPR

SEQ ID NO: 3189 - protein, 11 aa, Artificial Sequence
  Description of Artificial Sequence: Synthetic peptide
  Seed: FGVTCVKKCPR (EGFR A289V)
FVVTCVKKCPR

SEQ ID NO: 3190 - protein, 11 aa, Artificial Sequence
  Description of Artificial Sequence: Synthetic peptide
  Seed: FGVTCVKKCPR (EGFR A289V)
FWVTCVKKCPR

SEQ ID NO: 3191 - protein, 11 aa, Artificial Sequence
  Description of Artificial Sequence: Synthetic peptide
  Seed: FGVTCVKKCPR (EGFR A289V)
FYVTCVKKCPK

SEQ ID NO: 3192 - protein, 11 aa, Artificial Sequence
  Description of Artificial Sequence: Synthetic peptide
  Seed: FGVTCVKKCPR (EGFR A289V)
FYVTCVKKCPR

SEQ ID NO: 3193 - protein, 11 aa, Artificial Sequence
  Description of Artificial Sequence: Synthetic peptide
  Seed: GKYSFGVTCVK (EGFR A289V)
GAYSFGVTCVK

SEQ ID NO: 3194 - protein, 11 aa, Artificial Sequence
  Description of Artificial Sequence: Synthetic peptide
  Seed: GKYSFGVTCVK (EGFR A289V)
GAYSFGVTCVR

SEQ ID NO: 3195 - protein, 11 aa, Artificial Sequence
  Description of Artificial Sequence: Synthetic peptide
  Seed: GKYSFGVTCVK (EGFR A289V)
GCYSFGVTCVK

SEQ ID NO: 3196 - protein, 11 aa, Artificial Sequence
  Description of Artificial Sequence: Synthetic peptide
  Seed: GKYSFGVTCVK (EGFR A289V)
GCYSFGVTCVR

SEQ ID NO: 3197 - protein, 11 aa, Artificial Sequence
  Description of Artificial Sequence: Synthetic peptide
  Seed: GKYSFGVTCVK (EGFR A289V)
GDYSFGVTCVK

SEQ ID NO: 3198 - protein, 11 aa, Artificial Sequence
  Description of Artificial Sequence: Synthetic peptide
  Seed: GKYSFGVTCVK (EGFR A289V)
GDYSFGVTCVR

SEQ ID NO: 3199 - protein, 11 aa, Artificial Sequence
  Description of Artificial Sequence: Synthetic peptide
  Seed: GKYSFGVTCVK (EGFR A289V)
GEYSFGVTCVK

SEQ ID NO: 3200 - protein, 11 aa, Artificial Sequence
  Description of Artificial Sequence: Synthetic peptide
  Seed: GKYSFGVTCVK (EGFR A289V)
GEYSFGVTCVR

SEQ ID NO: 3201 - protein, 11 aa, Artificial Sequence
  Description of Artificial Sequence: Synthetic peptide
  Seed: GKYSFGVTCVK (EGFR A289V)
GFYSFGVTCVK

SEQ ID NO: 3202 - protein, 11 aa, Artificial Sequence
  Description of Artificial Sequence: Synthetic peptide
  Seed: GKYSFGVTCVK (EGFR A289V)
GFYSFGVTCVR

SEQ ID NO: 3203 - protein, 11 aa, Artificial Sequence
  Description of Artificial Sequence: Synthetic peptide
  Seed: GKYSFGVTCVK (EGFR A289V)
GGYSFGVTCVK

SEQ ID NO: 3204 - protein, 11 aa, Artificial Sequence
  Description of Artificial Sequence: Synthetic peptide
  Seed: GKYSFGVTCVK (EGFR A289V)
GGYSFGVTCVR

SEQ ID NO: 3205 - protein, 11 aa, Artificial Sequence
  Description of Artificial Sequence: Synthetic peptide
  Seed: GKYSFGVTCVK (EGFR A289V)
GHYSFGVTCVK

SEQ ID NO: 3206 - protein, 11 aa, Artificial Sequence
  Description of Artificial Sequence: Synthetic peptide
  Seed: GKYSFGVTCVK (EGFR A289V)
GHYSFGVTCVR

SEQ ID NO: 3207 - protein, 11 aa, Artificial Sequence
  Description of Artificial Sequence: Synthetic peptide
  Seed: GKYSFGVTCVK (EGFR A289V)
GIYSFGVTCVK

SEQ ID NO: 3208 - protein, 11 aa, Artificial Sequence
  Description of Artificial Sequence: Synthetic peptide
  Seed: GKYSFGVTCVK (EGFR A289V)
GIYSFGVTCVR

SEQ ID NO: 3209 - protein, 11 aa, Artificial Sequence
  Description of Artificial Sequence: Synthetic peptide
  Seed: GKYSFGVTCVK (EGFR A289V)
GKYSFGVTCVR

SEQ ID NO: 3210 - protein, 11 aa, Artificial Sequence
  Description of Artificial Sequence: Synthetic peptide
  Seed: GKYSFGVTCVK (EGFR A289V)
GLYSFGVTCVK

SEQ ID NO: 3211 - protein, 11 aa, Artificial Sequence
  Description of Artificial Sequence: Synthetic peptide
  Seed: GKYSFGVTCVK (EGFR A289V)
GLYSFGVTCVR

SEQ ID NO: 3212 - protein, 11 aa, Artificial Sequence
  Description of Artificial Sequence: Synthetic peptide
  Seed: GKYSFGVTCVK (EGFR A289V)
GMYSFGVTCVK

SEQ ID NO: 3213 - protein, 11 aa, Artificial Sequence
  Description of Artificial Sequence: Synthetic peptide
  Seed: GKYSFGVTCVK (EGFR A289V)
GMYSFGVTCVR

SEQ ID NO: 3214 - protein, 11 aa, Artificial Sequence
  Description of Artificial Sequence: Synthetic peptide
  Seed: GKYSFGVTCVK (EGFR A289V)
GNYSFGVTCVK

SEQ ID NO: 3215 - protein, 11 aa, Artificial Sequence
  Description of Artificial Sequence: Synthetic peptide
  Seed: GKYSFGVTCVK (EGFR A289V)
GNYSFGVTCVR

SEQ ID NO: 3216 - protein, 11 aa, Artificial Sequence
  Description of Artificial Sequence: Synthetic peptide
  Seed: GKYSFGVTCVK (EGFR A289V)
GPYSFGVTCVK

SEQ ID NO: 3217 - protein, 11 aa, Artificial Sequence
  Description of Artificial Sequence: Synthetic peptide
  Seed: GKYSFGVTCVK (EGFR A289V)
GPYSFGVTCVR

SEQ ID NO: 3218 - protein, 11 aa, Artificial Sequence
  Description of Artificial Sequence: Synthetic peptide
  Seed: GKYSFGVTCVK (EGFR A289V)
GQYSFGVTCVK

SEQ ID NO: 3219 - protein, 11 aa, Artificial Sequence
  Description of Artificial Sequence: Synthetic peptide
  Seed: GKYSFGVTCVK (EGFR A289V)
GQYSFGVTCVR

SEQ ID NO: 3220 - protein, 11 aa, Artificial Sequence
  Description of Artificial Sequence: Synthetic peptide
  Seed: GKYSFGVTCVK (EGFR A289V)
GRYSFGVTCVK

SEQ ID NO: 3221 - protein, 11 aa, Artificial Sequence
  Description of Artificial Sequence: Synthetic peptide
  Seed: GKYSFGVTCVK (EGFR A289V)
GRYSFGVTCVR

SEQ ID NO: 3222 - protein, 11 aa, Artificial Sequence
  Description of Artificial Sequence: Synthetic peptide
  Seed: GKYSFGVTCVK (EGFR A289V)
GSYSFGVTCVK

SEQ ID NO: 3223 - protein, 11 aa, Artificial Sequence
  Description of Artificial Sequence: Synthetic peptide
  Seed: GKYSFGVTCVK (EGFR A289V)
GSYSFGVTCVR

SEQ ID NO: 3224 - protein, 11 aa, Artificial Sequence
  Description of Artificial Sequence: Synthetic peptide
  Seed: GKYSFGVTCVK (EGFR A289V)
GTYSFGVTCVK

SEQ ID NO: 3225 - protein, 11 aa, Artificial Sequence
  Description of Artificial Sequence: Synthetic peptide
  Seed: GKYSFGVTCVK (EGFR A289V)
GTYSFGVTCVR

SEQ ID NO: 3226 - protein, 11 aa, Artificial Sequence
  Description of Artificial Sequence: Synthetic peptide
  Seed: GKYSFGVTCVK (EGFR A289V)
GTYSFGVTCVY

SEQ ID NO: 3227 - protein, 11 aa, Artificial Sequence
  Description of Artificial Sequence: Synthetic peptide
  Seed: GKYSFGVTCVK (EGFR A289V)
GVYSFGVTCVK

SEQ ID NO: 3228 - protein, 11 aa, Artificial Sequence
  Description of Artificial Sequence: Synthetic peptide
  Seed: GKYSFGVTCVK (EGFR A289V)
GVYSFGVTCVR

SEQ ID NO: 3229 - protein, 11 aa, Artificial Sequence
  Description of Artificial Sequence: Synthetic peptide
  Seed: GKYSFGVTCVK (EGFR A289V)
GWYSFGVTCVK

SEQ ID NO: 3230 - protein, 11 aa, Artificial Sequence
  Description of Artificial Sequence: Synthetic peptide
  Seed: GKYSFGVTCVK (EGFR A289V)
GWYSFGVTCVR

SEQ ID NO: 3231 - protein, 11 aa, Artificial Sequence
  Description of Artificial Sequence: Synthetic peptide
  Seed: GKYSFGVTCVK (EGFR A289V)
GYYSFGVTCVK

SEQ ID NO: 3232 - protein, 11 aa, Artificial Sequence
  Description of Artificial Sequence: Synthetic peptide
  Seed: GKYSFGVTCVK (EGFR A289V)
GYYSFGVTCVR

SEQ ID NO: 3233 - protein, 10 aa, Artificial Sequence
  Description of Artificial Sequence: Synthetic peptide
  Seed: KYSFGVTCVK (EGFR A289V)
KASFGVTCVA

SEQ ID NO: 3234 - protein, 10 aa, Artificial Sequence
  Description of Artificial Sequence: Synthetic peptide
  Seed: KYSFGVTCVK (EGFR A289V)
KASFGVTCVK

SEQ ID NO: 3235 - protein, 11 aa, Artificial Sequence
  Description of Artificial Sequence: Synthetic peptide
  Seed: KYSFGVTCVKK (EGFR A289V)
KASFGVTCVKR

SEQ ID NO: 3236 - protein, 10 aa, Artificial Sequence
  Description of Artificial Sequence: Synthetic peptide
  Seed: KYSFGVTCVK (EGFR A289V)
KASFGVTCVR

SEQ ID NO: 3237 - protein, 10 aa, Artificial Sequence
  Description of Artificial Sequence: Synthetic peptide
  Seed: KYSFGVTCVK (EGFR A289V)
KASFGVTCVV

SEQ ID NO: 3238 - protein, 10 aa, Artificial Sequence
  Description of Artificial Sequence: Synthetic peptide
  Seed: KYSFGVTCVK (EGFR A289V)
KCSFGVTCVA

SEQ ID NO: 3239 - protein, 10 aa, Artificial Sequence
  Description of Artificial Sequence: Synthetic peptide
  Seed: KYSFGVTCVK (EGFR A289V)
KCSFGVTCVK

SEQ ID NO: 3240 - protein, 11 aa, Artificial Sequence
  Description of Artificial Sequence: Synthetic peptide
  Seed: KYSFGVTCVKK (EGFR A289V)
KCSFGVTCVKR

SEQ ID NO: 3241 - protein, 10 aa, Artificial Sequence
  Description of Artificial Sequence: Synthetic peptide
  Seed: KYSFGVTCVK (EGFR A289V)
KCSFGVTCVR

SEQ ID NO: 3242 - protein, 10 aa, Artificial Sequence
  Description of Artificial Sequence: Synthetic peptide
  Seed: KYSFGVTCVK (EGFR A289V)
KDSFGVTCVA

SEQ ID NO: 3243 - protein, 10 aa, Artificial Sequence
  Description of Artificial Sequence: Synthetic peptide
  Seed: KYSFGVTCVK (EGFR A289V)
KDSFGVTCVK

SEQ ID NO: 3244 - protein, 11 aa, Artificial Sequence
  Description of Artificial Sequence: Synthetic peptide
  Seed: KYSFGVTCVKK (EGFR A289V)
KDSFGVTCVKK

SEQ ID NO: 3245 - protein, 11 aa, Artificial Sequence
  Description of Artificial Sequence: Synthetic peptide
  Seed: KYSFGVTCVKK (EGFR A289V)
KDSFGVTCVKR

SEQ ID NO: 3246 - protein, 10 aa, Artificial Sequence
  Description of Artificial Sequence: Synthetic peptide
  Seed: KYSFGVTCVK (EGFR A289V)
KDSFGVTCVR

SEQ ID NO: 3247 - protein, 10 aa, Artificial Sequence
  Description of Artificial Sequence: Synthetic peptide
  Seed: KYSFGVTCVK (EGFR A289V)
KESFGVTCVA

SEQ ID NO: 3248 - protein, 10 aa, Artificial Sequence
  Description of Artificial Sequence: Synthetic peptide
  Seed: KYSFGVTCVK (EGFR A289V)
KESFGVTCVK

SEQ ID NO: 3249 - protein, 11 aa, Artificial Sequence
  Description of Artificial Sequence: Synthetic peptide
  Seed: KYSFGVTCVKK (EGFR A289V)
KESFGVTCVKK

SEQ ID NO: 3250 - protein, 11 aa, Artificial Sequence
  Description of Artificial Sequence: Synthetic peptide
  Seed: KYSFGVTCVKK (EGFR A289V)
KESFGVTCVKR

SEQ ID NO: 3251 - protein, 10 aa, Artificial Sequence
  Description of Artificial Sequence: Synthetic peptide
  Seed: KYSFGVTCVK (EGFR A289V)
KESFGVTCVR

SEQ ID NO: 3252 - protein, 9 aa, Artificial Sequence
  Description of Artificial Sequence: Synthetic peptide
  Seed: KYSFGVTCV (EGFR A289V)
KFSFGVTCF

SEQ ID NO: 3253 - protein, 9 aa, Artificial Sequence
  Description of Artificial Sequence: Synthetic peptide
  Seed: KYSFGVTCV (EGFR A289V)
KFSFGVTCI

SEQ ID NO: 3254 - protein, 9 aa, Artificial Sequence
  Description of Artificial Sequence: Synthetic peptide
  Seed: KYSFGVTCV (EGFR A289V)
KFSFGVTCL

SEQ ID NO: 3255 - protein, 9 aa, Artificial Sequence
  Description of Artificial Sequence: Synthetic peptide
  Seed: KYSFGVTCV (EGFR A289V)
KFSFGVTCM

SEQ ID NO: 3256 - protein, 9 aa, Artificial Sequence
  Description of Artificial Sequence: Synthetic peptide
  Seed: KYSFGVTCV (EGFR A289V)
KFSFGVTCV

SEQ ID NO: 3257 - protein, 10 aa, Artificial Sequence
  Description of Artificial Sequence: Synthetic peptide
  Seed: KYSFGVTCVK (EGFR A289V)
KFSFGVTCVA

SEQ ID NO: 3258 - protein, 10 aa, Artificial Sequence
  Description of Artificial Sequence: Synthetic peptide
  Seed: KYSFGVTCVK (EGFR A289V)
KFSFGVTCVH

SEQ ID NO: 3259 - protein, 10 aa, Artificial Sequence
  Description of Artificial Sequence: Synthetic peptide
  Seed: KYSFGVTCVK (EGFR A289V)
KFSFGVTCVK

SEQ ID NO: 3260 - protein, 11 aa, Artificial Sequence
  Description of Artificial Sequence: Synthetic peptide
  Seed: KYSFGVTCVKK (EGFR A289V)
KFSFGVTCVKK

SEQ ID NO: 3261 - protein, 11 aa, Artificial Sequence
  Description of Artificial Sequence: Synthetic peptide
  Seed: KYSFGVTCVKK (EGFR A289V)
KFSFGVTCVKR

SEQ ID NO: 3262 - protein, 10 aa, Artificial Sequence
  Description of Artificial Sequence: Synthetic peptide
  Seed: KYSFGVTCVK (EGFR A289V)
KFSFGVTCVR

SEQ ID NO: 3263 - protein, 10 aa, Artificial Sequence
  Description of Artificial Sequence: Synthetic peptide
  Seed: KYSFGVTCVK (EGFR A289V)
KFSFGVTCVV

SEQ ID NO: 3264 - protein, 10 aa, Artificial Sequence
  Description of Artificial Sequence: Synthetic peptide
  Seed: KYSFGVTCVK (EGFR A289V)
KFSFGVTCVY

SEQ ID NO: 3265 - protein, 9 aa, Artificial Sequence
  Description of Artificial Sequence: Synthetic peptide
  Seed: KYSFGVTCV (EGFR A289V)
KFSFGVTCW

SEQ ID NO: 3266 - protein, 9 aa, Artificial Sequence
  Description of Artificial Sequence: Synthetic peptide
  Seed: KYSFGVTCV (EGFR A289V)
KFSFGVTCY

SEQ ID NO: 3267 - protein, 10 aa, Artificial Sequence
  Description of Artificial Sequence: Synthetic peptide
  Seed: KYSFGVTCVK (EGFR A289V)
KGSFGVTCVA

SEQ ID NO: 3268 - protein, 10 aa, Artificial Sequence
  Description of Artificial Sequence: Synthetic peptide
  Seed: KYSFGVTCVK (EGFR A289V)
KGSFGVTCVK

SEQ ID NO: 3269 - protein, 11 aa, Artificial Sequence
  Description of Artificial Sequence: Synthetic peptide
  Seed: KYSFGVTCVKK (EGFR A289V)
KGSFGVTCVKR

SEQ ID NO: 3270 - protein, 10 aa, Artificial Sequence
  Description of Artificial Sequence: Synthetic peptide
  Seed: KYSFGVTCVK (EGFR A289V)
KGSFGVTCVR

SEQ ID NO: 3271 - protein, 10 aa, Artificial Sequence
  Description of Artificial Sequence: Synthetic peptide
  Seed: KYSFGVTCVK (EGFR A289V)
KGSFGVTCVV

SEQ ID NO: 3272 - protein, 10 aa, Artificial Sequence
  Description of Artificial Sequence: Synthetic peptide
  Seed: KYSFGVTCVK (EGFR A289V)
KHSFGVTCVA

SEQ ID NO: 3273 - protein, 10 aa, Artificial Sequence
  Description of Artificial Sequence: Synthetic peptide
  Seed: KYSFGVTCVK (EGFR A289V)
KHSFGVTCVK

SEQ ID NO: 3274 - protein, 11 aa, Artificial Sequence
  Description of Artificial Sequence: Synthetic peptide
  Seed: KYSFGVTCVKK (EGFR A289V)
KHSFGVTCVKR

SEQ ID NO: 3275 - protein, 10 aa, Artificial Sequence
  Description of Artificial Sequence: Synthetic peptide
  Seed: KYSFGVTCVK (EGFR A289V)
KHSFGVTCVR

SEQ ID NO: 3276 - protein, 10 aa, Artificial Sequence
  Description of Artificial Sequence: Synthetic peptide
  Seed: KYSFGVTCVK (EGFR A289V)
KISFGVTCVA

SEQ ID NO: 3277 - protein, 10 aa, Artificial Sequence
  Description of Artificial Sequence: Synthetic peptide
  Seed: KYSFGVTCVK (EGFR A289V)
KISFGVTCVK

SEQ ID NO: 3278 - protein, 11 aa, Artificial Sequence
  Description of Artificial Sequence: Synthetic peptide
  Seed: KYSFGVTCVKK (EGFR A289V)
KISFGVTCVKR

SEQ ID NO: 3279 - protein, 10 aa, Artificial Sequence
  Description of Artificial Sequence: Synthetic peptide
  Seed: KYSFGVTCVK (EGFR A289V)
KISFGVTCVR

SEQ ID NO: 3280 - protein, 10 aa, Artificial Sequence
  Description of Artificial Sequence: Synthetic peptide
  Seed: KYSFGVTCVK (EGFR A289V)
KISFGVTCVV

SEQ ID NO: 3281 - protein, 10 aa, Artificial Sequence
  Description of Artificial Sequence: Synthetic peptide
  Seed: KYSFGVTCVK (EGFR A289V)
KISFGVTCVY

SEQ ID NO: 3282 - protein, 10 aa, Artificial Sequence
  Description of Artificial Sequence: Synthetic peptide
  Seed: KYSFGVTCVK (EGFR A289V)
KKSFGVTCVA

SEQ ID NO: 3283 - protein, 10 aa, Artificial Sequence
  Description of Artificial Sequence: Synthetic peptide
  Seed: KYSFGVTCVK (EGFR A289V)
KKSFGVTCVK

SEQ ID NO: 3284 - protein, 11 aa, Artificial Sequence
  Description of Artificial Sequence: Synthetic peptide
  Seed: KYSFGVTCVKK (EGFR A289V)
KKSFGVTCVKR

SEQ ID NO: 3285 - protein, 10 aa, Artificial Sequence
  Description of Artificial Sequence: Synthetic peptide
  Seed: KYSFGVTCVK (EGFR A289V)
KKSFGVTCVR

SEQ ID NO: 3286 - protein, 10 aa, Artificial Sequence
  Description of Artificial Sequence: Synthetic peptide
  Seed: KYSFGVTCVK (EGFR A289V)
KLSFGVTCVA

SEQ ID NO: 3287 - protein, 10 aa, Artificial Sequence
  Description of Artificial Sequence: Synthetic peptide
  Seed: KYSFGVTCVK (EGFR A289V)
KLSFGVTCVK

SEQ ID NO: 3288 - protein, 11 aa, Artificial Sequence
  Description of Artificial Sequence: Synthetic peptide
  Seed: KYSFGVTCVKK (EGFR A289V)
KLSFGVTCVKR

SEQ ID NO: 3289 - protein, 10 aa, Artificial Sequence
  Description of Artificial Sequence: Synthetic peptide
  Seed: KYSFGVTCVK (EGFR A289V)
KLSFGVTCVR

SEQ ID NO: 3290 - protein, 10 aa, Artificial Sequence
  Description of Artificial Sequence: Synthetic peptide
  Seed: KYSFGVTCVK (EGFR A289V)
KLSFGVTCVV

SEQ ID NO: 3291 - protein, 10 aa, Artificial Sequence
  Description of Artificial Sequence: Synthetic peptide
  Seed: KYSFGVTCVK (EGFR A289V)
KLSFGVTCVY

SEQ ID NO: 3292 - protein, 9 aa, Artificial Sequence
  Description of Artificial Sequence: Synthetic peptide
  Seed: KYSFGVTCV (EGFR A289V)
KMSFGVTCF

SEQ ID NO: 3293 - protein, 9 aa, Artificial Sequence
  Description of Artificial Sequence: Synthetic peptide
  Seed: KYSFGVTCV (EGFR A289V)
KMSFGVTCM

SEQ ID NO: 3294 - protein, 10 aa, Artificial Sequence
  Description of Artificial Sequence: Synthetic peptide
  Seed: KYSFGVTCVK (EGFR A289V)
KMSFGVTCVA

SEQ ID NO: 3295 - protein, 10 aa, Artificial Sequence
  Description of Artificial Sequence: Synthetic peptide
  Seed: KYSFGVTCVK (EGFR A289V)
KMSFGVTCVH

SEQ ID NO: 3296 - protein, 10 aa, Artificial Sequence
  Description of Artificial Sequence: Synthetic peptide
  Seed: KYSFGVTCVK (EGFR A289V)
KMSFGVTCVI

SEQ ID NO: 3297 - protein, 11 aa, Artificial Sequence
  Description of Artificial Sequence: Synthetic peptide
  Seed: KYSFGVTCVKK (EGFR A289V)
KMSFGVTCVKK

SEQ ID NO: 3298 - protein, 11 aa, Artificial Sequence
  Description of Artificial Sequence: Synthetic peptide
  Seed: KYSFGVTCVKK (EGFR A289V)
KMSFGVTCVKR

SEQ ID NO: 3299 - protein, 10 aa, Artificial Sequence
  Description of Artificial Sequence: Synthetic peptide
  Seed: KYSFGVTCVK (EGFR A289V)
KMSFGVTCVR

SEQ ID NO: 3300 - protein, 10 aa, Artificial Sequence
  Description of Artificial Sequence: Synthetic peptide
  Seed: KYSFGVTCVK (EGFR A289V)
KMSFGVTCVV

SEQ ID NO: 3301 - protein, 10 aa, Artificial Sequence
  Description of Artificial Sequence: Synthetic peptide
  Seed: KYSFGVTCVK (EGFR A289V)
KMSFGVTCVY

SEQ ID NO: 3302 - protein, 10 aa, Artificial Sequence
  Description of Artificial Sequence: Synthetic peptide
  Seed: KYSFGVTCVK (EGFR A289V)
KNSFGVTCVA

SEQ ID NO: 3303 - protein, 10 aa, Artificial Sequence
  Description of Artificial Sequence: Synthetic peptide
  Seed: KYSFGVTCVK (EGFR A289V)
KNSFGVTCVK

SEQ ID NO: 3304 - protein, 11 aa, Artificial Sequence
  Description of Artificial Sequence: Synthetic peptide
  Seed: KYSFGVTCVKK (EGFR A289V)
KNSFGVTCVKR

SEQ ID NO: 3305 - protein, 10 aa, Artificial Sequence
  Description of Artificial Sequence: Synthetic peptide
  Seed: KYSFGVTCVK (EGFR A289V)
KNSFGVTCVR

SEQ ID NO: 3306 - protein, 10 aa, Artificial Sequence
  Description of Artificial Sequence: Synthetic peptide
  Seed: KYSFGVTCVK (EGFR A289V)
KNSFGVTCVV

SEQ ID NO: 3307 - protein, 10 aa, Artificial Sequence
  Description of Artificial Sequence: Synthetic peptide
  Seed: KYSFGVTCVK (EGFR A289V)
KPSFGVTCVA

SEQ ID NO: 3308 - protein, 10 aa, Artificial Sequence
  Description of Artificial Sequence: Synthetic peptide
  Seed: KYSFGVTCVK (EGFR A289V)
KPSFGVTCVK

SEQ ID NO: 3309 - protein, 11 aa, Artificial Sequence
  Description of Artificial Sequence: Synthetic peptide
  Seed: KYSFGVTCVKK (EGFR A289V)
KPSFGVTCVKR

SEQ ID NO: 3310 - protein, 10 aa, Artificial Sequence
  Description of Artificial Sequence: Synthetic peptide
  Seed: KYSFGVTCVK (EGFR A289V)
KPSFGVTCVR

SEQ ID NO: 3311 - protein, 10 aa, Artificial Sequence
  Description of Artificial Sequence: Synthetic peptide
  Seed: KYSFGVTCVK (EGFR A289V)
KQSFGVTCVA

SEQ ID NO: 3312 - protein, 10 aa, Artificial Sequence
  Description of Artificial Sequence: Synthetic peptide
  Seed: KYSFGVTCVK (EGFR A289V)
KQSFGVTCVK

SEQ ID NO: 3313 - protein, 11 aa, Artificial Sequence
  Description of Artificial Sequence: Synthetic peptide
  Seed: KYSFGVTCVKK (EGFR A289V)
KQSFGVTCVKR

SEQ ID NO: 3314 - protein, 10 aa, Artificial Sequence
  Description of Artificial Sequence: Synthetic peptide
  Seed: KYSFGVTCVK (EGFR A289V)
KQSFGVTCVR

SEQ ID NO: 3315 - protein, 10 aa, Artificial Sequence
  Description of Artificial Sequence: Synthetic peptide
  Seed: KYSFGVTCVK (EGFR A289V)
KQSFGVTCVV

SEQ ID NO: 3316 - protein, 10 aa, Artificial Sequence
  Description of Artificial Sequence: Synthetic peptide
  Seed: KYSFGVTCVK (EGFR A289V)
KRSFGVTCVA

SEQ ID NO: 3317 - protein, 10 aa, Artificial Sequence
  Description of Artificial Sequence: Synthetic peptide
  Seed: KYSFGVTCVK (EGFR A289V)
KRSFGVTCVK

SEQ ID NO: 3318 - protein, 11 aa, Artificial Sequence
  Description of Artificial Sequence: Synthetic peptide
  Seed: KYSFGVTCVKK (EGFR A289V)
KRSFGVTCVKR

SEQ ID NO: 3319 - protein, 10 aa, Artificial Sequence
  Description of Artificial Sequence: Synthetic peptide
  Seed: KYSFGVTCVK (EGFR A289V)
KRSFGVTCVR

SEQ ID NO: 3320 - protein, 10 aa, Artificial Sequence
  Description of Artificial Sequence: Synthetic peptide
  Seed: KYSFGVTCVK (EGFR A289V)
KSSFGVTCVA

SEQ ID NO: 3321 - protein, 10 aa, Artificial Sequence
  Description of Artificial Sequence: Synthetic peptide
  Seed: KYSFGVTCVK (EGFR A289V)
KSSFGVTCVI

SEQ ID NO: 3322 - protein, 10 aa, Artificial Sequence
  Description of Artificial Sequence: Synthetic peptide
  Seed: KYSFGVTCVK (EGFR A289V)
KSSFGVTCVK

SEQ ID NO: 3323 - protein, 11 aa, Artificial Sequence
  Description of Artificial Sequence: Synthetic peptide
  Seed: KYSFGVTCVKK (EGFR A289V)
KSSFGVTCVKR

SEQ ID NO: 3324 - protein, 10 aa, Artificial Sequence
  Description of Artificial Sequence: Synthetic peptide
  Seed: KYSFGVTCVK (EGFR A289V)
KSSFGVTCVR

SEQ ID NO: 3325 - protein, 10 aa, Artificial Sequence
  Description of Artificial Sequence: Synthetic peptide
  Seed: KYSFGVTCVK (EGFR A289V)
KSSFGVTCVV

SEQ ID NO: 3326 - protein, 10 aa, Artificial Sequence
  Description of Artificial Sequence: Synthetic peptide
  Seed: KYSFGVTCVK (EGFR A289V)
KSSFGVTCVY

SEQ ID NO: 3327 - protein, 10 aa, Artificial Sequence
  Description of Artificial Sequence: Synthetic peptide
  Seed: KYSFGVTCVK (EGFR A289V)
KTSFGVTCVA

SEQ ID NO: 3328 - protein, 10 aa, Artificial Sequence
  Description of Artificial Sequence: Synthetic peptide
  Seed: KYSFGVTCVK (EGFR A289V)
KTSFGVTCVI

SEQ ID NO: 3329 - protein, 10 aa, Artificial Sequence
  Description of Artificial Sequence: Synthetic peptide
  Seed: KYSFGVTCVK (EGFR A289V)
KTSFGVTCVK

SEQ ID NO: 3330 - protein, 11 aa, Artificial Sequence
  Description of Artificial Sequence: Synthetic peptide
  Seed: KYSFGVTCVKK (EGFR A289V)
KTSFGVTCVKK

SEQ ID NO: 3331 - protein, 11 aa, Artificial Sequence
  Description of Artificial Sequence: Synthetic peptide
  Seed: KYSFGVTCVKK (EGFR A289V)
KTSFGVTCVKR

SEQ ID NO: 3332 - protein, 10 aa, Artificial Sequence
  Description of Artificial Sequence: Synthetic peptide
  Seed: KYSFGVTCVK (EGFR A289V)
KTSFGVTCVL

SEQ ID NO: 3333 - protein, 10 aa, Artificial Sequence
  Description of Artificial Sequence: Synthetic peptide
  Seed: KYSFGVTCVK (EGFR A289V)
KTSFGVTCVM

SEQ ID NO: 3334 - protein, 10 aa, Artificial Sequence
  Description of Artificial Sequence: Synthetic peptide
  Seed: KYSFGVTCVK (EGFR A289V)
KTSFGVTCVR

SEQ ID NO: 3335 - protein, 10 aa, Artificial Sequence
  Description of Artificial Sequence: Synthetic peptide
  Seed: KYSFGVTCVK (EGFR A289V)
KTSFGVTCVS

SEQ ID NO: 3336 - protein, 10 aa, Artificial Sequence
  Description of Artificial Sequence: Synthetic peptide
  Seed: KYSFGVTCVK (EGFR A289V)
KTSFGVTCVV

SEQ ID NO: 3337 - protein, 10 aa, Artificial Sequence
  Description of Artificial Sequence: Synthetic peptide
  Seed: KYSFGVTCVK (EGFR A289V)
KTSFGVTCVY

SEQ ID NO: 3338 - protein, 10 aa, Artificial Sequence
  Description of Artificial Sequence: Synthetic peptide
  Seed: KYSFGVTCVK (EGFR A289V)
KVSFGVTCVA

SEQ ID NO: 3339 - protein, 10 aa, Artificial Sequence
  Description of Artificial Sequence: Synthetic peptide
  Seed: KYSFGVTCVK (EGFR A289V)
KVSFGVTCVI

SEQ ID NO: 3340 - protein, 10 aa, Artificial Sequence
  Description of Artificial Sequence: Synthetic peptide
  Seed: KYSFGVTCVK (EGFR A289V)
KVSFGVTCVK

SEQ ID NO: 3341 - protein, 11 aa, Artificial Sequence
  Description of Artificial Sequence: Synthetic peptide
  Seed: KYSFGVTCVKK (EGFR A289V)
KVSFGVTCVKK

SEQ ID NO: 3342 - protein, 11 aa, Artificial Sequence
  Description of Artificial Sequence: Synthetic peptide
  Seed: KYSFGVTCVKK (EGFR A289V)
KVSFGVTCVKR

SEQ ID NO: 3343 - protein, 10 aa, Artificial Sequence
  Description of Artificial Sequence: Synthetic peptide
  Seed: KYSFGVTCVK (EGFR A289V)
KVSFGVTCVR

SEQ ID NO: 3344 - protein, 10 aa, Artificial Sequence
  Description of Artificial Sequence: Synthetic peptide
  Seed: KYSFGVTCVK (EGFR A289V)
KVSFGVTCVV

SEQ ID NO: 3345 - protein, 10 aa, Artificial Sequence
  Description of Artificial Sequence: Synthetic peptide
  Seed: KYSFGVTCVK (EGFR A289V)
KVSFGVTCVY

SEQ ID NO: 3346 - protein, 9 aa, Artificial Sequence
  Description of Artificial Sequence: Synthetic peptide
  Seed: KYSFGVTCV (EGFR A289V)
KWSFGVTCF

SEQ ID NO: 3347 - protein, 9 aa, Artificial Sequence
  Description of Artificial Sequence: Synthetic peptide
  Seed: KYSFGVTCV (EGFR A289V)
KWSFGVTCI

SEQ ID NO: 3348 - protein, 9 aa, Artificial Sequence
  Description of Artificial Sequence: Synthetic peptide
  Seed: KYSFGVTCV (EGFR A289V)
KWSFGVTCL

SEQ ID NO: 3349 - protein, 9 aa, Artificial Sequence
  Description of Artificial Sequence: Synthetic peptide
  Seed: KYSFGVTCV (EGFR A289V)
KWSFGVTCM

SEQ ID NO: 3350 - protein, 9 aa, Artificial Sequence
  Description of Artificial Sequence: Synthetic peptide
  Seed: KYSFGVTCV (EGFR A289V)
KWSFGVTCV

SEQ ID NO: 3351 - protein, 10 aa, Artificial Sequence
  Description of Artificial Sequence: Synthetic peptide
  Seed: KYSFGVTCVK (EGFR A289V)
KWSFGVTCVA

SEQ ID NO: 3352 - protein, 10 aa, Artificial Sequence
  Description of Artificial Sequence: Synthetic peptide
  Seed: KYSFGVTCVK (EGFR A289V)
KWSFGVTCVI

SEQ ID NO: 3353 - protein, 10 aa, Artificial Sequence
  Description of Artificial Sequence: Synthetic peptide
  Seed: KYSFGVTCVK (EGFR A289V)
KWSFGVTCVK

SEQ ID NO: 3354 - protein, 11 aa, Artificial Sequence
  Description of Artificial Sequence: Synthetic peptide
  Seed: KYSFGVTCVKK (EGFR A289V)
KWSFGVTCVKK

SEQ ID NO: 3355 - protein, 11 aa, Artificial Sequence
  Description of Artificial Sequence: Synthetic peptide
  Seed: KYSFGVTCVKK (EGFR A289V)
KWSFGVTCVKR

SEQ ID NO: 3356 - protein, 10 aa, Artificial Sequence
  Description of Artificial Sequence: Synthetic peptide
  Seed: KYSFGVTCVK (EGFR A289V)
KWSFGVTCVR

SEQ ID NO: 3357 - protein, 10 aa, Artificial Sequence
  Description of Artificial Sequence: Synthetic peptide
  Seed: KYSFGVTCVK (EGFR A289V)
KWSFGVTCVV

SEQ ID NO: 3358 - protein, 10 aa, Artificial Sequence
  Description of Artificial Sequence: Synthetic peptide
  Seed: KYSFGVTCVK (EGFR A289V)
KWSFGVTCVY

SEQ ID NO: 3359 - protein, 9 aa, Artificial Sequence
  Description of Artificial Sequence: Synthetic peptide
  Seed: KYSFGVTCV (EGFR A289V)
KWSFGVTCW

SEQ ID NO: 3360 - protein, 9 aa, Artificial Sequence
  Description of Artificial Sequence: Synthetic peptide
  Seed: KYSFGVTCV (EGFR A289V)
KWSFGVTCY

SEQ ID NO: 3361 - protein, 9 aa, Artificial Sequence
  Description of Artificial Sequence: Synthetic peptide
  Seed: KYSFGVTCV (EGFR A289V)
KYSFGVTCI

SEQ ID NO: 3362 - protein, 9 aa, Artificial Sequence
  Description of Artificial Sequence: Synthetic peptide
  Seed: KYSFGVTCV (EGFR A289V)
KYSFGVTCM

SEQ ID NO: 3363 - protein, 10 aa, Artificial Sequence
  Description of Artificial Sequence: Synthetic peptide
  Seed: KYSFGVTCVK (EGFR A289V)
KYSFGVTCVA

SEQ ID NO: 3364 - protein, 10 aa, Artificial Sequence
  Description of Artificial Sequence: Synthetic peptide
  Seed: KYSFGVTCVK (EGFR A289V)
KYSFGVTCVI

SEQ ID NO: 3365 - protein, 11 aa, Artificial Sequence
  Description of Artificial Sequence: Synthetic peptide
  Seed: KYSFGVTCVKK (EGFR A289V)
KYSFGVTCVKR

SEQ ID NO: 3366 - protein, 10 aa, Artificial Sequence
  Description of Artificial Sequence: Synthetic peptide
  Seed: KYSFGVTCVK (EGFR A289V)
KYSFGVTCVR

SEQ ID NO: 3367 - protein, 10 aa, Artificial Sequence
  Description of Artificial Sequence: Synthetic peptide
  Seed: KYSFGVTCVK (EGFR A289V)
KYSFGVTCVV

SEQ ID NO: 3368 - protein, 9 aa, Artificial Sequence
  Description of Artificial Sequence: Synthetic peptide
  Seed: KYSFGVTCV (EGFR A289V)
KYSFGVTCW

SEQ ID NO: 3369 - protein, 9 aa, Artificial Sequence
  Description of Artificial Sequence: Synthetic peptide
  Seed: KYSFGVTCV (EGFR A289V)
KYSFGVTCY

SEQ ID NO: 3370 - protein, 9 aa, Artificial Sequence
  Description of Artificial Sequence: Synthetic peptide
  Seed: SFGVTCVKK (EGFR A289V)
SAGVTCVKR

SEQ ID NO: 3371 - protein, 9 aa, Artificial Sequence
  Description of Artificial Sequence: Synthetic peptide
  Seed: SFGVTCVKK (EGFR A289V)
SFGVTCVKR

SEQ ID NO: 3372 - protein, 9 aa, Artificial Sequence
  Description of Artificial Sequence: Synthetic peptide
  Seed: SFGVTCVKK (EGFR A289V)
SGGVTCVKR

SEQ ID NO: 3373 - protein, 9 aa, Artificial Sequence
  Description of Artificial Sequence: Synthetic peptide
  Seed: SFGVTCVKK (EGFR A289V)
SIGVTCVKR

SEQ ID NO: 3374 - protein, 9 aa, Artificial Sequence
  Description of Artificial Sequence: Synthetic peptide
  Seed: SFGVTCVKK (EGFR A289V)
SLGVTCVKR

SEQ ID NO: 3375 - protein, 9 aa, Artificial Sequence
  Description of Artificial Sequence: Synthetic peptide
  Seed: SFGVTCVKK (EGFR A289V)
SMGVTCVKK

SEQ ID NO: 3376 - protein, 9 aa, Artificial Sequence
  Description of Artificial Sequence: Synthetic peptide
  Seed: SFGVTCVKK (EGFR A289V)
SMGVTCVKR

SEQ ID NO: 3377 - protein, 9 aa, Artificial Sequence
  Description of Artificial Sequence: Synthetic peptide
  Seed: SFGVTCVKK (EGFR A289V)
SQGVTCVKR

SEQ ID NO: 3378 - protein, 9 aa, Artificial Sequence
  Description of Artificial Sequence: Synthetic peptide
  Seed: SFGVTCVKK (EGFR A289V)
SSGVTCVKR

SEQ ID NO: 3379 - protein, 9 aa, Artificial Sequence
  Description of Artificial Sequence: Synthetic peptide
  Seed: SFGVTCVKK (EGFR A289V)
STGVTCVKK

SEQ ID NO: 3380 - protein, 9 aa, Artificial Sequence
  Description of Artificial Sequence: Synthetic peptide
  Seed: SFGVTCVKK (EGFR A289V)
STGVTCVKR

SEQ ID NO: 3381 - protein, 9 aa, Artificial Sequence
  Description of Artificial Sequence: Synthetic peptide
  Seed: SFGVTCVKK (EGFR A289V)
SVGVTCVKR

SEQ ID NO: 3382 - protein, 9 aa, Artificial Sequence
  Description of Artificial Sequence: Synthetic peptide
  Seed: SFGVTCVKK (EGFR A289V)
SWGVTCVKR

SEQ ID NO: 3383 - protein, 9 aa, Artificial Sequence
  Description of Artificial Sequence: Synthetic peptide
  Seed: SFGVTCVKK (EGFR A289V)
SYGVTCVKK

SEQ ID NO: 3384 - protein, 9 aa, Artificial Sequence
  Description of Artificial Sequence: Synthetic peptide
  Seed: SFGVTCVKK (EGFR A289V)
SYGVTCVKR

SEQ ID NO: 3385 - protein, 9 aa, Artificial Sequence
  Description of Artificial Sequence: Synthetic peptide
  Seed: VTCVKKCPR (EGFR A289V)
VACVKKCPR

SEQ ID NO: 3386 - protein, 9 aa, Artificial Sequence
  Description of Artificial Sequence: Synthetic peptide
  Seed: VTCVKKCPR (EGFR A289V)
VFCVKKCPK

SEQ ID NO: 3387 - protein, 9 aa, Artificial Sequence
  Description of Artificial Sequence: Synthetic peptide
  Seed: VTCVKKCPR (EGFR A289V)
VFCVKKCPR

SEQ ID NO: 3388 - protein, 9 aa, Artificial Sequence
  Description of Artificial Sequence: Synthetic peptide
  Seed: VTCVKKCPR (EGFR A289V)
VGCVKKCPR

SEQ ID NO: 3389 - protein, 9 aa, Artificial Sequence
  Description of Artificial Sequence: Synthetic peptide
  Seed: VTCVKKCPR (EGFR A289V)
VICVKKCPK

SEQ ID NO: 3390 - protein, 9 aa, Artificial Sequence
  Description of Artificial Sequence: Synthetic peptide
  Seed: VTCVKKCPR (EGFR A289V)
VICVKKCPR

SEQ ID NO: 3391 - protein, 9 aa, Artificial Sequence
  Description of Artificial Sequence: Synthetic peptide
  Seed: VTCVKKCPR (EGFR A289V)
VLCVKKCPK

SEQ ID NO: 3392 - protein, 9 aa, Artificial Sequence
  Description of Artificial Sequence: Synthetic peptide
  Seed: VTCVKKCPR (EGFR A289V)
VLCVKKCPR

SEQ ID NO: 3393 - protein, 9 aa, Artificial Sequence
  Description of Artificial Sequence: Synthetic peptide
  Seed: VTCVKKCPR (EGFR A289V)
VMCVKKCPK

SEQ ID NO: 3394 - protein, 9 aa, Artificial Sequence
  Description of Artificial Sequence: Synthetic peptide
  Seed: VTCVKKCPR (EGFR A289V)
VMCVKKCPR

SEQ ID NO: 3395 - protein, 9 aa, Artificial Sequence
  Description of Artificial Sequence: Synthetic peptide
  Seed: VTCVKKCPR (EGFR A289V)
VNCVKKCPR

SEQ ID NO: 3396 - protein, 9 aa, Artificial Sequence
  Description of Artificial Sequence: Synthetic peptide
  Seed: VTCVKKCPR (EGFR A289V)
VQCVKKCPK

SEQ ID NO: 3397 - protein, 9 aa, Artificial Sequence
  Description of Artificial Sequence: Synthetic peptide
  Seed: VTCVKKCPR (EGFR A289V)
VQCVKKCPR

SEQ ID NO: 3398 - protein, 9 aa, Artificial Sequence
  Description of Artificial Sequence: Synthetic peptide
  Seed: VTCVKKCPR (EGFR A289V)
VSCVKKCPK

SEQ ID NO: 3399 - protein, 9 aa, Artificial Sequence
  Description of Artificial Sequence: Synthetic peptide
  Seed: VTCVKKCPR (EGFR A289V)
VSCVKKCPR

SEQ ID NO: 3400 - protein, 9 aa, Artificial Sequence
  Description of Artificial Sequence: Synthetic peptide
  Seed: VTCVKKCPR (EGFR A289V)
VTCVKKCPK

SEQ ID NO: 3401 - protein, 9 aa, Artificial Sequence
  Description of Artificial Sequence: Synthetic peptide
  Seed: VTCVKKCPR (EGFR A289V)
VVCVKKCPK

SEQ ID NO: 3402 - protein, 9 aa, Artificial Sequence
  Description of Artificial Sequence: Synthetic peptide
  Seed: VTCVKKCPR (EGFR A289V)
VVCVKKCPR

SEQ ID NO: 3403 - protein, 9 aa, Artificial Sequence
  Description of Artificial Sequence: Synthetic peptide
  Seed: VTCVKKCPR (EGFR A289V)
VWCVKKCPK

SEQ ID NO: 3404 - protein, 9 aa, Artificial Sequence
  Description of Artificial Sequence: Synthetic peptide
  Seed: VTCVKKCPR (EGFR A289V)
VWCVKKCPR

SEQ ID NO: 3405 - protein, 9 aa, Artificial Sequence
  Description of Artificial Sequence: Synthetic peptide
  Seed: VTCVKKCPR (EGFR A289V)
VYCVKKCPK

SEQ ID NO: 3406 - protein, 9 aa, Artificial Sequence
  Description of Artificial Sequence: Synthetic peptide
  Seed: VTCVKKCPR (EGFR A289V)
VYCVKKCPR

SEQ ID NO: 3407 - protein, 8 aa, Artificial Sequence
  Description of Artificial Sequence: Synthetic peptide
  Seed: YSFGVTCV (EGFR A289V)
YAFGVTCF

SEQ ID NO: 3408 - protein, 8 aa, Artificial Sequence
  Description of Artificial Sequence: Synthetic peptide
  Seed: YSFGVTCV (EGFR A289V)
YAFGVTCI

SEQ ID NO: 3409 - protein, 8 aa, Artificial Sequence
  Description of Artificial Sequence: Synthetic peptide
  Seed: YSFGVTCV (EGFR A289V)
YAFGVTCL

SEQ ID NO: 3410 - protein, 8 aa, Artificial Sequence
  Description of Artificial Sequence: Synthetic peptide
  Seed: YSFGVTCV (EGFR A289V)
YAFGVTCV

SEQ ID NO: 3411 - protein, 9 aa, Artificial Sequence
  Description of Artificial Sequence: Synthetic peptide
  Seed: YSFGVTCVK (EGFR A289V)
YAFGVTCVA

SEQ ID NO: 3412 - protein, 9 aa, Artificial Sequence
  Description of Artificial Sequence: Synthetic peptide
  Seed: YSFGVTCVK (EGFR A289V)
YAFGVTCVC

SEQ ID NO: 3413 - protein, 9 aa, Artificial Sequence
  Description of Artificial Sequence: Synthetic peptide
  Seed: YSFGVTCVK (EGFR A289V)
YAFGVTCVF

SEQ ID NO: 3414 - protein, 9 aa, Artificial Sequence
  Description of Artificial Sequence: Synthetic peptide
  Seed: YSFGVTCVK (EGFR A289V)
YAFGVTCVG

SEQ ID NO: 3415 - protein, 9 aa, Artificial Sequence
  Description of Artificial Sequence: Synthetic peptide
  Seed: YSFGVTCVK (EGFR A289V)
YAFGVTCVH

SEQ ID NO: 3416 - protein, 9 aa, Artificial Sequence
  Description of Artificial Sequence: Synthetic peptide
  Seed: YSFGVTCVK (EGFR A289V)
YAFGVTCVI

SEQ ID NO: 3417 - protein, 9 aa, Artificial Sequence
  Description of Artificial Sequence: Synthetic peptide
  Seed: YSFGVTCVK (EGFR A289V)
YAFGVTCVK

SEQ ID NO: 3418 - protein, 10 aa, Artificial Sequence
  Description of Artificial Sequence: Synthetic peptide
  Seed: YSFGVTCVKK (EGFR A289V)
YAFGVTCVKA

SEQ ID NO: 3419 - protein, 10 aa, Artificial Sequence
  Description of Artificial Sequence: Synthetic peptide
  Seed: YSFGVTCVKK (EGFR A289V)
YAFGVTCVKC

SEQ ID NO: 3420 - protein, 10 aa, Artificial Sequence
  Description of Artificial Sequence: Synthetic peptide
  Seed: YSFGVTCVKK (EGFR A289V)
YAFGVTCVKD

SEQ ID NO: 3421 - protein, 10 aa, Artificial Sequence
  Description of Artificial Sequence: Synthetic peptide
  Seed: YSFGVTCVKK (EGFR A289V)
YAFGVTCVKE

SEQ ID NO: 3422 - protein, 10 aa, Artificial Sequence
  Description of Artificial Sequence: Synthetic peptide
  Seed: YSFGVTCVKK (EGFR A289V)
YAFGVTCVKF

SEQ ID NO: 3423 - protein, 10 aa, Artificial Sequence
  Description of Artificial Sequence: Synthetic peptide
  Seed: YSFGVTCVKK (EGFR A289V)
YAFGVTCVKG

SEQ ID NO: 3424 - protein, 10 aa, Artificial Sequence
  Description of Artificial Sequence: Synthetic peptide
  Seed: YSFGVTCVKK (EGFR A289V)
YAFGVTCVKH

SEQ ID NO: 3425 - protein, 10 aa, Artificial Sequence
  Description of Artificial Sequence: Synthetic peptide
  Seed: YSFGVTCVKK (EGFR A289V)
YAFGVTCVKI

SEQ ID NO: 3426 - protein, 10 aa, Artificial Sequence
  Description of Artificial Sequence: Synthetic peptide
  Seed: YSFGVTCVKK (EGFR A289V)
YAFGVTCVKK

SEQ ID NO: 3427 - protein, 10 aa, Artificial Sequence
  Description of Artificial Sequence: Synthetic peptide
  Seed: YSFGVTCVKK (EGFR A289V)
YAFGVTCVKL

SEQ ID NO: 3428 - protein, 10 aa, Artificial Sequence
  Description of Artificial Sequence: Synthetic peptide
  Seed: YSFGVTCVKK (EGFR A289V)
YAFGVTCVKM

SEQ ID NO: 3429 - protein, 10 aa, Artificial Sequence
  Description of Artificial Sequence: Synthetic peptide
  Seed: YSFGVTCVKK (EGFR A289V)
YAFGVTCVKN

SEQ ID NO: 3430 - protein, 10 aa, Artificial Sequence
  Description of Artificial Sequence: Synthetic peptide
  Seed: YSFGVTCVKK (EGFR A289V)
YAFGVTCVKP

SEQ ID NO: 3431 - protein, 10 aa, Artificial Sequence
  Description of Artificial Sequence: Synthetic peptide
  Seed: YSFGVTCVKK (EGFR A289V)
YAFGVTCVKQ

SEQ ID NO: 3432 - protein, 10 aa, Artificial Sequence
  Description of Artificial Sequence: Synthetic peptide
  Seed: YSFGVTCVKK (EGFR A289V)
YAFGVTCVKR

SEQ ID NO: 3433 - protein, 10 aa, Artificial Sequence
  Description of Artificial Sequence: Synthetic peptide
  Seed: YSFGVTCVKK (EGFR A289V)
YAFGVTCVKS

SEQ ID NO: 3434 - protein, 10 aa, Artificial Sequence
  Description of Artificial Sequence: Synthetic peptide
  Seed: YSFGVTCVKK (EGFR A289V)
YAFGVTCVKT

SEQ ID NO: 3435 - protein, 10 aa, Artificial Sequence
  Description of Artificial Sequence: Synthetic peptide
  Seed: YSFGVTCVKK (EGFR A289V)
YAFGVTCVKV

SEQ ID NO: 3436 - protein, 10 aa, Artificial Sequence
  Description of Artificial Sequence: Synthetic peptide
  Seed: YSFGVTCVKK (EGFR A289V)
YAFGVTCVKW

SEQ ID NO: 3437 - protein, 10 aa, Artificial Sequence
  Description of Artificial Sequence: Synthetic peptide
  Seed: YSFGVTCVKK (EGFR A289V)
YAFGVTCVKY

SEQ ID NO: 3438 - protein, 9 aa, Artificial Sequence
  Description of Artificial Sequence: Synthetic peptide
  Seed: YSFGVTCVK (EGFR A289V)
YAFGVTCVL

SEQ ID NO: 3439 - protein, 9 aa, Artificial Sequence
  Description of Artificial Sequence: Synthetic peptide
  Seed: YSFGVTCVK (EGFR A289V)
YAFGVTCVM

SEQ ID NO: 3440 - protein, 9 aa, Artificial Sequence
  Description of Artificial Sequence: Synthetic peptide
  Seed: YSFGVTCVK (EGFR A289V)
YAFGVTCVN

SEQ ID NO: 3441 - protein, 9 aa, Artificial Sequence
  Description of Artificial Sequence: Synthetic peptide
  Seed: YSFGVTCVK (EGFR A289V)
YAFGVTCVQ

SEQ ID NO: 3442 - protein, 9 aa, Artificial Sequence
  Description of Artificial Sequence: Synthetic peptide
  Seed: YSFGVTCVK (EGFR A289V)
YAFGVTCVR

SEQ ID NO: 3443 - protein, 9 aa, Artificial Sequence
  Description of Artificial Sequence: Synthetic peptide
  Seed: YSFGVTCVK (EGFR A289V)
YAFGVTCVS

SEQ ID NO: 3444 - protein, 9 aa, Artificial Sequence
  Description of Artificial Sequence: Synthetic peptide
  Seed: YSFGVTCVK (EGFR A289V)
YAFGVTCVT

SEQ ID NO: 3445 - protein, 9 aa, Artificial Sequence
  Description of Artificial Sequence: Synthetic peptide
  Seed: YSFGVTCVK (EGFR A289V)
YAFGVTCVV

SEQ ID NO: 3446 - protein, 9 aa, Artificial Sequence
  Description of Artificial Sequence: Synthetic peptide
  Seed: YSFGVTCVK (EGFR A289V)
YAFGVTCVW

SEQ ID NO: 3447 - protein, 9 aa, Artificial Sequence
  Description of Artificial Sequence: Synthetic peptide
  Seed: YSFGVTCVK (EGFR A289V)
YAFGVTCVY

SEQ ID NO: 3448 - protein, 8 aa, Artificial Sequence
  Description of Artificial Sequence: Synthetic peptide
  Seed: YSFGVTCV (EGFR A289V)
YAFGVTCY

SEQ ID NO: 3449 - protein, 9 aa, Artificial Sequence
  Description of Artificial Sequence: Synthetic peptide
  Seed: YSFGVTCVK (EGFR A289V)
YCFGVTCVF

SEQ ID NO: 3450 - protein, 9 aa, Artificial Sequence
  Description of Artificial Sequence: Synthetic peptide
  Seed: YSFGVTCVK (EGFR A289V)
YCFGVTCVI

SEQ ID NO: 3451 - protein, 9 aa, Artificial Sequence
  Description of Artificial Sequence: Synthetic peptide
  Seed: YSFGVTCVK (EGFR A289V)
YCFGVTCVK

SEQ ID NO: 3452 - protein, 10 aa, Artificial Sequence
  Description of Artificial Sequence: Synthetic peptide
  Seed: YSFGVTCVKK (EGFR A289V)
YCFGVTCVKK

SEQ ID NO: 3453 - protein, 10 aa, Artificial Sequence
  Description of Artificial Sequence: Synthetic peptide
  Seed: YSFGVTCVKK (EGFR A289V)
YCFGVTCVKR

SEQ ID NO: 3454 - protein, 9 aa, Artificial Sequence
  Description of Artificial Sequence: Synthetic peptide
  Seed: YSFGVTCVK (EGFR A289V)
YCFGVTCVL

SEQ ID NO: 3455 - protein, 9 aa, Artificial Sequence
  Description of Artificial Sequence: Synthetic peptide
  Seed: YSFGVTCVK (EGFR A289V)
YCFGVTCVM

SEQ ID NO: 3456 - protein, 9 aa, Artificial Sequence
  Description of Artificial Sequence: Synthetic peptide
  Seed: YSFGVTCVK (EGFR A289V)
YCFGVTCVR

SEQ ID NO: 3457 - protein, 9 aa, Artificial Sequence
  Description of Artificial Sequence: Synthetic peptide
  Seed: YSFGVTCVK (EGFR A289V)
YCFGVTCVV

SEQ ID NO: 3458 - protein, 9 aa, Artificial Sequence
  Description of Artificial Sequence: Synthetic peptide
  Seed: YSFGVTCVK (EGFR A289V)
YCFGVTCVY

SEQ ID NO: 3459 - protein, 9 aa, Artificial Sequence
  Description of Artificial Sequence: Synthetic peptide
  Seed: YSFGVTCVK (EGFR A289V)
YDFGVTCVK

SEQ ID NO: 3460 - protein, 10 aa, Artificial Sequence
  Description of Artificial Sequence: Synthetic peptide
  Seed: YSFGVTCVKK (EGFR A289V)
YDFGVTCVKR

SEQ ID NO: 3461 - protein, 9 aa, Artificial Sequence
  Description of Artificial Sequence: Synthetic peptide
  Seed: YSFGVTCVK (EGFR A289V)
YDFGVTCVR

SEQ ID NO: 3462 - protein, 10 aa, Artificial Sequence
  Description of Artificial Sequence: Synthetic peptide
  Seed: YSFGVTCVKK (EGFR A289V)
YEFGVTCVKR

SEQ ID NO: 3463 - protein, 9 aa, Artificial Sequence
  Description of Artificial Sequence: Synthetic peptide
  Seed: YSFGVTCVK (EGFR A289V)
YFFGVTCVF

SEQ ID NO: 3464 - protein, 9 aa, Artificial Sequence
  Description of Artificial Sequence: Synthetic peptide
  Seed: YSFGVTCVK (EGFR A289V)
YFFGVTCVI

SEQ ID NO: 3465 - protein, 9 aa, Artificial Sequence
  Description of Artificial Sequence: Synthetic peptide
  Seed: YSFGVTCVK (EGFR A289V)
YFFGVTCVK

SEQ ID NO: 3466 - protein, 10 aa, Artificial Sequence
  Description of Artificial Sequence: Synthetic peptide
  Seed: YSFGVTCVKK (EGFR A289V)
YFFGVTCVKK

SEQ ID NO: 3467 - protein, 10 aa, Artificial Sequence
  Description of Artificial Sequence: Synthetic peptide
  Seed: YSFGVTCVKK (EGFR A289V)
YFFGVTCVKR

SEQ ID NO: 3468 - protein, 9 aa, Artificial Sequence
  Description of Artificial Sequence: Synthetic peptide
  Seed: YSFGVTCVK (EGFR A289V)
YFFGVTCVL

SEQ ID NO: 3469 - protein, 9 aa, Artificial Sequence
  Description of Artificial Sequence: Synthetic peptide
  Seed: YSFGVTCVK (EGFR A289V)
YFFGVTCVM

SEQ ID NO: 3470 - protein, 9 aa, Artificial Sequence
  Description of Artificial Sequence: Synthetic peptide
  Seed: YSFGVTCVK (EGFR A289V)
YFFGVTCVR

SEQ ID NO: 3471 - protein, 9 aa, Artificial Sequence
  Description of Artificial Sequence: Synthetic peptide
  Seed: YSFGVTCVK (EGFR A289V)
YFFGVTCVV

SEQ ID NO: 3472 - protein, 9 aa, Artificial Sequence
  Description of Artificial Sequence: Synthetic peptide
  Seed: YSFGVTCVK (EGFR A289V)
YFFGVTCVY

SEQ ID NO: 3473 - protein, 9 aa, Artificial Sequence
  Description of Artificial Sequence: Synthetic peptide
  Seed: YSFGVTCVK (EGFR A289V)
YGFGVTCVA

SEQ ID NO: 3474 - protein, 9 aa, Artificial Sequence
  Description of Artificial Sequence: Synthetic peptide
  Seed: YSFGVTCVK (EGFR A289V)
YGFGVTCVF

SEQ ID NO: 3475 - protein, 9 aa, Artificial Sequence
  Description of Artificial Sequence: Synthetic peptide
  Seed: YSFGVTCVK (EGFR A289V)
YGFGVTCVI

SEQ ID NO: 3476 - protein, 9 aa, Artificial Sequence
  Description of Artificial Sequence: Synthetic peptide
  Seed: YSFGVTCVK (EGFR A289V)
YGFGVTCVK

SEQ ID NO: 3477 - protein, 10 aa, Artificial Sequence
  Description of Artificial Sequence: Synthetic peptide
  Seed: YSFGVTCVKK (EGFR A289V)
YGFGVTCVKK

SEQ ID NO: 3478 - protein, 10 aa, Artificial Sequence
  Description of Artificial Sequence: Synthetic peptide
  Seed: YSFGVTCVKK (EGFR A289V)
YGFGVTCVKR

SEQ ID NO: 3479 - protein, 9 aa, Artificial Sequence
  Description of Artificial Sequence: Synthetic peptide
  Seed: YSFGVTCVK (EGFR A289V)
YGFGVTCVL

SEQ ID NO: 3480 - protein, 9 aa, Artificial Sequence
  Description of Artificial Sequence: Synthetic peptide
  Seed: YSFGVTCVK (EGFR A289V)
YGFGVTCVM

SEQ ID NO: 3481 - protein, 9 aa, Artificial Sequence
  Description of Artificial Sequence: Synthetic peptide
  Seed: YSFGVTCVK (EGFR A289V)
YGFGVTCVR

SEQ ID NO: 3482 - protein, 9 aa, Artificial Sequence
  Description of Artificial Sequence: Synthetic peptide
  Seed: YSFGVTCVK (EGFR A289V)
YGFGVTCVV

SEQ ID NO: 3483 - protein, 9 aa, Artificial Sequence
  Description of Artificial Sequence: Synthetic peptide
  Seed: YSFGVTCVK (EGFR A289V)
YGFGVTCVW

SEQ ID NO: 3484 - protein, 9 aa, Artificial Sequence
  Description of Artificial Sequence: Synthetic peptide
  Seed: YSFGVTCVK (EGFR A289V)
YGFGVTCVY

SEQ ID NO: 3485 - protein, 9 aa, Artificial Sequence
  Description of Artificial Sequence: Synthetic peptide
  Seed: YSFGVTCVK (EGFR A289V)
YHFGVTCVF

SEQ ID NO: 3486 - protein, 9 aa, Artificial Sequence
  Description of Artificial Sequence: Synthetic peptide
  Seed: YSFGVTCVK (EGFR A289V)
YHFGVTCVI

SEQ ID NO: 3487 - protein, 10 aa, Artificial Sequence
  Description of Artificial Sequence: Synthetic peptide
  Seed: YSFGVTCVKK (EGFR A289V)
YHFGVTCVKR

SEQ ID NO: 3488 - protein, 9 aa, Artificial Sequence
  Description of Artificial Sequence: Synthetic peptide
  Seed: YSFGVTCVK (EGFR A289V)
YHFGVTCVL

SEQ ID NO: 3489 - protein, 9 aa, Artificial Sequence
  Description of Artificial Sequence: Synthetic peptide
  Seed: YSFGVTCVK (EGFR A289V)
YHFGVTCVM

SEQ ID NO: 3490 - protein, 9 aa, Artificial Sequence
  Description of Artificial Sequence: Synthetic peptide
  Seed: YSFGVTCVK (EGFR A289V)
YHFGVTCVR

SEQ ID NO: 3491 - protein, 9 aa, Artificial Sequence
  Description of Artificial Sequence: Synthetic peptide
  Seed: YSFGVTCVK (EGFR A289V)
YHFGVTCVV

SEQ ID NO: 3492 - protein, 9 aa, Artificial Sequence
  Description of Artificial Sequence: Synthetic peptide
  Seed: YSFGVTCVK (EGFR A289V)
YHFGVTCVY

SEQ ID NO: 3493 - protein, 9 aa, Artificial Sequence
  Description of Artificial Sequence: Synthetic peptide
  Seed: YSFGVTCVK (EGFR A289V)
YIFGVTCVA

SEQ ID NO: 3494 - protein, 9 aa, Artificial Sequence
  Description of Artificial Sequence: Synthetic peptide
  Seed: YSFGVTCVK (EGFR A289V)
YIFGVTCVF

SEQ ID NO: 3495 - protein, 9 aa, Artificial Sequence
  Description of Artificial Sequence: Synthetic peptide
  Seed: YSFGVTCVK (EGFR A289V)
YIFGVTCVH

SEQ ID NO: 3496 - protein, 9 aa, Artificial Sequence
  Description of Artificial Sequence: Synthetic peptide
  Seed: YSFGVTCVK (EGFR A289V)
YIFGVTCVI

SEQ ID NO: 3497 - protein, 9 aa, Artificial Sequence
  Description of Artificial Sequence: Synthetic peptide
  Seed: YSFGVTCVK (EGFR A289V)
YIFGVTCVK

SEQ ID NO: 3498 - protein, 10 aa, Artificial Sequence
  Description of Artificial Sequence: Synthetic peptide
  Seed: YSFGVTCVKK (EGFR A289V)
YIFGVTCVKA

SEQ ID NO: 3499 - protein, 10 aa, Artificial Sequence
  Description of Artificial Sequence: Synthetic peptide
  Seed: YSFGVTCVKK (EGFR A289V)
YIFGVTCVKC

SEQ ID NO: 3500 - protein, 10 aa, Artificial Sequence
  Description of Artificial Sequence: Synthetic peptide
  Seed: YSFGVTCVKK (EGFR A289V)
YIFGVTCVKD

SEQ ID NO: 3501 - protein, 10 aa, Artificial Sequence
  Description of Artificial Sequence: Synthetic peptide
  Seed: YSFGVTCVKK (EGFR A289V)
YIFGVTCVKE

SEQ ID NO: 3502 - protein, 10 aa, Artificial Sequence
  Description of Artificial Sequence: Synthetic peptide
  Seed: YSFGVTCVKK (EGFR A289V)
YIFGVTCVKF

SEQ ID NO: 3503 - protein, 10 aa, Artificial Sequence
  Description of Artificial Sequence: Synthetic peptide
  Seed: YSFGVTCVKK (EGFR A289V)
YIFGVTCVKG

SEQ ID NO: 3504 - protein, 10 aa, Artificial Sequence
  Description of Artificial Sequence: Synthetic peptide
  Seed: YSFGVTCVKK (EGFR A289V)
YIFGVTCVKH

SEQ ID NO: 3505 - protein, 10 aa, Artificial Sequence
  Description of Artificial Sequence: Synthetic peptide
  Seed: YSFGVTCVKK (EGFR A289V)
YIFGVTCVKI

SEQ ID NO: 3506 - protein, 10 aa, Artificial Sequence
  Description of Artificial Sequence: Synthetic peptide
  Seed: YSFGVTCVKK (EGFR A289V)
YIFGVTCVKK

SEQ ID NO: 3507 - protein, 10 aa, Artificial Sequence
  Description of Artificial Sequence: Synthetic peptide
  Seed: YSFGVTCVKK (EGFR A289V)
YIFGVTCVKL

SEQ ID NO: 3508 - protein, 10 aa, Artificial Sequence
  Description of Artificial Sequence: Synthetic peptide
  Seed: YSFGVTCVKK (EGFR A289V)
YIFGVTCVKM

SEQ ID NO: 3509 - protein, 10 aa, Artificial Sequence
  Description of Artificial Sequence: Synthetic peptide
  Seed: YSFGVTCVKK (EGFR A289V)
YIFGVTCVKN

SEQ ID NO: 3510 - protein, 10 aa, Artificial Sequence
  Description of Artificial Sequence: Synthetic peptide
  Seed: YSFGVTCVKK (EGFR A289V)
YIFGVTCVKP

SEQ ID NO: 3511 - protein, 10 aa, Artificial Sequence
  Description of Artificial Sequence: Synthetic peptide
  Seed: YSFGVTCVKK (EGFR A289V)
YIFGVTCVKQ

SEQ ID NO: 3512 - protein, 10 aa, Artificial Sequence
  Description of Artificial Sequence: Synthetic peptide
  Seed: YSFGVTCVKK (EGFR A289V)
YIFGVTCVKR

SEQ ID NO: 3513 - protein, 10 aa, Artificial Sequence
  Description of Artificial Sequence: Synthetic peptide
  Seed: YSFGVTCVKK (EGFR A289V)
YIFGVTCVKS

SEQ ID NO: 3514 - protein, 10 aa, Artificial Sequence
  Description of Artificial Sequence: Synthetic peptide
  Seed: YSFGVTCVKK (EGFR A289V)
YIFGVTCVKT

SEQ ID NO: 3515 - protein, 10 aa, Artificial Sequence
  Description of Artificial Sequence: Synthetic peptide
  Seed: YSFGVTCVKK (EGFR A289V)
YIFGVTCVKV

SEQ ID NO: 3516 - protein, 10 aa, Artificial Sequence
  Description of Artificial Sequence: Synthetic peptide
  Seed: YSFGVTCVKK (EGFR A289V)
YIFGVTCVKW

SEQ ID NO: 3517 - protein, 10 aa, Artificial Sequence
  Description of Artificial Sequence: Synthetic peptide
  Seed: YSFGVTCVKK (EGFR A289V)
YIFGVTCVKY

SEQ ID NO: 3518 - protein, 9 aa, Artificial Sequence
  Description of Artificial Sequence: Synthetic peptide
  Seed: YSFGVTCVK (EGFR A289V)
YIFGVTCVL

SEQ ID NO: 3519 - protein, 9 aa, Artificial Sequence
  Description of Artificial Sequence: Synthetic peptide
  Seed: YSFGVTCVK (EGFR A289V)
YIFGVTCVM

SEQ ID NO: 3520 - protein, 9 aa, Artificial Sequence
  Description of Artificial Sequence: Synthetic peptide
  Seed: YSFGVTCVK (EGFR A289V)
YIFGVTCVR

SEQ ID NO: 3521 - protein, 9 aa, Artificial Sequence
  Description of Artificial Sequence: Synthetic peptide
  Seed: YSFGVTCVK (EGFR A289V)
YIFGVTCVV

SEQ ID NO: 3522 - protein, 9 aa, Artificial Sequence
  Description of Artificial Sequence: Synthetic peptide
  Seed: YSFGVTCVK (EGFR A289V)
YIFGVTCVW

SEQ ID NO: 3523 - protein, 9 aa, Artificial Sequence
  Description of Artificial Sequence: Synthetic peptide
  Seed: YSFGVTCVK (EGFR A289V)
YIFGVTCVY

SEQ ID NO: 3524 - protein, 9 aa, Artificial Sequence
  Description of Artificial Sequence: Synthetic peptide
  Seed: YSFGVTCVK (EGFR A289V)
YKFGVTCVF

SEQ ID NO: 3525 - protein, 9 aa, Artificial Sequence
  Description of Artificial Sequence: Synthetic peptide
  Seed: YSFGVTCVK (EGFR A289V)
YKFGVTCVI

SEQ ID NO: 3526 - protein, 10 aa, Artificial Sequence
  Description of Artificial Sequence: Synthetic peptide
  Seed: YSFGVTCVKK (EGFR A289V)
YKFGVTCVKR

SEQ ID NO: 3527 - protein, 9 aa, Artificial Sequence
  Description of Artificial Sequence: Synthetic peptide
  Seed: YSFGVTCVK (EGFR A289V)
YKFGVTCVL

SEQ ID NO: 3528 - protein, 9 aa, Artificial Sequence
  Description of Artificial Sequence: Synthetic peptide
  Seed: YSFGVTCVK (EGFR A289V)
YKFGVTCVM

SEQ ID NO: 3529 - protein, 9 aa, Artificial Sequence
  Description of Artificial Sequence: Synthetic peptide
  Seed: YSFGVTCVK (EGFR A289V)
YKFGVTCVV

SEQ ID NO: 3530 - protein, 9 aa, Artificial Sequence
  Description of Artificial Sequence: Synthetic peptide
  Seed: YSFGVTCVK (EGFR A289V)
YKFGVTCVY

SEQ ID NO: 3531 - protein, 9 aa, Artificial Sequence
  Description of Artificial Sequence: Synthetic peptide
  Seed: YSFGVTCVK (EGFR A289V)
YLFGVTCVA

SEQ ID NO: 3532 - protein, 9 aa, Artificial Sequence
  Description of Artificial Sequence: Synthetic peptide
  Seed: YSFGVTCVK (EGFR A289V)
YLFGVTCVF

SEQ ID NO: 3533 - protein, 9 aa, Artificial Sequence
  Description of Artificial Sequence: Synthetic peptide
  Seed: YSFGVTCVK (EGFR A289V)
YLFGVTCVI

SEQ ID NO: 3534 - protein, 10 aa, Artificial Sequence
  Description of Artificial Sequence: Synthetic peptide
  Seed: YSFGVTCVKK (EGFR A289V)
YLFGVTCVKK

SEQ ID NO: 3535 - protein, 10 aa, Artificial Sequence
  Description of Artificial Sequence: Synthetic peptide
  Seed: YSFGVTCVKK (EGFR A289V)
YLFGVTCVKR

SEQ ID NO: 3536 - protein, 10 aa, Artificial Sequence
  Description of Artificial Sequence: Synthetic peptide
  Seed: YSFGVTCVKK (EGFR A289V)
YLFGVTCVKY

SEQ ID NO: 3537 - protein, 9 aa, Artificial Sequence
  Description of Artificial Sequence: Synthetic peptide
  Seed: YSFGVTCVK (EGFR A289V)
YLFGVTCVL

SEQ ID NO: 3538 - protein, 9 aa, Artificial Sequence
  Description of Artificial Sequence: Synthetic peptide
  Seed: YSFGVTCVK (EGFR A289V)
YLFGVTCVM

SEQ ID NO: 3539 - protein, 9 aa, Artificial Sequence
  Description of Artificial Sequence: Synthetic peptide
  Seed: YSFGVTCVK (EGFR A289V)
YLFGVTCVR

SEQ ID NO: 3540 - protein, 9 aa, Artificial Sequence
  Description of Artificial Sequence: Synthetic peptide
  Seed: YSFGVTCVK (EGFR A289V)
YLFGVTCVV

SEQ ID NO: 3541 - protein, 9 aa, Artificial Sequence
  Description of Artificial Sequence: Synthetic peptide
  Seed: YSFGVTCVK (EGFR A289V)
YLFGVTCVY

SEQ ID NO: 3542 - protein, 9 aa, Artificial Sequence
  Description of Artificial Sequence: Synthetic peptide
  Seed: YSFGVTCVK (EGFR A289V)
YMFGVTCVA

SEQ ID NO: 3543 - protein, 9 aa, Artificial Sequence
  Description of Artificial Sequence: Synthetic peptide
  Seed: YSFGVTCVK (EGFR A289V)
YMFGVTCVF

SEQ ID NO: 3544 - protein, 9 aa, Artificial Sequence
  Description of Artificial Sequence: Synthetic peptide
  Seed: YSFGVTCVK (EGFR A289V)
YMFGVTCVH

SEQ ID NO: 3545 - protein, 9 aa, Artificial Sequence
  Description of Artificial Sequence: Synthetic peptide
  Seed: YSFGVTCVK (EGFR A289V)
YMFGVTCVI

SEQ ID NO: 3546 - protein, 10 aa, Artificial Sequence
  Description of Artificial Sequence: Synthetic peptide
  Seed: YSFGVTCVKK (EGFR A289V)
YMFGVTCVKK

SEQ ID NO: 3547 - protein, 10 aa, Artificial Sequence
  Description of Artificial Sequence: Synthetic peptide
  Seed: YSFGVTCVKK (EGFR A289V)
YMFGVTCVKR

SEQ ID NO: 3548 - protein, 10 aa, Artificial Sequence
  Description of Artificial Sequence: Synthetic peptide
  Seed: YSFGVTCVKK (EGFR A289V)
YMFGVTCVKY

SEQ ID NO: 3549 - protein, 9 aa, Artificial Sequence
  Description of Artificial Sequence: Synthetic peptide
  Seed: YSFGVTCVK (EGFR A289V)
YMFGVTCVL

SEQ ID NO: 3550 - protein, 9 aa, Artificial Sequence
  Description of Artificial Sequence: Synthetic peptide
  Seed: YSFGVTCVK (EGFR A289V)
YMFGVTCVM

SEQ ID NO: 3551 - protein, 9 aa, Artificial Sequence
  Description of Artificial Sequence: Synthetic peptide
  Seed: YSFGVTCVK (EGFR A289V)
YMFGVTCVR

SEQ ID NO: 3552 - protein, 9 aa, Artificial Sequence
  Description of Artificial Sequence: Synthetic peptide
  Seed: YSFGVTCVK (EGFR A289V)
YMFGVTCVV

SEQ ID NO: 3553 - protein, 9 aa, Artificial Sequence
  Description of Artificial Sequence: Synthetic peptide
  Seed: YSFGVTCVK (EGFR A289V)
YMFGVTCVW

SEQ ID NO: 3554 - protein, 9 aa, Artificial Sequence
  Description of Artificial Sequence: Synthetic peptide
  Seed: YSFGVTCVK (EGFR A289V)
YNFGVTCVF

SEQ ID NO: 3555 - protein, 9 aa, Artificial Sequence
  Description of Artificial Sequence: Synthetic peptide
  Seed: YSFGVTCVK (EGFR A289V)
YNFGVTCVI

SEQ ID NO: 3556 - protein, 9 aa, Artificial Sequence
  Description of Artificial Sequence: Synthetic peptide
  Seed: YSFGVTCVK (EGFR A289V)
YNFGVTCVK

SEQ ID NO: 3557 - protein, 10 aa, Artificial Sequence
  Description of Artificial Sequence: Synthetic peptide
  Seed: YSFGVTCVKK (EGFR A289V)
YNFGVTCVKK

SEQ ID NO: 3558 - protein, 10 aa, Artificial Sequence
  Description of Artificial Sequence: Synthetic peptide
  Seed: YSFGVTCVKK (EGFR A289V)
YNFGVTCVKR

SEQ ID NO: 3559 - protein, 9 aa, Artificial Sequence
  Description of Artificial Sequence: Synthetic peptide
  Seed: YSFGVTCVK (EGFR A289V)
YNFGVTCVL

SEQ ID NO: 3560 - protein, 9 aa, Artificial Sequence
  Description of Artificial Sequence: Synthetic peptide
  Seed: YSFGVTCVK (EGFR A289V)
YNFGVTCVM

SEQ ID NO: 3561 - protein, 9 aa, Artificial Sequence
  Description of Artificial Sequence: Synthetic peptide
  Seed: YSFGVTCVK (EGFR A289V)
YNFGVTCVR

SEQ ID NO: 3562 - protein, 9 aa, Artificial Sequence
  Description of Artificial Sequence: Synthetic peptide
  Seed: YSFGVTCVK (EGFR A289V)
YNFGVTCVV

SEQ ID NO: 3563 - protein, 9 aa, Artificial Sequence
  Description of Artificial Sequence: Synthetic peptide
  Seed: YSFGVTCVK (EGFR A289V)
YNFGVTCVY

SEQ ID NO: 3564 - protein, 9 aa, Artificial Sequence
  Description of Artificial Sequence: Synthetic peptide
  Seed: YSFGVTCVK (EGFR A289V)
YPFGVTCVF

SEQ ID NO: 3565 - protein, 9 aa, Artificial Sequence
  Description of Artificial Sequence: Synthetic peptide
  Seed: YSFGVTCVK (EGFR A289V)
YPFGVTCVI

SEQ ID NO: 3566 - protein, 9 aa, Artificial Sequence
  Description of Artificial Sequence: Synthetic peptide
  Seed: YSFGVTCVK (EGFR A289V)
YPFGVTCVK

SEQ ID NO: 3567 - protein, 10 aa, Artificial Sequence
  Description of Artificial Sequence: Synthetic peptide
  Seed: YSFGVTCVKK (EGFR A289V)
YPFGVTCVKK

SEQ ID NO: 3568 - protein, 10 aa, Artificial Sequence
  Description of Artificial Sequence: Synthetic peptide
  Seed: YSFGVTCVKK (EGFR A289V)
YPFGVTCVKR

SEQ ID NO: 3569 - protein, 9 aa, Artificial Sequence
  Description of Artificial Sequence: Synthetic peptide
  Seed: YSFGVTCVK (EGFR A289V)
YPFGVTCVL

SEQ ID NO: 3570 - protein, 9 aa, Artificial Sequence
  Description of Artificial Sequence: Synthetic peptide
  Seed: YSFGVTCVK (EGFR A289V)
YPFGVTCVM

SEQ ID NO: 3571 - protein, 9 aa, Artificial Sequence
  Description of Artificial Sequence: Synthetic peptide
  Seed: YSFGVTCVK (EGFR A289V)
YPFGVTCVR

SEQ ID NO: 3572 - protein, 9 aa, Artificial Sequence
  Description of Artificial Sequence: Synthetic peptide
  Seed: YSFGVTCVK (EGFR A289V)
YPFGVTCVV

SEQ ID NO: 3573 - protein, 9 aa, Artificial Sequence
  Description of Artificial Sequence: Synthetic peptide
  Seed: YSFGVTCVK (EGFR A289V)
YPFGVTCVY

SEQ ID NO: 3574 - protein, 9 aa, Artificial Sequence
  Description of Artificial Sequence: Synthetic peptide
  Seed: YSFGVTCVK (EGFR A289V)
YQFGVTCVA

SEQ ID NO: 3575 - protein, 9 aa, Artificial Sequence
  Description of Artificial Sequence: Synthetic peptide
  Seed: YSFGVTCVK (EGFR A289V)
YQFGVTCVF

SEQ ID NO: 3576 - protein, 9 aa, Artificial Sequence
  Description of Artificial Sequence: Synthetic peptide
  Seed: YSFGVTCVK (EGFR A289V)
YQFGVTCVI

SEQ ID NO: 3577 - protein, 9 aa, Artificial Sequence
  Description of Artificial Sequence: Synthetic peptide
  Seed: YSFGVTCVK (EGFR A289V)
YQFGVTCVK

SEQ ID NO: 3578 - protein, 10 aa, Artificial Sequence
  Description of Artificial Sequence: Synthetic peptide
  Seed: YSFGVTCVKK (EGFR A289V)
YQFGVTCVKK

SEQ ID NO: 3579 - protein, 10 aa, Artificial Sequence
  Description of Artificial Sequence: Synthetic peptide
  Seed: YSFGVTCVKK (EGFR A289V)
YQFGVTCVKR

SEQ ID NO: 3580 - protein, 9 aa, Artificial Sequence
  Description of Artificial Sequence: Synthetic peptide
  Seed: YSFGVTCVK (EGFR A289V)
YQFGVTCVL

SEQ ID NO: 3581 - protein, 9 aa, Artificial Sequence
  Description of Artificial Sequence: Synthetic peptide
  Seed: YSFGVTCVK (EGFR A289V)
YQFGVTCVM

SEQ ID NO: 3582 - protein, 9 aa, Artificial Sequence
  Description of Artificial Sequence: Synthetic peptide
  Seed: YSFGVTCVK (EGFR A289V)
YQFGVTCVR

SEQ ID NO: 3583 - protein, 9 aa, Artificial Sequence
  Description of Artificial Sequence: Synthetic peptide
  Seed: YSFGVTCVK (EGFR A289V)
YQFGVTCVV

SEQ ID NO: 3584 - protein, 9 aa, Artificial Sequence
  Description of Artificial Sequence: Synthetic peptide
  Seed: YSFGVTCVK (EGFR A289V)
YQFGVTCVW

SEQ ID NO: 3585 - protein, 9 aa, Artificial Sequence
  Description of Artificial Sequence: Synthetic peptide
  Seed: YSFGVTCVK (EGFR A289V)
YQFGVTCVY

SEQ ID NO: 3586 - protein, 9 aa, Artificial Sequence
  Description of Artificial Sequence: Synthetic peptide
  Seed: YSFGVTCVK (EGFR A289V)
YRFGVTCVF

SEQ ID NO: 3587 - protein, 9 aa, Artificial Sequence
  Description of Artificial Sequence: Synthetic peptide
  Seed: YSFGVTCVK (EGFR A289V)
YRFGVTCVI

SEQ ID NO: 3588 - protein, 10 aa, Artificial Sequence
  Description of Artificial Sequence: Synthetic peptide
  Seed: YSFGVTCVKK (EGFR A289V)
YRFGVTCVKR

SEQ ID NO: 3589 - protein, 9 aa, Artificial Sequence
  Description of Artificial Sequence: Synthetic peptide
  Seed: YSFGVTCVK (EGFR A289V)
YRFGVTCVL

SEQ ID NO: 3590 - protein, 9 aa, Artificial Sequence
  Description of Artificial Sequence: Synthetic peptide
  Seed: YSFGVTCVK (EGFR A289V)
YRFGVTCVM

SEQ ID NO: 3591 - protein, 9 aa, Artificial Sequence
  Description of Artificial Sequence: Synthetic peptide
  Seed: YSFGVTCVK (EGFR A289V)
YRFGVTCVV

SEQ ID NO: 3592 - protein, 9 aa, Artificial Sequence
  Description of Artificial Sequence: Synthetic peptide
  Seed: YSFGVTCVK (EGFR A289V)
YRFGVTCVY

SEQ ID NO: 3593 - protein, 8 aa, Artificial Sequence
  Description of Artificial Sequence: Synthetic peptide
  Seed: YSFGVTCV (EGFR A289V)
YSFGVTCF

SEQ ID NO: 3594 - protein, 8 aa, Artificial Sequence
  Description of Artificial Sequence: Synthetic peptide
  Seed: YSFGVTCV (EGFR A289V)
YSFGVTCI

SEQ ID NO: 3595 - protein, 8 aa, Artificial Sequence
  Description of Artificial Sequence: Synthetic peptide
  Seed: YSFGVTCV (EGFR A289V)
YSFGVTCL

SEQ ID NO: 3596 - protein, 8 aa, Artificial Sequence
  Description of Artificial Sequence: Synthetic peptide
  Seed: YSFGVTCV (EGFR A289V)
YSFGVTCM

SEQ ID NO: 3597 - protein, 9 aa, Artificial Sequence
  Description of Artificial Sequence: Synthetic peptide
  Seed: YSFGVTCVK (EGFR A289V)
YSFGVTCVA

SEQ ID NO: 3598 - protein, 9 aa, Artificial Sequence
  Description of Artificial Sequence: Synthetic peptide
  Seed: YSFGVTCVK (EGFR A289V)
YSFGVTCVC

SEQ ID NO: 3599 - protein, 9 aa, Artificial Sequence
  Description of Artificial Sequence: Synthetic peptide
  Seed: YSFGVTCVK (EGFR A289V)
YSFGVTCVF

SEQ ID NO: 3600 - protein, 9 aa, Artificial Sequence
  Description of Artificial Sequence: Synthetic peptide
  Seed: YSFGVTCVK (EGFR A289V)
YSFGVTCVG

SEQ ID NO: 3601 - protein, 9 aa, Artificial Sequence
  Description of Artificial Sequence: Synthetic peptide
  Seed: YSFGVTCVK (EGFR A289V)
YSFGVTCVH

SEQ ID NO: 3602 - protein, 9 aa, Artificial Sequence
  Description of Artificial Sequence: Synthetic peptide
  Seed: YSFGVTCVK (EGFR A289V)
YSFGVTCVI

SEQ ID NO: 3603 - protein, 10 aa, Artificial Sequence
  Description of Artificial Sequence: Synthetic peptide
  Seed: YSFGVTCVKK (EGFR A289V)
YSFGVTCVKA

SEQ ID NO: 3604 - protein, 10 aa, Artificial Sequence
  Description of Artificial Sequence: Synthetic peptide
  Seed: YSFGVTCVKK (EGFR A289V)
YSFGVTCVKC

SEQ ID NO: 3605 - protein, 10 aa, Artificial Sequence
  Description of Artificial Sequence: Synthetic peptide
  Seed: YSFGVTCVKK (EGFR A289V)
YSFGVTCVKD

SEQ ID NO: 3606 - protein, 10 aa, Artificial Sequence
  Description of Artificial Sequence: Synthetic peptide
  Seed: YSFGVTCVKK (EGFR A289V)
YSFGVTCVKE

SEQ ID NO: 3607 - protein, 10 aa, Artificial Sequence
  Description of Artificial Sequence: Synthetic peptide
  Seed: YSFGVTCVKK (EGFR A289V)
YSFGVTCVKF

SEQ ID NO: 3608 - protein, 10 aa, Artificial Sequence
  Description of Artificial Sequence: Synthetic peptide
  Seed: YSFGVTCVKK (EGFR A289V)
YSFGVTCVKG

SEQ ID NO: 3609 - protein, 10 aa, Artificial Sequence
  Description of Artificial Sequence: Synthetic peptide
  Seed: YSFGVTCVKK (EGFR A289V)
YSFGVTCVKH

SEQ ID NO: 3610 - protein, 10 aa, Artificial Sequence
  Description of Artificial Sequence: Synthetic peptide
  Seed: YSFGVTCVKK (EGFR A289V)
YSFGVTCVKI

SEQ ID NO: 3611 - protein, 10 aa, Artificial Sequence
  Description of Artificial Sequence: Synthetic peptide
  Seed: YSFGVTCVKK (EGFR A289V)
YSFGVTCVKL

SEQ ID NO: 3612 - protein, 10 aa, Artificial Sequence
  Description of Artificial Sequence: Synthetic peptide
  Seed: YSFGVTCVKK (EGFR A289V)
YSFGVTCVKM

SEQ ID NO: 3613 - protein, 10 aa, Artificial Sequence
  Description of Artificial Sequence: Synthetic peptide
  Seed: YSFGVTCVKK (EGFR A289V)
YSFGVTCVKN

SEQ ID NO: 3614 - protein, 10 aa, Artificial Sequence
  Description of Artificial Sequence: Synthetic peptide
  Seed: YSFGVTCVKK (EGFR A289V)
YSFGVTCVKP

SEQ ID NO: 3615 - protein, 10 aa, Artificial Sequence
  Description of Artificial Sequence: Synthetic peptide
  Seed: YSFGVTCVKK (EGFR A289V)
YSFGVTCVKQ

SEQ ID NO: 3616 - protein, 10 aa, Artificial Sequence
  Description of Artificial Sequence: Synthetic peptide
  Seed: YSFGVTCVKK (EGFR A289V)
YSFGVTCVKR

SEQ ID NO: 3617 - protein, 10 aa, Artificial Sequence
  Description of Artificial Sequence: Synthetic peptide
  Seed: YSFGVTCVKK (EGFR A289V)
YSFGVTCVKS

SEQ ID NO: 3618 - protein, 10 aa, Artificial Sequence
  Description of Artificial Sequence: Synthetic peptide
  Seed: YSFGVTCVKK (EGFR A289V)
YSFGVTCVKT

SEQ ID NO: 3619 - protein, 10 aa, Artificial Sequence
  Description of Artificial Sequence: Synthetic peptide
  Seed: YSFGVTCVKK (EGFR A289V)
YSFGVTCVKV

SEQ ID NO: 3620 - protein, 10 aa, Artificial Sequence
  Description of Artificial Sequence: Synthetic peptide
  Seed: YSFGVTCVKK (EGFR A289V)
YSFGVTCVKW

SEQ ID NO: 3621 - protein, 10 aa, Artificial Sequence
  Description of Artificial Sequence: Synthetic peptide
  Seed: YSFGVTCVKK (EGFR A289V)
YSFGVTCVKY

SEQ ID NO: 3622 - protein, 9 aa, Artificial Sequence
  Description of Artificial Sequence: Synthetic peptide
  Seed: YSFGVTCVK (EGFR A289V)
YSFGVTCVL

SEQ ID NO: 3623 - protein, 9 aa, Artificial Sequence
  Description of Artificial Sequence: Synthetic peptide
  Seed: YSFGVTCVK (EGFR A289V)
YSFGVTCVR

SEQ ID NO: 3624 - protein, 9 aa, Artificial Sequence
  Description of Artificial Sequence: Synthetic peptide
  Seed: YSFGVTCVK (EGFR A289V)
YSFGVTCVS

SEQ ID NO: 3625 - protein, 9 aa, Artificial Sequence
  Description of Artificial Sequence: Synthetic peptide
  Seed: YSFGVTCVK (EGFR A289V)
YSFGVTCVT

SEQ ID NO: 3626 - protein, 9 aa, Artificial Sequence
  Description of Artificial Sequence: Synthetic peptide
  Seed: YSFGVTCVK (EGFR A289V)
YSFGVTCVV

SEQ ID NO: 3627 - protein, 9 aa, Artificial Sequence
  Description of Artificial Sequence: Synthetic peptide
  Seed: YSFGVTCVK (EGFR A289V)
YSFGVTCVW

SEQ ID NO: 3628 - protein, 9 aa, Artificial Sequence
  Description of Artificial Sequence: Synthetic peptide
  Seed: YSFGVTCVK (EGFR A289V)
YSFGVTCVY

SEQ ID NO: 3629 - protein, 8 aa, Artificial Sequence
  Description of Artificial Sequence: Synthetic peptide
  Seed: YSFGVTCV (EGFR A289V)
YSFGVTCY

SEQ ID NO: 3630 - protein, 8 aa, Artificial Sequence
  Description of Artificial Sequence: Synthetic peptide
  Seed: YSFGVTCV (EGFR A289V)
YTFGVTCF

SEQ ID NO: 3631 - protein, 8 aa, Artificial Sequence
  Description of Artificial Sequence: Synthetic peptide
  Seed: YSFGVTCV (EGFR A289V)
YTFGVTCI

SEQ ID NO: 3632 - protein, 8 aa, Artificial Sequence
  Description of Artificial Sequence: Synthetic peptide
  Seed: YSFGVTCV (EGFR A289V)
YTFGVTCL

SEQ ID NO: 3633 - protein, 8 aa, Artificial Sequence
  Description of Artificial Sequence: Synthetic peptide
  Seed: YSFGVTCV (EGFR A289V)
YTFGVTCM

SEQ ID NO: 3634 - protein, 8 aa, Artificial Sequence
  Description of Artificial Sequence: Synthetic peptide
  Seed: YSFGVTCV (EGFR A289V)
YTFGVTCV

SEQ ID NO: 3635 - protein, 9 aa, Artificial Sequence
  Description of Artificial Sequence: Synthetic peptide
  Seed: YSFGVTCVK (EGFR A289V)
YTFGVTCVA

SEQ ID NO: 3636 - protein, 9 aa, Artificial Sequence
  Description of Artificial Sequence: Synthetic peptide
  Seed: YSFGVTCVK (EGFR A289V)
YTFGVTCVC

SEQ ID NO: 3637 - protein, 9 aa, Artificial Sequence
  Description of Artificial Sequence: Synthetic peptide
  Seed: YSFGVTCVK (EGFR A289V)
YTFGVTCVF

SEQ ID NO: 3638 - protein, 9 aa, Artificial Sequence
  Description of Artificial Sequence: Synthetic peptide
  Seed: YSFGVTCVK (EGFR A289V)
YTFGVTCVH

SEQ ID NO: 3639 - protein, 9 aa, Artificial Sequence
  Description of Artificial Sequence: Synthetic peptide
  Seed: YSFGVTCVK (EGFR A289V)
YTFGVTCVI

SEQ ID NO: 3640 - protein, 10 aa, Artificial Sequence
  Description of Artificial Sequence: Synthetic peptide
  Seed: YSFGVTCVKK (EGFR A289V)
YTFGVTCVKA

SEQ ID NO: 3641 - protein, 10 aa, Artificial Sequence
  Description of Artificial Sequence: Synthetic peptide
  Seed: YSFGVTCVKK (EGFR A289V)
YTFGVTCVKC

SEQ ID NO: 3642 - protein, 10 aa, Artificial Sequence
  Description of Artificial Sequence: Synthetic peptide
  Seed: YSFGVTCVKK (EGFR A289V)
YTFGVTCVKD

SEQ ID NO: 3643 - protein, 10 aa, Artificial Sequence
  Description of Artificial Sequence: Synthetic peptide
  Seed: YSFGVTCVKK (EGFR A289V)
YTFGVTCVKE

SEQ ID NO: 3644 - protein, 10 aa, Artificial Sequence
  Description of Artificial Sequence: Synthetic peptide
  Seed: YSFGVTCVKK (EGFR A289V)
YTFGVTCVKF

SEQ ID NO: 3645 - protein, 10 aa, Artificial Sequence
  Description of Artificial Sequence: Synthetic peptide
  Seed: YSFGVTCVKK (EGFR A289V)
YTFGVTCVKG

SEQ ID NO: 3646 - protein, 10 aa, Artificial Sequence
  Description of Artificial Sequence: Synthetic peptide
  Seed: YSFGVTCVKK (EGFR A289V)
YTFGVTCVKH

SEQ ID NO: 3647 - protein, 10 aa, Artificial Sequence
  Description of Artificial Sequence: Synthetic peptide
  Seed: YSFGVTCVKK (EGFR A289V)
YTFGVTCVKI

SEQ ID NO: 3648 - protein, 10 aa, Artificial Sequence
  Description of Artificial Sequence: Synthetic peptide
  Seed: YSFGVTCVKK (EGFR A289V)
YTFGVTCVKK

SEQ ID NO: 3649 - protein, 10 aa, Artificial Sequence
  Description of Artificial Sequence: Synthetic peptide
  Seed: YSFGVTCVKK (EGFR A289V)
YTFGVTCVKL

SEQ ID NO: 3650 - protein, 10 aa, Artificial Sequence
  Description of Artificial Sequence: Synthetic peptide
  Seed: YSFGVTCVKK (EGFR A289V)
YTFGVTCVKM

SEQ ID NO: 3651 - protein, 10 aa, Artificial Sequence
  Description of Artificial Sequence: Synthetic peptide
  Seed: YSFGVTCVKK (EGFR A289V)
YTFGVTCVKN

SEQ ID NO: 3652 - protein, 10 aa, Artificial Sequence
  Description of Artificial Sequence: Synthetic peptide
  Seed: YSFGVTCVKK (EGFR A289V)
YTFGVTCVKP

SEQ ID NO: 3653 - protein, 10 aa, Artificial Sequence
  Description of Artificial Sequence: Synthetic peptide
  Seed: YSFGVTCVKK (EGFR A289V)
YTFGVTCVKQ

SEQ ID NO: 3654 - protein, 10 aa, Artificial Sequence
  Description of Artificial Sequence: Synthetic peptide
  Seed: YSFGVTCVKK (EGFR A289V)
YTFGVTCVKR

SEQ ID NO: 3655 - protein, 10 aa, Artificial Sequence
  Description of Artificial Sequence: Synthetic peptide
  Seed: YSFGVTCVKK (EGFR A289V)
YTFGVTCVKS

SEQ ID NO: 3656 - protein, 10 aa, Artificial Sequence
  Description of Artificial Sequence: Synthetic peptide
  Seed: YSFGVTCVKK (EGFR A289V)
YTFGVTCVKT

SEQ ID NO: 3657 - protein, 10 aa, Artificial Sequence
  Description of Artificial Sequence: Synthetic peptide
  Seed: YSFGVTCVKK (EGFR A289V)
YTFGVTCVKV

SEQ ID NO: 3658 - protein, 10 aa, Artificial Sequence
  Description of Artificial Sequence: Synthetic peptide
  Seed: YSFGVTCVKK (EGFR A289V)
YTFGVTCVKW

SEQ ID NO: 3659 - protein, 10 aa, Artificial Sequence
  Description of Artificial Sequence: Synthetic peptide
  Seed: YSFGVTCVKK (EGFR A289V)
YTFGVTCVKY

SEQ ID NO: 3660 - protein, 9 aa, Artificial Sequence
  Description of Artificial Sequence: Synthetic peptide
  Seed: YSFGVTCVK (EGFR A289V)
YTFGVTCVL

SEQ ID NO: 3661 - protein, 9 aa, Artificial Sequence
  Description of Artificial Sequence: Synthetic peptide
  Seed: YSFGVTCVK (EGFR A289V)
YTFGVTCVQ

SEQ ID NO: 3662 - protein, 9 aa, Artificial Sequence
  Description of Artificial Sequence: Synthetic peptide
  Seed: YSFGVTCVK (EGFR A289V)
YTFGVTCVS

SEQ ID NO: 3663 - protein, 9 aa, Artificial Sequence
  Description of Artificial Sequence: Synthetic peptide
  Seed: YSFGVTCVK (EGFR A289V)
YTFGVTCVT

SEQ ID NO: 3664 - protein, 9 aa, Artificial Sequence
  Description of Artificial Sequence: Synthetic peptide
  Seed: YSFGVTCVK (EGFR A289V)
YTFGVTCVV

SEQ ID NO: 3665 - protein, 9 aa, Artificial Sequence
  Description of Artificial Sequence: Synthetic peptide
  Seed: YSFGVTCVK (EGFR A289V)
YTFGVTCVW

SEQ ID NO: 3666 - protein, 8 aa, Artificial Sequence
  Description of Artificial Sequence: Synthetic peptide
  Seed: YSFGVTCV (EGFR A289V)
YTFGVTCY

SEQ ID NO: 3667 - protein, 9 aa, Artificial Sequence
  Description of Artificial Sequence: Synthetic peptide
  Seed: YSFGVTCVK (EGFR A289V)
YVFGVTCVA

SEQ ID NO: 3668 - protein, 9 aa, Artificial Sequence
  Description of Artificial Sequence: Synthetic peptide
  Seed: YSFGVTCVK (EGFR A289V)
YVFGVTCVF

SEQ ID NO: 3669 - protein, 9 aa, Artificial Sequence
  Description of Artificial Sequence: Synthetic peptide
  Seed: YSFGVTCVK (EGFR A289V)
YVFGVTCVH

SEQ ID NO: 3670 - protein, 9 aa, Artificial Sequence
  Description of Artificial Sequence: Synthetic peptide
  Seed: YSFGVTCVK (EGFR A289V)
YVFGVTCVI

SEQ ID NO: 3671 - protein, 9 aa, Artificial Sequence
  Description of Artificial Sequence: Synthetic peptide
  Seed: YSFGVTCVK (EGFR A289V)
YVFGVTCVK

SEQ ID NO: 3672 - protein, 10 aa, Artificial Sequence
  Description of Artificial Sequence: Synthetic peptide
  Seed: YSFGVTCVKK (EGFR A289V)
YVFGVTCVKA

SEQ ID NO: 3673 - protein, 10 aa, Artificial Sequence
  Description of Artificial Sequence: Synthetic peptide
  Seed: YSFGVTCVKK (EGFR A289V)
YVFGVTCVKC

SEQ ID NO: 3674 - protein, 10 aa, Artificial Sequence
  Description of Artificial Sequence: Synthetic peptide
  Seed: YSFGVTCVKK (EGFR A289V)
YVFGVTCVKD

SEQ ID NO: 3675 - protein, 10 aa, Artificial Sequence
  Description of Artificial Sequence: Synthetic peptide
  Seed: YSFGVTCVKK (EGFR A289V)
YVFGVTCVKE

SEQ ID NO: 3676 - protein, 10 aa, Artificial Sequence
  Description of Artificial Sequence: Synthetic peptide
  Seed: YSFGVTCVKK (EGFR A289V)
YVFGVTCVKF

SEQ ID NO: 3677 - protein, 10 aa, Artificial Sequence
  Description of Artificial Sequence: Synthetic peptide
  Seed: YSFGVTCVKK (EGFR A289V)
YVFGVTCVKG

SEQ ID NO: 3678 - protein, 10 aa, Artificial Sequence
  Description of Artificial Sequence: Synthetic peptide
  Seed: YSFGVTCVKK (EGFR A289V)
YVFGVTCVKH

SEQ ID NO: 3679 - protein, 10 aa, Artificial Sequence
  Description of Artificial Sequence: Synthetic peptide
  Seed: YSFGVTCVKK (EGFR A289V)
YVFGVTCVKI

SEQ ID NO: 3680 - protein, 10 aa, Artificial Sequence
  Description of Artificial Sequence: Synthetic peptide
  Seed: YSFGVTCVKK (EGFR A289V)
YVFGVTCVKK

SEQ ID NO: 3681 - protein, 10 aa, Artificial Sequence
  Description of Artificial Sequence: Synthetic peptide
  Seed: YSFGVTCVKK (EGFR A289V)
YVFGVTCVKL

SEQ ID NO: 3682 - protein, 10 aa, Artificial Sequence
  Description of Artificial Sequence: Synthetic peptide
  Seed: YSFGVTCVKK (EGFR A289V)
YVFGVTCVKM

SEQ ID NO: 3683 - protein, 10 aa, Artificial Sequence
  Description of Artificial Sequence: Synthetic peptide
  Seed: YSFGVTCVKK (EGFR A289V)
YVFGVTCVKN

SEQ ID NO: 3684 - protein, 10 aa, Artificial Sequence
  Description of Artificial Sequence: Synthetic peptide
  Seed: YSFGVTCVKK (EGFR A289V)
YVFGVTCVKP

SEQ ID NO: 3685 - protein, 10 aa, Artificial Sequence
  Description of Artificial Sequence: Synthetic peptide
  Seed: YSFGVTCVKK (EGFR A289V)
YVFGVTCVKQ

SEQ ID NO: 3686 - protein, 10 aa, Artificial Sequence
  Description of Artificial Sequence: Synthetic peptide
  Seed: YSFGVTCVKK (EGFR A289V)
YVFGVTCVKR

SEQ ID NO: 3687 - protein, 10 aa, Artificial Sequence
  Description of Artificial Sequence: Synthetic peptide
  Seed: YSFGVTCVKK (EGFR A289V)
YVFGVTCVKS

SEQ ID NO: 3688 - protein, 10 aa, Artificial Sequence
  Description of Artificial Sequence: Synthetic peptide
  Seed: YSFGVTCVKK (EGFR A289V)
YVFGVTCVKT

SEQ ID NO: 3689 - protein, 10 aa, Artificial Sequence
  Description of Artificial Sequence: Synthetic peptide
  Seed: YSFGVTCVKK (EGFR A289V)
YVFGVTCVKV

SEQ ID NO: 3690 - protein, 10 aa, Artificial Sequence
  Description of Artificial Sequence: Synthetic peptide
  Seed: YSFGVTCVKK (EGFR A289V)
YVFGVTCVKW

SEQ ID NO: 3691 - protein, 10 aa, Artificial Sequence
  Description of Artificial Sequence: Synthetic peptide
  Seed: YSFGVTCVKK (EGFR A289V)
YVFGVTCVKY

SEQ ID NO: 3692 - protein, 9 aa, Artificial Sequence
  Description of Artificial Sequence: Synthetic peptide
  Seed: YSFGVTCVK (EGFR A289V)
YVFGVTCVL

SEQ ID NO: 3693 - protein, 9 aa, Artificial Sequence
  Description of Artificial Sequence: Synthetic peptide
  Seed: YSFGVTCVK (EGFR A289V)
YVFGVTCVT

SEQ ID NO: 3694 - protein, 9 aa, Artificial Sequence
  Description of Artificial Sequence: Synthetic peptide
  Seed: YSFGVTCVK (EGFR A289V)
YVFGVTCVV

SEQ ID NO: 3695 - protein, 9 aa, Artificial Sequence
  Description of Artificial Sequence: Synthetic peptide
  Seed: YSFGVTCVK (EGFR A289V)
YVFGVTCVW

SEQ ID NO: 3696 - protein, 9 aa, Artificial Sequence
  Description of Artificial Sequence: Synthetic peptide
  Seed: YSFGVTCVK (EGFR A289V)
YVFGVTCVY

SEQ ID NO: 3697 - protein, 9 aa, Artificial Sequence
  Description of Artificial Sequence: Synthetic peptide
  Seed: YSFGVTCVK (EGFR A289V)
YWFGVTCVK

SEQ ID NO: 3698 - protein, 10 aa, Artificial Sequence
  Description of Artificial Sequence: Synthetic peptide
  Seed: YSFGVTCVKK (EGFR A289V)
YWFGVTCVKK

SEQ ID NO: 3699 - protein, 10 aa, Artificial Sequence
  Description of Artificial Sequence: Synthetic peptide
  Seed: YSFGVTCVKK (EGFR A289V)
YWFGVTCVKR

SEQ ID NO: 3700 - protein, 9 aa, Artificial Sequence
  Description of Artificial Sequence: Synthetic peptide
  Seed: YSFGVTCVK (EGFR A289V)
YWFGVTCVL

SEQ ID NO: 3701 - protein, 9 aa, Artificial Sequence
  Description of Artificial Sequence: Synthetic peptide
  Seed: YSFGVTCVK (EGFR A289V)
YWFGVTCVM

SEQ ID NO: 3702 - protein, 9 aa, Artificial Sequence
  Description of Artificial Sequence: Synthetic peptide
  Seed: YSFGVTCVK (EGFR A289V)
YWFGVTCVR

SEQ ID NO: 3703 - protein, 9 aa, Artificial Sequence
  Description of Artificial Sequence: Synthetic peptide
  Seed: YSFGVTCVK (EGFR A289V)
YYFGVTCVA

SEQ ID NO: 3704 - protein, 9 aa, Artificial Sequence
  Description of Artificial Sequence: Synthetic peptide
  Seed: YSFGVTCVK (EGFR A289V)
YYFGVTCVF

SEQ ID NO: 3705 - protein, 9 aa, Artificial Sequence
  Description of Artificial Sequence: Synthetic peptide
  Seed: YSFGVTCVK (EGFR A289V)
YYFGVTCVI

SEQ ID NO: 3706 - protein, 9 aa, Artificial Sequence
  Description of Artificial Sequence: Synthetic peptide
  Seed: YSFGVTCVK (EGFR A289V)
YYFGVTCVK

SEQ ID NO: 3707 - protein, 10 aa, Artificial Sequence
  Description of Artificial Sequence: Synthetic peptide
  Seed: YSFGVTCVKK (EGFR A289V)
YYFGVTCVKK

SEQ ID NO: 3708 - protein, 10 aa, Artificial Sequence
  Description of Artificial Sequence: Synthetic peptide
  Seed: YSFGVTCVKK (EGFR A289V)
YYFGVTCVKR

SEQ ID NO: 3709 - protein, 9 aa, Artificial Sequence
  Description of Artificial Sequence: Synthetic peptide
  Seed: YSFGVTCVK (EGFR A289V)
YYFGVTCVL

SEQ ID NO: 3710 - protein, 9 aa, Artificial Sequence
  Description of Artificial Sequence: Synthetic peptide
  Seed: YSFGVTCVK (EGFR A289V)
YYFGVTCVM

SEQ ID NO: 3711 - protein, 9 aa, Artificial Sequence
  Description of Artificial Sequence: Synthetic peptide
  Seed: YSFGVTCVK (EGFR A289V)
YYFGVTCVR

SEQ ID NO: 3712 - protein, 9 aa, Artificial Sequence
  Description of Artificial Sequence: Synthetic peptide
  Seed: YSFGVTCVK (EGFR A289V)
YYFGVTCVV

SEQ ID NO: 3713 - protein, 9 aa, Artificial Sequence
  Description of Artificial Sequence: Synthetic peptide
  Seed: YSFGVTCVK (EGFR A289V)
YYFGVTCVY

SEQ ID NO: 3714 - protein, 8 aa, Artificial Sequence
  Description of Artificial Sequence: Synthetic peptide
  Seed: FGVTCVKK (EGFR A289V)
FAVTCVKF

SEQ ID NO: 3715 - protein, 8 aa, Artificial Sequence
  Description of Artificial Sequence: Synthetic peptide
  Seed: FGVTCVKK (EGFR A289V)
FAVTCVKI

SEQ ID NO: 3716 - protein, 8 aa, Artificial Sequence
  Description of Artificial Sequence: Synthetic peptide
  Seed: FGVTCVKK (EGFR A289V)
FAVTCVKK

SEQ ID NO: 3717 - protein, 8 aa, Artificial Sequence
  Description of Artificial Sequence: Synthetic peptide
  Seed: FGVTCVKK (EGFR A289V)
FAVTCVKL

SEQ ID NO: 3718 - protein, 8 aa, Artificial Sequence
  Description of Artificial Sequence: Synthetic peptide
  Seed: FGVTCVKK (EGFR A289V)
FAVTCVKM

SEQ ID NO: 3719 - protein, 8 aa, Artificial Sequence
  Description of Artificial Sequence: Synthetic peptide
  Seed: FGVTCVKK (EGFR A289V)
FAVTCVKR

SEQ ID NO: 3720 - protein, 8 aa, Artificial Sequence
  Description of Artificial Sequence: Synthetic peptide
  Seed: FGVTCVKK (EGFR A289V)
FAVTCVKV

SEQ ID NO: 3721 - protein, 8 aa, Artificial Sequence
  Description of Artificial Sequence: Synthetic peptide
  Seed: FGVTCVKK (EGFR A289V)
FAVTCVKY

SEQ ID NO: 3722 - protein, 8 aa, Artificial Sequence
  Description of Artificial Sequence: Synthetic peptide
  Seed: FGVTCVKK (EGFR A289V)
FDVTCVKK

SEQ ID NO: 3723 - protein, 8 aa, Artificial Sequence
  Description of Artificial Sequence: Synthetic peptide
  Seed: FGVTCVKK (EGFR A289V)
FGVTCVKL

SEQ ID NO: 3724 - protein, 8 aa, Artificial Sequence
  Description of Artificial Sequence: Synthetic peptide
  Seed: FGVTCVKK (EGFR A289V)
FGVTCVKR

SEQ ID NO: 3725 - protein, 8 aa, Artificial Sequence
  Description of Artificial Sequence: Synthetic peptide
  Seed: FGVTCVKK (EGFR A289V)
FIVTCVKK

SEQ ID NO: 3726 - protein, 8 aa, Artificial Sequence
  Description of Artificial Sequence: Synthetic peptide
  Seed: FGVTCVKK (EGFR A289V)
FIVTCVKL

SEQ ID NO: 3727 - protein, 8 aa, Artificial Sequence
  Description of Artificial Sequence: Synthetic peptide
  Seed: FGVTCVKK (EGFR A289V)
FNVTCVKK

SEQ ID NO: 3728 - protein, 8 aa, Artificial Sequence
  Description of Artificial Sequence: Synthetic peptide
  Seed: FGVTCVKK (EGFR A289V)
FQVTCVKK

SEQ ID NO: 3729 - protein, 8 aa, Artificial Sequence
  Description of Artificial Sequence: Synthetic peptide
  Seed: FGVTCVKK (EGFR A289V)
FSVTCVKF

SEQ ID NO: 3730 - protein, 8 aa, Artificial Sequence
  Description of Artificial Sequence: Synthetic peptide
  Seed: FGVTCVKK (EGFR A289V)
FSVTCVKI

SEQ ID NO: 3731 - protein, 8 aa, Artificial Sequence
  Description of Artificial Sequence: Synthetic peptide
  Seed: FGVTCVKK (EGFR A289V)
FSVTCVKK

SEQ ID NO: 3732 - protein, 8 aa, Artificial Sequence
  Description of Artificial Sequence: Synthetic peptide
  Seed: FGVTCVKK (EGFR A289V)
FSVTCVKL

SEQ ID NO: 3733 - protein, 8 aa, Artificial Sequence
  Description of Artificial Sequence: Synthetic peptide
  Seed: FGVTCVKK (EGFR A289V)
FSVTCVKM

SEQ ID NO: 3734 - protein, 8 aa, Artificial Sequence
  Description of Artificial Sequence: Synthetic peptide
  Seed: FGVTCVKK (EGFR A289V)
FTVTCVKL

SEQ ID NO: 3735 - protein, 8 aa, Artificial Sequence
  Description of Artificial Sequence: Synthetic peptide
  Seed: FGVTCVKK (EGFR A289V)
FTVTCVKM

SEQ ID NO: 3736 - protein, 8 aa, Artificial Sequence
  Description of Artificial Sequence: Synthetic peptide
  Seed: FGVTCVKK (EGFR A289V)
FVVTCVKK

SEQ ID NO: 3737 - protein, 8 aa, Artificial Sequence
  Description of Artificial Sequence: Synthetic peptide
  Seed: FGVTCVKK (EGFR A289V)
FVVTCVKL

SEQ ID NO: 3738 - protein, 9 aa, Artificial Sequence
  Description of Artificial Sequence: Synthetic peptide
  Seed: GKYSFGVTC (EGFR A289V)
GAYSFGVTA

SEQ ID NO: 3739 - protein, 9 aa, Artificial Sequence
  Description of Artificial Sequence: Synthetic peptide
  Seed: GKYSFGVTC (EGFR A289V)
GAYSFGVTF

SEQ ID NO: 3740 - protein, 9 aa, Artificial Sequence
  Description of Artificial Sequence: Synthetic peptide
  Seed: GKYSFGVTC (EGFR A289V)
GAYSFGVTH

SEQ ID NO: 3741 - protein, 9 aa, Artificial Sequence
  Description of Artificial Sequence: Synthetic peptide
  Seed: GKYSFGVTC (EGFR A289V)
GAYSFGVTI

SEQ ID NO: 3742 - protein, 9 aa, Artificial Sequence
  Description of Artificial Sequence: Synthetic peptide
  Seed: GKYSFGVTC (EGFR A289V)
GAYSFGVTL

SEQ ID NO: 3743 - protein, 9 aa, Artificial Sequence
  Description of Artificial Sequence: Synthetic peptide
  Seed: GKYSFGVTC (EGFR A289V)
GAYSFGVTM

SEQ ID NO: 3744 - protein, 9 aa, Artificial Sequence
  Description of Artificial Sequence: Synthetic peptide
  Seed: GKYSFGVTC (EGFR A289V)
GAYSFGVTV

SEQ ID NO: 3745 - protein, 9 aa, Artificial Sequence
  Description of Artificial Sequence: Synthetic peptide
  Seed: GKYSFGVTC (EGFR A289V)
GAYSFGVTW

SEQ ID NO: 3746 - protein, 9 aa, Artificial Sequence
  Description of Artificial Sequence: Synthetic peptide
  Seed: GKYSFGVTC (EGFR A289V)
GAYSFGVTY

SEQ ID NO: 3747 - protein, 9 aa, Artificial Sequence
  Description of Artificial Sequence: Synthetic peptide
  Seed: GKYSFGVTC (EGFR A289V)
GCYSFGVTF

SEQ ID NO: 3748 - protein, 9 aa, Artificial Sequence
  Description of Artificial Sequence: Synthetic peptide
  Seed: GKYSFGVTC (EGFR A289V)
GCYSFGVTY

SEQ ID NO: 3749 - protein, 9 aa, Artificial Sequence
  Description of Artificial Sequence: Synthetic peptide
  Seed: GKYSFGVTC (EGFR A289V)
GDYSFGVTA

SEQ ID NO: 3750 - protein, 9 aa, Artificial Sequence
  Description of Artificial Sequence: Synthetic peptide
  Seed: GKYSFGVTC (EGFR A289V)
GDYSFGVTF

SEQ ID NO: 3751 - protein, 9 aa, Artificial Sequence
  Description of Artificial Sequence: Synthetic peptide
  Seed: GKYSFGVTC (EGFR A289V)
GDYSFGVTL

SEQ ID NO: 3752 - protein, 9 aa, Artificial Sequence
  Description of Artificial Sequence: Synthetic peptide
  Seed: GKYSFGVTC (EGFR A289V)
GDYSFGVTM

SEQ ID NO: 3753 - protein, 9 aa, Artificial Sequence
  Description of Artificial Sequence: Synthetic peptide
  Seed: GKYSFGVTC (EGFR A289V)
GDYSFGVTY

SEQ ID NO: 3754 - protein, 9 aa, Artificial Sequence
  Description of Artificial Sequence: Synthetic peptide
  Seed: GKYSFGVTC (EGFR A289V)
GEYSFGVTA

SEQ ID NO: 3755 - protein, 9 aa, Artificial Sequence
  Description of Artificial Sequence: Synthetic peptide
  Seed: GKYSFGVTC (EGFR A289V)
GEYSFGVTC

SEQ ID NO: 3756 - protein, 9 aa, Artificial Sequence
  Description of Artificial Sequence: Synthetic peptide
  Seed: GKYSFGVTC (EGFR A289V)
GEYSFGVTF

SEQ ID NO: 3757 - protein, 9 aa, Artificial Sequence
  Description of Artificial Sequence: Synthetic peptide
  Seed: GKYSFGVTC (EGFR A289V)
GEYSFGVTH

SEQ ID NO: 3758 - protein, 9 aa, Artificial Sequence
  Description of Artificial Sequence: Synthetic peptide
  Seed: GKYSFGVTC (EGFR A289V)
GEYSFGVTI

SEQ ID NO: 3759 - protein, 9 aa, Artificial Sequence
  Description of Artificial Sequence: Synthetic peptide
  Seed: GKYSFGVTC (EGFR A289V)
GEYSFGVTK

SEQ ID NO: 3760 - protein, 9 aa, Artificial Sequence
  Description of Artificial Sequence: Synthetic peptide
  Seed: GKYSFGVTC (EGFR A289V)
GEYSFGVTL

SEQ ID NO: 3761 - protein, 9 aa, Artificial Sequence
  Description of Artificial Sequence: Synthetic peptide
  Seed: GKYSFGVTC (EGFR A289V)
GEYSFGVTM

SEQ ID NO: 3762 - protein, 9 aa, Artificial Sequence
  Description of Artificial Sequence: Synthetic peptide
  Seed: GKYSFGVTC (EGFR A289V)
GEYSFGVTR

SEQ ID NO: 3763 - protein, 9 aa, Artificial Sequence
  Description of Artificial Sequence: Synthetic peptide
  Seed: GKYSFGVTC (EGFR A289V)
GEYSFGVTV

SEQ ID NO: 3764 - protein, 9 aa, Artificial Sequence
  Description of Artificial Sequence: Synthetic peptide
  Seed: GKYSFGVTC (EGFR A289V)
GEYSFGVTW

SEQ ID NO: 3765 - protein, 9 aa, Artificial Sequence
  Description of Artificial Sequence: Synthetic peptide
  Seed: GKYSFGVTC (EGFR A289V)
GEYSFGVTY

SEQ ID NO: 3766 - protein, 9 aa, Artificial Sequence
  Description of Artificial Sequence: Synthetic peptide
  Seed: GKYSFGVTC (EGFR A289V)
GFYSFGVTF

SEQ ID NO: 3767 - protein, 9 aa, Artificial Sequence
  Description of Artificial Sequence: Synthetic peptide
  Seed: GKYSFGVTC (EGFR A289V)
GFYSFGVTY

SEQ ID NO: 3768 - protein, 9 aa, Artificial Sequence
  Description of Artificial Sequence: Synthetic peptide
  Seed: GKYSFGVTC (EGFR A289V)
GGYSFGVTA

SEQ ID NO: 3769 - protein, 9 aa, Artificial Sequence
  Description of Artificial Sequence: Synthetic peptide
  Seed: GKYSFGVTC (EGFR A289V)
GGYSFGVTF

SEQ ID NO: 3770 - protein, 9 aa, Artificial Sequence
  Description of Artificial Sequence: Synthetic peptide
  Seed: GKYSFGVTC (EGFR A289V)
GGYSFGVTL

SEQ ID NO: 3771 - protein, 9 aa, Artificial Sequence
  Description of Artificial Sequence: Synthetic peptide
  Seed: GKYSFGVTC (EGFR A289V)
GGYSFGVTM

SEQ ID NO: 3772 - protein, 9 aa, Artificial Sequence
  Description of Artificial Sequence: Synthetic peptide
  Seed: GKYSFGVTC (EGFR A289V)
GGYSFGVTY

SEQ ID NO: 3773 - protein, 9 aa, Artificial Sequence
  Description of Artificial Sequence: Synthetic peptide
  Seed: GKYSFGVTC (EGFR A289V)
GHYSFGVTA

SEQ ID NO: 3774 - protein, 9 aa, Artificial Sequence
  Description of Artificial Sequence: Synthetic peptide
  Seed: GKYSFGVTC (EGFR A289V)
GHYSFGVTC

SEQ ID NO: 3775 - protein, 9 aa, Artificial Sequence
  Description of Artificial Sequence: Synthetic peptide
  Seed: GKYSFGVTC (EGFR A289V)
GHYSFGVTF

SEQ ID NO: 3776 - protein, 9 aa, Artificial Sequence
  Description of Artificial Sequence: Synthetic peptide
  Seed: GKYSFGVTC (EGFR A289V)
GHYSFGVTG

SEQ ID NO: 3777 - protein, 9 aa, Artificial Sequence
  Description of Artificial Sequence: Synthetic peptide
  Seed: GKYSFGVTC (EGFR A289V)
GHYSFGVTH

SEQ ID NO: 3778 - protein, 9 aa, Artificial Sequence
  Description of Artificial Sequence: Synthetic peptide
  Seed: GKYSFGVTC (EGFR A289V)
GHYSFGVTI

SEQ ID NO: 3779 - protein, 9 aa, Artificial Sequence
  Description of Artificial Sequence: Synthetic peptide
  Seed: GKYSFGVTC (EGFR A289V)
GHYSFGVTL

SEQ ID NO: 3780 - protein, 9 aa, Artificial Sequence
  Description of Artificial Sequence: Synthetic peptide
  Seed: GKYSFGVTC (EGFR A289V)
GHYSFGVTM

SEQ ID NO: 3781 - protein, 9 aa, Artificial Sequence
  Description of Artificial Sequence: Synthetic peptide
  Seed: GKYSFGVTC (EGFR A289V)
GHYSFGVTP

SEQ ID NO: 3782 - protein, 9 aa, Artificial Sequence
  Description of Artificial Sequence: Synthetic peptide
  Seed: GKYSFGVTC (EGFR A289V)
GHYSFGVTS

SEQ ID NO: 3783 - protein, 9 aa, Artificial Sequence
  Description of Artificial Sequence: Synthetic peptide
  Seed: GKYSFGVTC (EGFR A289V)
GHYSFGVTT

SEQ ID NO: 3784 - protein, 9 aa, Artificial Sequence
  Description of Artificial Sequence: Synthetic peptide
  Seed: GKYSFGVTC (EGFR A289V)
GHYSFGVTV

SEQ ID NO: 3785 - protein, 9 aa, Artificial Sequence
  Description of Artificial Sequence: Synthetic peptide
  Seed: GKYSFGVTC (EGFR A289V)
GHYSFGVTW

SEQ ID NO: 3786 - protein, 9 aa, Artificial Sequence
  Description of Artificial Sequence: Synthetic peptide
  Seed: GKYSFGVTC (EGFR A289V)
GHYSFGVTY

SEQ ID NO: 3787 - protein, 9 aa, Artificial Sequence
  Description of Artificial Sequence: Synthetic peptide
  Seed: GKYSFGVTC (EGFR A289V)
GIYSFGVTF

SEQ ID NO: 3788 - protein, 9 aa, Artificial Sequence
  Description of Artificial Sequence: Synthetic peptide
  Seed: GKYSFGVTC (EGFR A289V)
GIYSFGVTL

SEQ ID NO: 3789 - protein, 9 aa, Artificial Sequence
  Description of Artificial Sequence: Synthetic peptide
  Seed: GKYSFGVTC (EGFR A289V)
GIYSFGVTM

SEQ ID NO: 3790 - protein, 9 aa, Artificial Sequence
  Description of Artificial Sequence: Synthetic peptide
  Seed: GKYSFGVTC (EGFR A289V)
GIYSFGVTY

SEQ ID NO: 3791 - protein, 9 aa, Artificial Sequence
  Description of Artificial Sequence: Synthetic peptide
  Seed: GKYSFGVTC (EGFR A289V)
GKYSFGVTA

SEQ ID NO: 3792 - protein, 9 aa, Artificial Sequence
  Description of Artificial Sequence: Synthetic peptide
  Seed: GKYSFGVTC (EGFR A289V)
GKYSFGVTF

SEQ ID NO: 3793 - protein, 9 aa, Artificial Sequence
  Description of Artificial Sequence: Synthetic peptide
  Seed: GKYSFGVTC (EGFR A289V)
GKYSFGVTH

SEQ ID NO: 3794 - protein, 9 aa, Artificial Sequence
  Description of Artificial Sequence: Synthetic peptide
  Seed: GKYSFGVTC (EGFR A289V)
GKYSFGVTI

SEQ ID NO: 3795 - protein, 9 aa, Artificial Sequence
  Description of Artificial Sequence: Synthetic peptide
  Seed: GKYSFGVTC (EGFR A289V)
GKYSFGVTL

SEQ ID NO: 3796 - protein, 9 aa, Artificial Sequence
  Description of Artificial Sequence: Synthetic peptide
  Seed: GKYSFGVTC (EGFR A289V)
GKYSFGVTM

SEQ ID NO: 3797 - protein, 9 aa, Artificial Sequence
  Description of Artificial Sequence: Synthetic peptide
  Seed: GKYSFGVTC (EGFR A289V)
GKYSFGVTV

SEQ ID NO: 3798 - protein, 9 aa, Artificial Sequence
  Description of Artificial Sequence: Synthetic peptide
  Seed: GKYSFGVTC (EGFR A289V)
GKYSFGVTW

SEQ ID NO: 3799 - protein, 9 aa, Artificial Sequence
  Description of Artificial Sequence: Synthetic peptide
  Seed: GKYSFGVTC (EGFR A289V)
GKYSFGVTY

SEQ ID NO: 3800 - protein, 9 aa, Artificial Sequence
  Description of Artificial Sequence: Synthetic peptide
  Seed: GKYSFGVTC (EGFR A289V)
GLYSFGVTF

SEQ ID NO: 3801 - protein, 9 aa, Artificial Sequence
  Description of Artificial Sequence: Synthetic peptide
  Seed: GKYSFGVTC (EGFR A289V)
GLYSFGVTL

SEQ ID NO: 3802 - protein, 9 aa, Artificial Sequence
  Description of Artificial Sequence: Synthetic peptide
  Seed: GKYSFGVTC (EGFR A289V)
GLYSFGVTM

SEQ ID NO: 3803 - protein, 9 aa, Artificial Sequence
  Description of Artificial Sequence: Synthetic peptide
  Seed: GKYSFGVTC (EGFR A289V)
GLYSFGVTW

SEQ ID NO: 3804 - protein, 9 aa, Artificial Sequence
  Description of Artificial Sequence: Synthetic peptide
  Seed: GKYSFGVTC (EGFR A289V)
GLYSFGVTY

SEQ ID NO: 3805 - protein, 9 aa, Artificial Sequence
  Description of Artificial Sequence: Synthetic peptide
  Seed: GKYSFGVTC (EGFR A289V)
GMYSFGVTF

SEQ ID NO: 3806 - protein, 9 aa, Artificial Sequence
  Description of Artificial Sequence: Synthetic peptide
  Seed: GKYSFGVTC (EGFR A289V)
GMYSFGVTH

SEQ ID NO: 3807 - protein, 9 aa, Artificial Sequence
  Description of Artificial Sequence: Synthetic peptide
  Seed: GKYSFGVTC (EGFR A289V)
GMYSFGVTI

SEQ ID NO: 3808 - protein, 9 aa, Artificial Sequence
  Description of Artificial Sequence: Synthetic peptide
  Seed: GKYSFGVTC (EGFR A289V)
GMYSFGVTL

SEQ ID NO: 3809 - protein, 9 aa, Artificial Sequence
  Description of Artificial Sequence: Synthetic peptide
  Seed: GKYSFGVTC (EGFR A289V)
GMYSFGVTM

SEQ ID NO: 3810 - protein, 9 aa, Artificial Sequence
  Description of Artificial Sequence: Synthetic peptide
  Seed: GKYSFGVTC (EGFR A289V)
GMYSFGVTV

SEQ ID NO: 3811 - protein, 9 aa, Artificial Sequence
  Description of Artificial Sequence: Synthetic peptide
  Seed: GKYSFGVTC (EGFR A289V)
GMYSFGVTW

SEQ ID NO: 3812 - protein, 9 aa, Artificial Sequence
  Description of Artificial Sequence: Synthetic peptide
  Seed: GKYSFGVTC (EGFR A289V)
GMYSFGVTY

SEQ ID NO: 3813 - protein, 9 aa, Artificial Sequence
  Description of Artificial Sequence: Synthetic peptide
  Seed: GKYSFGVTC (EGFR A289V)
GNYSFGVTA

SEQ ID NO: 3814 - protein, 9 aa, Artificial Sequence
  Description of Artificial Sequence: Synthetic peptide
  Seed: GKYSFGVTC (EGFR A289V)
GNYSFGVTF

SEQ ID NO: 3815 - protein, 9 aa, Artificial Sequence
  Description of Artificial Sequence: Synthetic peptide
  Seed: GKYSFGVTC (EGFR A289V)
GNYSFGVTI

SEQ ID NO: 3816 - protein, 9 aa, Artificial Sequence
  Description of Artificial Sequence: Synthetic peptide
  Seed: GKYSFGVTC (EGFR A289V)
GNYSFGVTL

SEQ ID NO: 3817 - protein, 9 aa, Artificial Sequence
  Description of Artificial Sequence: Synthetic peptide
  Seed: GKYSFGVTC (EGFR A289V)
GNYSFGVTM

SEQ ID NO: 3818 - protein, 9 aa, Artificial Sequence
  Description of Artificial Sequence: Synthetic peptide
  Seed: GKYSFGVTC (EGFR A289V)
GNYSFGVTV

SEQ ID NO: 3819 - protein, 9 aa, Artificial Sequence
  Description of Artificial Sequence: Synthetic peptide
  Seed: GKYSFGVTC (EGFR A289V)
GNYSFGVTW

SEQ ID NO: 3820 - protein, 9 aa, Artificial Sequence
  Description of Artificial Sequence: Synthetic peptide
  Seed: GKYSFGVTC (EGFR A289V)
GNYSFGVTY

SEQ ID NO: 3821 - protein, 9 aa, Artificial Sequence
  Description of Artificial Sequence: Synthetic peptide
  Seed: GKYSFGVTC (EGFR A289V)
GPYSFGVTA

SEQ ID NO: 3822 - protein, 9 aa, Artificial Sequence
  Description of Artificial Sequence: Synthetic peptide
  Seed: GKYSFGVTC (EGFR A289V)
GPYSFGVTC

SEQ ID NO: 3823 - protein, 9 aa, Artificial Sequence
  Description of Artificial Sequence: Synthetic peptide
  Seed: GKYSFGVTC (EGFR A289V)
GPYSFGVTF

SEQ ID NO: 3824 - protein, 9 aa, Artificial Sequence
  Description of Artificial Sequence: Synthetic peptide
  Seed: GKYSFGVTC (EGFR A289V)
GPYSFGVTI

SEQ ID NO: 3825 - protein, 9 aa, Artificial Sequence
  Description of Artificial Sequence: Synthetic peptide
  Seed: GKYSFGVTC (EGFR A289V)
GPYSFGVTL

SEQ ID NO: 3826 - protein, 9 aa, Artificial Sequence
  Description of Artificial Sequence: Synthetic peptide
  Seed: GKYSFGVTC (EGFR A289V)
GPYSFGVTM

SEQ ID NO: 3827 - protein, 9 aa, Artificial Sequence
  Description of Artificial Sequence: Synthetic peptide
  Seed: GKYSFGVTC (EGFR A289V)
GPYSFGVTT

SEQ ID NO: 3828 - protein, 9 aa, Artificial Sequence
  Description of Artificial Sequence: Synthetic peptide
  Seed: GKYSFGVTC (EGFR A289V)
GPYSFGVTV

SEQ ID NO: 3829 - protein, 9 aa, Artificial Sequence
  Description of Artificial Sequence: Synthetic peptide
  Seed: GKYSFGVTC (EGFR A289V)
GPYSFGVTY

SEQ ID NO: 3830 - protein, 9 aa, Artificial Sequence
  Description of Artificial Sequence: Synthetic peptide
  Seed: GKYSFGVTC (EGFR A289V)
GQYSFGVTA

SEQ ID NO: 3831 - protein, 9 aa, Artificial Sequence
  Description of Artificial Sequence: Synthetic peptide
  Seed: GKYSFGVTC (EGFR A289V)
GQYSFGVTC

SEQ ID NO: 3832 - protein, 9 aa, Artificial Sequence
  Description of Artificial Sequence: Synthetic peptide
  Seed: GKYSFGVTC (EGFR A289V)
GQYSFGVTF

SEQ ID NO: 3833 - protein, 9 aa, Artificial Sequence
  Description of Artificial Sequence: Synthetic peptide
  Seed: GKYSFGVTC (EGFR A289V)
GQYSFGVTG

SEQ ID NO: 3834 - protein, 9 aa, Artificial Sequence
  Description of Artificial Sequence: Synthetic peptide
  Seed: GKYSFGVTC (EGFR A289V)
GQYSFGVTH

SEQ ID NO: 3835 - protein, 9 aa, Artificial Sequence
  Description of Artificial Sequence: Synthetic peptide
  Seed: GKYSFGVTC (EGFR A289V)
GQYSFGVTI

SEQ ID NO: 3836 - protein, 9 aa, Artificial Sequence
  Description of Artificial Sequence: Synthetic peptide
  Seed: GKYSFGVTC (EGFR A289V)
GQYSFGVTK

SEQ ID NO: 3837 - protein, 9 aa, Artificial Sequence
  Description of Artificial Sequence: Synthetic peptide
  Seed: GKYSFGVTC (EGFR A289V)
GQYSFGVTM

SEQ ID NO: 3838 - protein, 9 aa, Artificial Sequence
  Description of Artificial Sequence: Synthetic peptide
  Seed: GKYSFGVTC (EGFR A289V)
GQYSFGVTN

SEQ ID NO: 3839 - protein, 9 aa, Artificial Sequence
  Description of Artificial Sequence: Synthetic peptide
  Seed: GKYSFGVTC (EGFR A289V)
GQYSFGVTP

SEQ ID NO: 3840 - protein, 9 aa, Artificial Sequence
  Description of Artificial Sequence: Synthetic peptide
  Seed: GKYSFGVTC (EGFR A289V)
GQYSFGVTQ

SEQ ID NO: 3841 - protein, 9 aa, Artificial Sequence
  Description of Artificial Sequence: Synthetic peptide
  Seed: GKYSFGVTC (EGFR A289V)
GQYSFGVTR

SEQ ID NO: 3842 - protein, 9 aa, Artificial Sequence
  Description of Artificial Sequence: Synthetic peptide
  Seed: GKYSFGVTC (EGFR A289V)
GQYSFGVTS

SEQ ID NO: 3843 - protein, 9 aa, Artificial Sequence
  Description of Artificial Sequence: Synthetic peptide
  Seed: GKYSFGVTC (EGFR A289V)
GQYSFGVTT

SEQ ID NO: 3844 - protein, 9 aa, Artificial Sequence
  Description of Artificial Sequence: Synthetic peptide
  Seed: GKYSFGVTC (EGFR A289V)
GQYSFGVTV

SEQ ID NO: 3845 - protein, 9 aa, Artificial Sequence
  Description of Artificial Sequence: Synthetic peptide
  Seed: GKYSFGVTC (EGFR A289V)
GQYSFGVTW

SEQ ID NO: 3846 - protein, 9 aa, Artificial Sequence
  Description of Artificial Sequence: Synthetic peptide
  Seed: GKYSFGVTC (EGFR A289V)
GQYSFGVTY

SEQ ID NO: 3847 - protein, 9 aa, Artificial Sequence
  Description of Artificial Sequence: Synthetic peptide
  Seed: GKYSFGVTC (EGFR A289V)
GRYSFGVTA

SEQ ID NO: 3848 - protein, 9 aa, Artificial Sequence
  Description of Artificial Sequence: Synthetic peptide
  Seed: GKYSFGVTC (EGFR A289V)
GRYSFGVTC

SEQ ID NO: 3849 - protein, 9 aa, Artificial Sequence
  Description of Artificial Sequence: Synthetic peptide
  Seed: GKYSFGVTC (EGFR A289V)
GRYSFGVTG

SEQ ID NO: 3850 - protein, 9 aa, Artificial Sequence
  Description of Artificial Sequence: Synthetic peptide
  Seed: GKYSFGVTC (EGFR A289V)
GRYSFGVTH

SEQ ID NO: 3851 - protein, 9 aa, Artificial Sequence
  Description of Artificial Sequence: Synthetic peptide
  Seed: GKYSFGVTC (EGFR A289V)
GRYSFGVTI

SEQ ID NO: 3852 - protein, 9 aa, Artificial Sequence
  Description of Artificial Sequence: Synthetic peptide
  Seed: GKYSFGVTC (EGFR A289V)
GRYSFGVTL

SEQ ID NO: 3853 - protein, 9 aa, Artificial Sequence
  Description of Artificial Sequence: Synthetic peptide
  Seed: GKYSFGVTC (EGFR A289V)
GRYSFGVTM

SEQ ID NO: 3854 - protein, 9 aa, Artificial Sequence
  Description of Artificial Sequence: Synthetic peptide
  Seed: GKYSFGVTC (EGFR A289V)
GRYSFGVTP

SEQ ID NO: 3855 - protein, 9 aa, Artificial Sequence
  Description of Artificial Sequence: Synthetic peptide
  Seed: GKYSFGVTC (EGFR A289V)
GRYSFGVTS

SEQ ID NO: 3856 - protein, 9 aa, Artificial Sequence
  Description of Artificial Sequence: Synthetic peptide
  Seed: GKYSFGVTC (EGFR A289V)
GRYSFGVTT

SEQ ID NO: 3857 - protein, 9 aa, Artificial Sequence
  Description of Artificial Sequence: Synthetic peptide
  Seed: GKYSFGVTC (EGFR A289V)
GRYSFGVTV

SEQ ID NO: 3858 - protein, 9 aa, Artificial Sequence
  Description of Artificial Sequence: Synthetic peptide
  Seed: GKYSFGVTC (EGFR A289V)
GRYSFGVTW

SEQ ID NO: 3859 - protein, 9 aa, Artificial Sequence
  Description of Artificial Sequence: Synthetic peptide
  Seed: GKYSFGVTC (EGFR A289V)
GRYSFGVTY

SEQ ID NO: 3860 - protein, 9 aa, Artificial Sequence
  Description of Artificial Sequence: Synthetic peptide
  Seed: GKYSFGVTC (EGFR A289V)
GSYSFGVTF

SEQ ID NO: 3861 - protein, 9 aa, Artificial Sequence
  Description of Artificial Sequence: Synthetic peptide
  Seed: GKYSFGVTC (EGFR A289V)
GSYSFGVTL

SEQ ID NO: 3862 - protein, 9 aa, Artificial Sequence
  Description of Artificial Sequence: Synthetic peptide
  Seed: GKYSFGVTC (EGFR A289V)
GSYSFGVTM

SEQ ID NO: 3863 - protein, 9 aa, Artificial Sequence
  Description of Artificial Sequence: Synthetic peptide
  Seed: GKYSFGVTC (EGFR A289V)
GSYSFGVTY

SEQ ID NO: 3864 - protein, 9 aa, Artificial Sequence
  Description of Artificial Sequence: Synthetic peptide
  Seed: GKYSFGVTC (EGFR A289V)
GTYSFGVTF

SEQ ID NO: 3865 - protein, 9 aa, Artificial Sequence
  Description of Artificial Sequence: Synthetic peptide
  Seed: GKYSFGVTC (EGFR A289V)
GTYSFGVTL

SEQ ID NO: 3866 - protein, 9 aa, Artificial Sequence
  Description of Artificial Sequence: Synthetic peptide
  Seed: GKYSFGVTC (EGFR A289V)
GTYSFGVTM

SEQ ID NO: 3867 - protein, 9 aa, Artificial Sequence
  Description of Artificial Sequence: Synthetic peptide
  Seed: GKYSFGVTC (EGFR A289V)
GTYSFGVTY

SEQ ID NO: 3868 - protein, 9 aa, Artificial Sequence
  Description of Artificial Sequence: Synthetic peptide
  Seed: GKYSFGVTC (EGFR A289V)
GVYSFGVTF

SEQ ID NO: 3869 - protein, 9 aa, Artificial Sequence
  Description of Artificial Sequence: Synthetic peptide
  Seed: GKYSFGVTC (EGFR A289V)
GVYSFGVTL

SEQ ID NO: 3870 - protein, 9 aa, Artificial Sequence
  Description of Artificial Sequence: Synthetic peptide
  Seed: GKYSFGVTC (EGFR A289V)
GVYSFGVTM

SEQ ID NO: 3871 - protein, 9 aa, Artificial Sequence
  Description of Artificial Sequence: Synthetic peptide
  Seed: GKYSFGVTC (EGFR A289V)
GVYSFGVTY

SEQ ID NO: 3872 - protein, 9 aa, Artificial Sequence
  Description of Artificial Sequence: Synthetic peptide
  Seed: GKYSFGVTC (EGFR A289V)
GWYSFGVTF

SEQ ID NO: 3873 - protein, 9 aa, Artificial Sequence
  Description of Artificial Sequence: Synthetic peptide
  Seed: GKYSFGVTC (EGFR A289V)
GWYSFGVTY

SEQ ID NO: 3874 - protein, 9 aa, Artificial Sequence
  Description of Artificial Sequence: Synthetic peptide
  Seed: GKYSFGVTC (EGFR A289V)
GYYSFGVTF

SEQ ID NO: 3875 - protein, 9 aa, Artificial Sequence
  Description of Artificial Sequence: Synthetic peptide
  Seed: GKYSFGVTC (EGFR A289V)
GYYSFGVTY

SEQ ID NO: 3876 - protein, 9 aa, Artificial Sequence
  Description of Artificial Sequence: Synthetic peptide
  Seed: KYSFGVTCV (EGFR A289V)
KASFGVTCF

SEQ ID NO: 3877 - protein, 9 aa, Artificial Sequence
  Description of Artificial Sequence: Synthetic peptide
  Seed: KYSFGVTCV (EGFR A289V)
KASFGVTCL

SEQ ID NO: 3878 - protein, 9 aa, Artificial Sequence
  Description of Artificial Sequence: Synthetic peptide
  Seed: KYSFGVTCV (EGFR A289V)
KASFGVTCM

SEQ ID NO: 3879 - protein, 9 aa, Artificial Sequence
  Description of Artificial Sequence: Synthetic peptide
  Seed: KYSFGVTCV (EGFR A289V)
KASFGVTCY

SEQ ID NO: 3880 - protein, 9 aa, Artificial Sequence
  Description of Artificial Sequence: Synthetic peptide
  Seed: KYSFGVTCV (EGFR A289V)
KHSFGVTCF

SEQ ID NO: 3881 - protein, 9 aa, Artificial Sequence
  Description of Artificial Sequence: Synthetic peptide
  Seed: KYSFGVTCV (EGFR A289V)
KHSFGVTCL

SEQ ID NO: 3882 - protein, 9 aa, Artificial Sequence
  Description of Artificial Sequence: Synthetic peptide
  Seed: KYSFGVTCV (EGFR A289V)
KHSFGVTCM

SEQ ID NO: 3883 - protein, 9 aa, Artificial Sequence
  Description of Artificial Sequence: Synthetic peptide
  Seed: KYSFGVTCV (EGFR A289V)
KHSFGVTCY

SEQ ID NO: 3884 - protein, 11 aa, Artificial Sequence
  Description of Artificial Sequence: Synthetic peptide
  Seed: KYSFGVTCVKK (EGFR A289V)
KISFGVTCVKK

SEQ ID NO: 3885 - protein, 9 aa, Artificial Sequence
  Description of Artificial Sequence: Synthetic peptide
  Seed: KYSFGVTCV (EGFR A289V)
KKSFGVTCF

SEQ ID NO: 3886 - protein, 9 aa, Artificial Sequence
  Description of Artificial Sequence: Synthetic peptide
  Seed: KYSFGVTCV (EGFR A289V)
KKSFGVTCY

SEQ ID NO: 3887 - protein, 9 aa, Artificial Sequence
  Description of Artificial Sequence: Synthetic peptide
  Seed: KYSFGVTCV (EGFR A289V)
KLSFGVTCF

SEQ ID NO: 3888 - protein, 9 aa, Artificial Sequence
  Description of Artificial Sequence: Synthetic peptide
  Seed: KYSFGVTCV (EGFR A289V)
KMSFGVTCL

SEQ ID NO: 3889 - protein, 9 aa, Artificial Sequence
  Description of Artificial Sequence: Synthetic peptide
  Seed: KYSFGVTCV (EGFR A289V)
KQSFGVTCF

SEQ ID NO: 3890 - protein, 9 aa, Artificial Sequence
  Description of Artificial Sequence: Synthetic peptide
  Seed: KYSFGVTCV (EGFR A289V)
KQSFGVTCL

SEQ ID NO: 3891 - protein, 9 aa, Artificial Sequence
  Description of Artificial Sequence: Synthetic peptide
  Seed: KYSFGVTCV (EGFR A289V)
KQSFGVTCM

SEQ ID NO: 3892 - protein, 9 aa, Artificial Sequence
  Description of Artificial Sequence: Synthetic peptide
  Seed: KYSFGVTCV (EGFR A289V)
KQSFGVTCY

SEQ ID NO: 3893 - protein, 9 aa, Artificial Sequence
  Description of Artificial Sequence: Synthetic peptide
  Seed: KYSFGVTCV (EGFR A289V)
KRSFGVTCF

SEQ ID NO: 3894 - protein, 9 aa, Artificial Sequence
  Description of Artificial Sequence: Synthetic peptide
  Seed: KYSFGVTCV (EGFR A289V)
KRSFGVTCI

SEQ ID NO: 3895 - protein, 9 aa, Artificial Sequence
  Description of Artificial Sequence: Synthetic peptide
  Seed: KYSFGVTCV (EGFR A289V)
KRSFGVTCL

SEQ ID NO: 3896 - protein, 9 aa, Artificial Sequence
  Description of Artificial Sequence: Synthetic peptide
  Seed: KYSFGVTCV (EGFR A289V)
KRSFGVTCM

SEQ ID NO: 3897 - protein, 9 aa, Artificial Sequence
  Description of Artificial Sequence: Synthetic peptide
  Seed: KYSFGVTCV (EGFR A289V)
KRSFGVTCV

SEQ ID NO: 3898 - protein, 9 aa, Artificial Sequence
  Description of Artificial Sequence: Synthetic peptide
  Seed: KYSFGVTCV (EGFR A289V)
KRSFGVTCW

SEQ ID NO: 3899 - protein, 9 aa, Artificial Sequence
  Description of Artificial Sequence: Synthetic peptide
  Seed: KYSFGVTCV (EGFR A289V)
KRSFGVTCY

SEQ ID NO: 3900 - protein, 11 aa, Artificial Sequence
  Description of Artificial Sequence: Synthetic peptide
  Seed: KYSFGVTCVKK (EGFR A289V)
KSSFGVTCVKK

SEQ ID NO: 3901 - protein, 10 aa, Artificial Sequence
  Description of Artificial Sequence: Synthetic peptide
  Seed: KYSFGVTCVK (EGFR A289V)
KTSFGVTCVH

SEQ ID NO: 3902 - protein, 9 aa, Artificial Sequence
  Description of Artificial Sequence: Synthetic peptide
  Seed: KYSFGVTCV (EGFR A289V)
KYSFGVTCC

SEQ ID NO: 3903 - protein, 9 aa, Artificial Sequence
  Description of Artificial Sequence: Synthetic peptide
  Seed: KYSFGVTCV (EGFR A289V)
KYSFGVTCH

SEQ ID NO: 3904 - protein, 9 aa, Artificial Sequence
  Description of Artificial Sequence: Synthetic peptide
  Seed: SFGVTCVKK (EGFR A289V)
SAGVTCVKK

SEQ ID NO: 3905 - protein, 9 aa, Artificial Sequence
  Description of Artificial Sequence: Synthetic peptide
  Seed: SFGVTCVKK (EGFR A289V)
SDGVTCVKK

SEQ ID NO: 3906 - protein, 9 aa, Artificial Sequence
  Description of Artificial Sequence: Synthetic peptide
  Seed: SFGVTCVKK (EGFR A289V)
SGGVTCVKK

SEQ ID NO: 3907 - protein, 9 aa, Artificial Sequence
  Description of Artificial Sequence: Synthetic peptide
  Seed: SFGVTCVKK (EGFR A289V)
SIGVTCVKK

SEQ ID NO: 3908 - protein, 9 aa, Artificial Sequence
  Description of Artificial Sequence: Synthetic peptide
  Seed: SFGVTCVKK (EGFR A289V)
SLGVTCVKK

SEQ ID NO: 3909 - protein, 9 aa, Artificial Sequence
  Description of Artificial Sequence: Synthetic peptide
  Seed: SFGVTCVKK (EGFR A289V)
SNGVTCVKK

SEQ ID NO: 3910 - protein, 9 aa, Artificial Sequence
  Description of Artificial Sequence: Synthetic peptide
  Seed: SFGVTCVKK (EGFR A289V)
SPGVTCVKK

SEQ ID NO: 3911 - protein, 9 aa, Artificial Sequence
  Description of Artificial Sequence: Synthetic peptide
  Seed: SFGVTCVKK (EGFR A289V)
SQGVTCVKK

SEQ ID NO: 3912 - protein, 9 aa, Artificial Sequence
  Description of Artificial Sequence: Synthetic peptide
  Seed: SFGVTCVKK (EGFR A289V)
SSGVTCVKK

SEQ ID NO: 3913 - protein, 9 aa, Artificial Sequence
  Description of Artificial Sequence: Synthetic peptide
  Seed: SFGVTCVKK (EGFR A289V)
STGVTCVKH

SEQ ID NO: 3914 - protein, 9 aa, Artificial Sequence
  Description of Artificial Sequence: Synthetic peptide
  Seed: SFGVTCVKK (EGFR A289V)
STGVTCVKY

SEQ ID NO: 3915 - protein, 9 aa, Artificial Sequence
  Description of Artificial Sequence: Synthetic peptide
  Seed: SFGVTCVKK (EGFR A289V)
SVGVTCVKH

SEQ ID NO: 3916 - protein, 9 aa, Artificial Sequence
  Description of Artificial Sequence: Synthetic peptide
  Seed: SFGVTCVKK (EGFR A289V)
SVGVTCVKK

SEQ ID NO: 3917 - protein, 9 aa, Artificial Sequence
  Description of Artificial Sequence: Synthetic peptide
  Seed: SFGVTCVKK (EGFR A289V)
SVGVTCVKY

SEQ ID NO: 3918 - protein, 9 aa, Artificial Sequence
  Description of Artificial Sequence: Synthetic peptide
  Seed: VTCVKKCPR (EGFR A289V)
VACVKKCPK

SEQ ID NO: 3919 - protein, 11 aa, Artificial Sequence
  Description of Artificial Sequence: Synthetic peptide
  Seed: VTCVKKCPRNY (EGFR A289V)
VACVKKCPRNF

SEQ ID NO: 3920 - protein, 11 aa, Artificial Sequence
  Description of Artificial Sequence: Synthetic peptide
  Seed: VTCVKKCPRNY (EGFR A289V)
VACVKKCPRNW

SEQ ID NO: 3921 - protein, 9 aa, Artificial Sequence
  Description of Artificial Sequence: Synthetic peptide
  Seed: VTCVKKCPR (EGFR A289V)
VCCVKKCPR

SEQ ID NO: 3922 - protein, 11 aa, Artificial Sequence
  Description of Artificial Sequence: Synthetic peptide
  Seed: VTCVKKCPRNY (EGFR A289V)
VCCVKKCPRNW

SEQ ID NO: 3923 - protein, 9 aa, Artificial Sequence
  Description of Artificial Sequence: Synthetic peptide
  Seed: VTCVKKCPR (EGFR A289V)
VDCVKKCPK

SEQ ID NO: 3924 - protein, 9 aa, Artificial Sequence
  Description of Artificial Sequence: Synthetic peptide
  Seed: VTCVKKCPR (EGFR A289V)
VDCVKKCPR

SEQ ID NO: 3925 - protein, 11 aa, Artificial Sequence
  Description of Artificial Sequence: Synthetic peptide
  Seed: VTCVKKCPRNY (EGFR A289V)
VDCVKKCPRNW

SEQ ID NO: 3926 - protein, 9 aa, Artificial Sequence
  Description of Artificial Sequence: Synthetic peptide
  Seed: VTCVKKCPR (EGFR A289V)
VECVKKCPR

SEQ ID NO: 3927 - protein, 11 aa, Artificial Sequence
  Description of Artificial Sequence: Synthetic peptide
  Seed: VTCVKKCPRNY (EGFR A289V)
VECVKKCPRNW

SEQ ID NO: 3928 - protein, 9 aa, Artificial Sequence
  Description of Artificial Sequence: Synthetic peptide
  Seed: VTCVKKCPR (EGFR A289V)
VGCVKKCPK

SEQ ID NO: 3929 - protein, 11 aa, Artificial Sequence
  Description of Artificial Sequence: Synthetic peptide
  Seed: VTCVKKCPRNY (EGFR A289V)
VGCVKKCPRNW

SEQ ID NO: 3930 - protein, 9 aa, Artificial Sequence
  Description of Artificial Sequence: Synthetic peptide
  Seed: VTCVKKCPR (EGFR A289V)
VHCVKKCPR

SEQ ID NO: 3931 - protein, 11 aa, Artificial Sequence
  Description of Artificial Sequence: Synthetic peptide
  Seed: VTCVKKCPRNY (EGFR A289V)
VICVKKCPRNW

SEQ ID NO: 3932 - protein, 11 aa, Artificial Sequence
  Description of Artificial Sequence: Synthetic peptide
  Seed: VTCVKKCPRNY (EGFR A289V)
VLCVKKCPRNW

SEQ ID NO: 3933 - protein, 11 aa, Artificial Sequence
  Description of Artificial Sequence: Synthetic peptide
  Seed: VTCVKKCPRNY (EGFR A289V)
VMCVKKCPRNW

SEQ ID NO: 3934 - protein, 11 aa, Artificial Sequence
  Description of Artificial Sequence: Synthetic peptide
  Seed: VTCVKKCPRNY (EGFR A289V)
VMCVKKCPRNY

SEQ ID NO: 3935 - protein, 11 aa, Artificial Sequence
  Description of Artificial Sequence: Synthetic peptide
  Seed: VTCVKKCPRNY (EGFR A289V)
VNCVKKCPRNW

SEQ ID NO: 3936 - protein, 9 aa, Artificial Sequence
  Description of Artificial Sequence: Synthetic peptide
  Seed: VTCVKKCPR (EGFR A289V)
VPCVKKCPR

SEQ ID NO: 3937 - protein, 11 aa, Artificial Sequence
  Description of Artificial Sequence: Synthetic peptide
  Seed: VTCVKKCPRNY (EGFR A289V)
VPCVKKCPRNW

SEQ ID NO: 3938 - protein, 11 aa, Artificial Sequence
  Description of Artificial Sequence: Synthetic peptide
  Seed: VTCVKKCPRNY (EGFR A289V)
VQCVKKCPRNW

SEQ ID NO: 3939 - protein, 11 aa, Artificial Sequence
  Description of Artificial Sequence: Synthetic peptide
  Seed: VTCVKKCPRNY (EGFR A289V)
VSCVKKCPRNF

SEQ ID NO: 3940 - protein, 11 aa, Artificial Sequence
  Description of Artificial Sequence: Synthetic peptide
  Seed: VTCVKKCPRNY (EGFR A289V)
VSCVKKCPRNW

SEQ ID NO: 3941 - protein, 11 aa, Artificial Sequence
  Description of Artificial Sequence: Synthetic peptide
  Seed: VTCVKKCPRNY (EGFR A289V)
VSCVKKCPRNY

SEQ ID NO: 3942 - protein, 11 aa, Artificial Sequence
  Description of Artificial Sequence: Synthetic peptide
  Seed: VTCVKKCPRNY (EGFR A289V)
VTCVKKCPRNF

SEQ ID NO: 3943 - protein, 11 aa, Artificial Sequence
  Description of Artificial Sequence: Synthetic peptide
  Seed: VTCVKKCPRNY (EGFR A289V)
VTCVKKCPRNW

SEQ ID NO: 3944 - protein, 9 aa, Artificial Sequence
  Description of Artificial Sequence: Synthetic peptide
  Seed: VTCVKKCPR (EGFR A289V)
VTCVKKCPY

SEQ ID NO: 3945 - protein, 11 aa, Artificial Sequence
  Description of Artificial Sequence: Synthetic peptide
  Seed: VTCVKKCPRNY (EGFR A289V)
VVCVKKCPRNW

SEQ ID NO: 3946 - protein, 9 aa, Artificial Sequence
  Description of Artificial Sequence: Synthetic peptide
  Seed: VTCVKKCPR (EGFR A289V)
VVCVKKCPY

SEQ ID NO: 3947 - protein, 8 aa, Artificial Sequence
  Description of Artificial Sequence: Synthetic peptide
  Seed: YSFGVTCV (EGFR A289V)
YAFGVTCH

SEQ ID NO: 3948 - protein, 9 aa, Artificial Sequence
  Description of Artificial Sequence: Synthetic peptide
  Seed: YSFGVTCVK (EGFR A289V)
YAFGVTCVE

SEQ ID NO: 3949 - protein, 9 aa, Artificial Sequence
  Description of Artificial Sequence: Synthetic peptide
  Seed: YSFGVTCVK (EGFR A289V)
YAFGVTCVP

SEQ ID NO: 3950 - protein, 9 aa, Artificial Sequence
  Description of Artificial Sequence: Synthetic peptide
  Seed: YSFGVTCVK (EGFR A289V)
YCFGVTCVH

SEQ ID NO: 3951 - protein, 10 aa, Artificial Sequence
  Description of Artificial Sequence: Synthetic peptide
  Seed: YSFGVTCVKK (EGFR A289V)
YCFGVTCVKY

SEQ ID NO: 3952 - protein, 9 aa, Artificial Sequence
  Description of Artificial Sequence: Synthetic peptide
  Seed: YSFGVTCVK (EGFR A289V)
YCFGVTCVW

SEQ ID NO: 3953 - protein, 8 aa, Artificial Sequence
  Description of Artificial Sequence: Synthetic peptide
  Seed: YSFGVTCV (EGFR A289V)
YDFGVTCI

SEQ ID NO: 3954 - protein, 8 aa, Artificial Sequence
  Description of Artificial Sequence: Synthetic peptide
  Seed: YSFGVTCV (EGFR A289V)
YDFGVTCL

SEQ ID NO: 3955 - protein, 8 aa, Artificial Sequence
  Description of Artificial Sequence: Synthetic peptide
  Seed: YSFGVTCV (EGFR A289V)
YDFGVTCV

SEQ ID NO: 3956 - protein, 9 aa, Artificial Sequence
  Description of Artificial Sequence: Synthetic peptide
  Seed: YSFGVTCVK (EGFR A289V)
YDFGVTCVF

SEQ ID NO: 3957 - protein, 10 aa, Artificial Sequence
  Description of Artificial Sequence: Synthetic peptide
  Seed: YSFGVTCVKK (EGFR A289V)
YDFGVTCVKK

SEQ ID NO: 3958 - protein, 10 aa, Artificial Sequence
  Description of Artificial Sequence: Synthetic peptide
  Seed: YSFGVTCVKK (EGFR A289V)
YDFGVTCVKY

SEQ ID NO: 3959 - protein, 9 aa, Artificial Sequence
  Description of Artificial Sequence: Synthetic peptide
  Seed: YSFGVTCVK (EGFR A289V)
YDFGVTCVL

SEQ ID NO: 3960 - protein, 9 aa, Artificial Sequence
  Description of Artificial Sequence: Synthetic peptide
  Seed: YSFGVTCVK (EGFR A289V)
YDFGVTCVM

SEQ ID NO: 3961 - protein, 9 aa, Artificial Sequence
  Description of Artificial Sequence: Synthetic peptide
  Seed: YSFGVTCVK (EGFR A289V)
YDFGVTCVY

SEQ ID NO: 3962 - protein, 8 aa, Artificial Sequence
  Description of Artificial Sequence: Synthetic peptide
  Seed: YSFGVTCV (EGFR A289V)
YEFGVTCI

SEQ ID NO: 3963 - protein, 8 aa, Artificial Sequence
  Description of Artificial Sequence: Synthetic peptide
  Seed: YSFGVTCV (EGFR A289V)
YEFGVTCL

SEQ ID NO: 3964 - protein, 8 aa, Artificial Sequence
  Description of Artificial Sequence: Synthetic peptide
  Seed: YSFGVTCV (EGFR A289V)
YEFGVTCM

SEQ ID NO: 3965 - protein, 8 aa, Artificial Sequence
  Description of Artificial Sequence: Synthetic peptide
  Seed: YSFGVTCV (EGFR A289V)
YEFGVTCV

SEQ ID NO: 3966 - protein, 9 aa, Artificial Sequence
  Description of Artificial Sequence: Synthetic peptide
  Seed: YSFGVTCVK (EGFR A289V)
YEFGVTCVF

SEQ ID NO: 3967 - protein, 9 aa, Artificial Sequence
  Description of Artificial Sequence: Synthetic peptide
  Seed: YSFGVTCVK (EGFR A289V)
YEFGVTCVH

SEQ ID NO: 3968 - protein, 9 aa, Artificial Sequence
  Description of Artificial Sequence: Synthetic peptide
  Seed: YSFGVTCVK (EGFR A289V)
YEFGVTCVK

SEQ ID NO: 3969 - protein, 10 aa, Artificial Sequence
  Description of Artificial Sequence: Synthetic peptide
  Seed: YSFGVTCVKK (EGFR A289V)
YEFGVTCVKK

SEQ ID NO: 3970 - protein, 10 aa, Artificial Sequence
  Description of Artificial Sequence: Synthetic peptide
  Seed: YSFGVTCVKK (EGFR A289V)
YEFGVTCVKY

SEQ ID NO: 3971 - protein, 9 aa, Artificial Sequence
  Description of Artificial Sequence: Synthetic peptide
  Seed: YSFGVTCVK (EGFR A289V)
YEFGVTCVL

SEQ ID NO: 3972 - protein, 9 aa, Artificial Sequence
  Description of Artificial Sequence: Synthetic peptide
  Seed: YSFGVTCVK (EGFR A289V)
YEFGVTCVM

SEQ ID NO: 3973 - protein, 9 aa, Artificial Sequence
  Description of Artificial Sequence: Synthetic peptide
  Seed: YSFGVTCVK (EGFR A289V)
YEFGVTCVR

SEQ ID NO: 3974 - protein, 9 aa, Artificial Sequence
  Description of Artificial Sequence: Synthetic peptide
  Seed: YSFGVTCVK (EGFR A289V)
YEFGVTCVY

SEQ ID NO: 3975 - protein, 10 aa, Artificial Sequence
  Description of Artificial Sequence: Synthetic peptide
  Seed: YSFGVTCVKK (EGFR A289V)
YFFGVTCVKY

SEQ ID NO: 3976 - protein, 9 aa, Artificial Sequence
  Description of Artificial Sequence: Synthetic peptide
  Seed: YSFGVTCVK (EGFR A289V)
YFFGVTCVW

SEQ ID NO: 3977 - protein, 8 aa, Artificial Sequence
  Description of Artificial Sequence: Synthetic peptide
  Seed: YSFGVTCV (EGFR A289V)
YGFGVTCF

SEQ ID NO: 3978 - protein, 8 aa, Artificial Sequence
  Description of Artificial Sequence: Synthetic peptide
  Seed: YSFGVTCV (EGFR A289V)
YGFGVTCI

SEQ ID NO: 3979 - protein, 8 aa, Artificial Sequence
  Description of Artificial Sequence: Synthetic peptide
  Seed: YSFGVTCV (EGFR A289V)
YGFGVTCL

SEQ ID NO: 3980 - protein, 8 aa, Artificial Sequence
  Description of Artificial Sequence: Synthetic peptide
  Seed: YSFGVTCV (EGFR A289V)
YGFGVTCM

SEQ ID NO: 3981 - protein, 8 aa, Artificial Sequence
  Description of Artificial Sequence: Synthetic peptide
  Seed: YSFGVTCV (EGFR A289V)
YGFGVTCV

SEQ ID NO: 3982 - protein, 9 aa, Artificial Sequence
  Description of Artificial Sequence: Synthetic peptide
  Seed: YSFGVTCVK (EGFR A289V)
YGFGVTCVH

SEQ ID NO: 3983 - protein, 10 aa, Artificial Sequence
  Description of Artificial Sequence: Synthetic peptide
  Seed: YSFGVTCVKK (EGFR A289V)
YGFGVTCVKY

SEQ ID NO: 3984 - protein, 8 aa, Artificial Sequence
  Description of Artificial Sequence: Synthetic peptide
  Seed: YSFGVTCV (EGFR A289V)
YGFGVTCY

SEQ ID NO: 3985 - protein, 9 aa, Artificial Sequence
  Description of Artificial Sequence: Synthetic peptide
  Seed: YSFGVTCVK (EGFR A289V)
YHFGVTCVK

SEQ ID NO: 3986 - protein, 8 aa, Artificial Sequence
  Description of Artificial Sequence: Synthetic peptide
  Seed: YSFGVTCV (EGFR A289V)
YIFGVTCF

SEQ ID NO: 3987 - protein, 8 aa, Artificial Sequence
  Description of Artificial Sequence: Synthetic peptide
  Seed: YSFGVTCV (EGFR A289V)
YIFGVTCI

SEQ ID NO: 3988 - protein, 8 aa, Artificial Sequence
  Description of Artificial Sequence: Synthetic peptide
  Seed: YSFGVTCV (EGFR A289V)
YIFGVTCL

SEQ ID NO: 3989 - protein, 8 aa, Artificial Sequence
  Description of Artificial Sequence: Synthetic peptide
  Seed: YSFGVTCV (EGFR A289V)
YIFGVTCM

SEQ ID NO: 3990 - protein, 9 aa, Artificial Sequence
  Description of Artificial Sequence: Synthetic peptide
  Seed: YSFGVTCVK (EGFR A289V)
YIFGVTCVC

SEQ ID NO: 3991 - protein, 8 aa, Artificial Sequence
  Description of Artificial Sequence: Synthetic peptide
  Seed: YSFGVTCV (EGFR A289V)
YIFGVTCY

SEQ ID NO: 3992 - protein, 9 aa, Artificial Sequence
  Description of Artificial Sequence: Synthetic peptide
  Seed: YSFGVTCVK (EGFR A289V)
YKFGVTCVR

SEQ ID NO: 3993 - protein, 8 aa, Artificial Sequence
  Description of Artificial Sequence: Synthetic peptide
  Seed: YSFGVTCV (EGFR A289V)
YLFGVTCI

SEQ ID NO: 3994 - protein, 8 aa, Artificial Sequence
  Description of Artificial Sequence: Synthetic peptide
  Seed: YSFGVTCV (EGFR A289V)
YLFGVTCV

SEQ ID NO: 3995 - protein, 9 aa, Artificial Sequence
  Description of Artificial Sequence: Synthetic peptide
  Seed: YSFGVTCVK (EGFR A289V)
YLFGVTCVH

SEQ ID NO: 3996 - protein, 10 aa, Artificial Sequence
  Description of Artificial Sequence: Synthetic peptide
  Seed: YSFGVTCVKK (EGFR A289V)
YLFGVTCVKA

SEQ ID NO: 3997 - protein, 10 aa, Artificial Sequence
  Description of Artificial Sequence: Synthetic peptide
  Seed: YSFGVTCVKK (EGFR A289V)
YLFGVTCVKF

SEQ ID NO: 3998 - protein, 10 aa, Artificial Sequence
  Description of Artificial Sequence: Synthetic peptide
  Seed: YSFGVTCVKK (EGFR A289V)
YLFGVTCVKI

SEQ ID NO: 3999 - protein, 10 aa, Artificial Sequence
  Description of Artificial Sequence: Synthetic peptide
  Seed: YSFGVTCVKK (EGFR A289V)
YLFGVTCVKL

SEQ ID NO: 4000 - protein, 10 aa, Artificial Sequence
  Description of Artificial Sequence: Synthetic peptide
  Seed: YSFGVTCVKK (EGFR A289V)
YLFGVTCVKM

SEQ ID NO: 4001 - protein, 10 aa, Artificial Sequence
  Description of Artificial Sequence: Synthetic peptide
  Seed: YSFGVTCVKK (EGFR A289V)
YLFGVTCVKV

SEQ ID NO: 4002 - protein, 9 aa, Artificial Sequence
  Description of Artificial Sequence: Synthetic peptide
  Seed: YSFGVTCVK (EGFR A289V)
YLFGVTCVW

SEQ ID NO: 4003 - protein, 8 aa, Artificial Sequence
  Description of Artificial Sequence: Synthetic peptide
  Seed: YSFGVTCV (EGFR A289V)
YMFGVTCF

SEQ ID NO: 4004 - protein, 8 aa, Artificial Sequence
  Description of Artificial Sequence: Synthetic peptide
  Seed: YSFGVTCV (EGFR A289V)
YMFGVTCI

SEQ ID NO: 4005 - protein, 8 aa, Artificial Sequence
  Description of Artificial Sequence: Synthetic peptide
  Seed: YSFGVTCV (EGFR A289V)
YMFGVTCL

SEQ ID NO: 4006 - protein, 8 aa, Artificial Sequence
  Description of Artificial Sequence: Synthetic peptide
  Seed: YSFGVTCV (EGFR A289V)
YMFGVTCV

SEQ ID NO: 4007 - protein, 10 aa, Artificial Sequence
  Description of Artificial Sequence: Synthetic peptide
  Seed: YSFGVTCVKK (EGFR A289V)
YMFGVTCVKA

SEQ ID NO: 4008 - protein, 10 aa, Artificial Sequence
  Description of Artificial Sequence: Synthetic peptide
  Seed: YSFGVTCVKK (EGFR A289V)
YMFGVTCVKF

SEQ ID NO: 4009 - protein, 10 aa, Artificial Sequence
  Description of Artificial Sequence: Synthetic peptide
  Seed: YSFGVTCVKK (EGFR A289V)
YMFGVTCVKI

SEQ ID NO: 4010 - protein, 10 aa, Artificial Sequence
  Description of Artificial Sequence: Synthetic peptide
  Seed: YSFGVTCVKK (EGFR A289V)
YMFGVTCVKL

SEQ ID NO: 4011 - protein, 10 aa, Artificial Sequence
  Description of Artificial Sequence: Synthetic peptide
  Seed: YSFGVTCVKK (EGFR A289V)
YMFGVTCVKM

SEQ ID NO: 4012 - protein, 10 aa, Artificial Sequence
  Description of Artificial Sequence: Synthetic peptide
  Seed: YSFGVTCVKK (EGFR A289V)
YMFGVTCVKV

SEQ ID NO: 4013 - protein, 9 aa, Artificial Sequence
  Description of Artificial Sequence: Synthetic peptide
  Seed: YSFGVTCVK (EGFR A289V)
YMFGVTCVT

SEQ ID NO: 4014 - protein, 8 aa, Artificial Sequence
  Description of Artificial Sequence: Synthetic peptide
  Seed: YSFGVTCV (EGFR A289V)
YMFGVTCY

SEQ ID NO: 4015 - protein, 8 aa, Artificial Sequence
  Description of Artificial Sequence: Synthetic peptide
  Seed: YSFGVTCV (EGFR A289V)
YNFGVTCI

SEQ ID NO: 4016 - protein, 8 aa, Artificial Sequence
  Description of Artificial Sequence: Synthetic peptide
  Seed: YSFGVTCV (EGFR A289V)
YNFGVTCL

SEQ ID NO: 4017 - protein, 8 aa, Artificial Sequence
  Description of Artificial Sequence: Synthetic peptide
  Seed: YSFGVTCV (EGFR A289V)
YNFGVTCV

SEQ ID NO: 4018 - protein, 9 aa, Artificial Sequence
  Description of Artificial Sequence: Synthetic peptide
  Seed: YSFGVTCVK (EGFR A289V)
YNFGVTCVH

SEQ ID NO: 4019 - protein, 10 aa, Artificial Sequence
  Description of Artificial Sequence: Synthetic peptide
  Seed: YSFGVTCVKK (EGFR A289V)
YNFGVTCVKY

SEQ ID NO: 4020 - protein, 9 aa, Artificial Sequence
  Description of Artificial Sequence: Synthetic peptide
  Seed: YSFGVTCVK (EGFR A289V)
YNFGVTCVW

SEQ ID NO: 4021 - protein, 8 aa, Artificial Sequence
  Description of Artificial Sequence: Synthetic peptide
  Seed: YSFGVTCV (EGFR A289V)
YPFGVTCI

SEQ ID NO: 4022 - protein, 8 aa, Artificial Sequence
  Description of Artificial Sequence: Synthetic peptide
  Seed: YSFGVTCV (EGFR A289V)
YPFGVTCL

SEQ ID NO: 4023 - protein, 8 aa, Artificial Sequence
  Description of Artificial Sequence: Synthetic peptide
  Seed: YSFGVTCV (EGFR A289V)
YPFGVTCV

SEQ ID NO: 4024 - protein, 9 aa, Artificial Sequence
  Description of Artificial Sequence: Synthetic peptide
  Seed: YSFGVTCVK (EGFR A289V)
YPFGVTCVH

SEQ ID NO: 4025 - protein, 8 aa, Artificial Sequence
  Description of Artificial Sequence: Synthetic peptide
  Seed: YSFGVTCV (EGFR A289V)
YQFGVTCF

SEQ ID NO: 4026 - protein, 8 aa, Artificial Sequence
  Description of Artificial Sequence: Synthetic peptide
  Seed: YSFGVTCV (EGFR A289V)
YQFGVTCI

SEQ ID NO: 4027 - protein, 8 aa, Artificial Sequence
  Description of Artificial Sequence: Synthetic peptide
  Seed: YSFGVTCV (EGFR A289V)
YQFGVTCL

SEQ ID NO: 4028 - protein, 8 aa, Artificial Sequence
  Description of Artificial Sequence: Synthetic peptide
  Seed: YSFGVTCV (EGFR A289V)
YQFGVTCM

SEQ ID NO: 4029 - protein, 8 aa, Artificial Sequence
  Description of Artificial Sequence: Synthetic peptide
  Seed: YSFGVTCV (EGFR A289V)
YQFGVTCV

SEQ ID NO: 4030 - protein, 9 aa, Artificial Sequence
  Description of Artificial Sequence: Synthetic peptide
  Seed: YSFGVTCVK (EGFR A289V)
YQFGVTCVH

SEQ ID NO: 4031 - protein, 10 aa, Artificial Sequence
  Description of Artificial Sequence: Synthetic peptide
  Seed: YSFGVTCVKK (EGFR A289V)
YQFGVTCVKY

SEQ ID NO: 4032 - protein, 9 aa, Artificial Sequence
  Description of Artificial Sequence: Synthetic peptide
  Seed: YSFGVTCVK (EGFR A289V)
YRFGVTCVR

SEQ ID NO: 4033 - protein, 9 aa, Artificial Sequence
  Description of Artificial Sequence: Synthetic peptide
  Seed: YSFGVTCVK (EGFR A289V)
YSFGVTCVQ

SEQ ID NO: 4034 - protein, 8 aa, Artificial Sequence
  Description of Artificial Sequence: Synthetic peptide
  Seed: YSFGVTCV (EGFR A289V)
YVFGVTCF

SEQ ID NO: 4035 - protein, 8 aa, Artificial Sequence
  Description of Artificial Sequence: Synthetic peptide
  Seed: YSFGVTCV (EGFR A289V)
YVFGVTCI

SEQ ID NO: 4036 - protein, 8 aa, Artificial Sequence
  Description of Artificial Sequence: Synthetic peptide
  Seed: YSFGVTCV (EGFR A289V)
YVFGVTCL

SEQ ID NO: 4037 - protein, 8 aa, Artificial Sequence
  Description of Artificial Sequence: Synthetic peptide
  Seed: YSFGVTCV (EGFR A289V)
YVFGVTCM

SEQ ID NO: 4038 - protein, 9 aa, Artificial Sequence
  Description of Artificial Sequence: Synthetic peptide
  Seed: YSFGVTCVK (EGFR A289V)
YVFGVTCVC

SEQ ID NO: 4039 - protein, 9 aa, Artificial Sequence
  Description of Artificial Sequence: Synthetic peptide
  Seed: YSFGVTCVK (EGFR A289V)
YVFGVTCVQ

SEQ ID NO: 4040 - protein, 8 aa, Artificial Sequence
  Description of Artificial Sequence: Synthetic peptide
  Seed: YSFGVTCV (EGFR A289V)
YVFGVTCY

SEQ ID NO: 4041 - protein, 9 aa, Artificial Sequence
  Description of Artificial Sequence: Synthetic peptide
  Seed: YSFGVTCVK (EGFR A289V)
YWFGVTCVF

SEQ ID NO: 4042 - protein, 9 aa, Artificial Sequence
  Description of Artificial Sequence: Synthetic peptide
  Seed: YSFGVTCVK (EGFR A289V)
YWFGVTCVY

SEQ ID NO: 4043 - protein, 11 aa, Homo sapiens
  Native (EGFR A289V)
FGVTCVKKCPR

SEQ ID NO: 4044 - protein, 11 aa, Homo sapiens
  Native (EGFR A289V)
GKYSFGVTCVK

SEQ ID NO: 4045 - protein, 9 aa, Homo sapiens
  Native (EGFR A289V)
KYSFGVTCV

SEQ ID NO: 4046 - protein, 10 aa, Homo sapiens
  Native (EGFR A289V)
KYSFGVTCVK

SEQ ID NO: 4047 - protein, 11 aa, Homo sapiens
  Native (EGFR A289V)
KYSFGVTCVKK

SEQ ID NO: 4048 - protein, 9 aa, Homo sapiens
  Native (EGFR A289V)
SFGVTCVKK

SEQ ID NO: 4049 - protein, 9 aa, Homo sapiens
  Native (EGFR A289V)
VTCVKKCPR

SEQ ID NO: 4050 - protein, 8 aa, Homo sapiens
  Native (EGFR A289V)
YSFGVTCV

SEQ ID NO: 4051 - protein, 9 aa, Homo sapiens
  Native (EGFR A289V)
YSFGVTCVK

SEQ ID NO: 4052 - protein, 10 aa, Homo sapiens
  Native (EGFR A289V)
YSFGVTCVKK

SEQ ID NO: 4053 - protein, 8 aa, Homo sapiens
  Native (EGFR A289V)
FGVTCVKK

SEQ ID NO: 4054 - protein, 9 aa, Homo sapiens
  Native (EGFR A289V)
GKYSFGVTC

SEQ ID NO: 4055 - protein, 11 aa, Homo sapiens
  Native (EGFR A289V)
VTCVKKCPRNY

SEQ ID NO: 4056 - protein, 9 aa, Artificial Sequence
  Description of Artificial Sequence: Synthetic peptide
  Seed: CVKTCPAVV (EGFR G598V)
CIKTCPAVV

SEQ ID NO: 4057 - protein, 9 aa, Artificial Sequence
  Description of Artificial Sequence: Synthetic peptide
  Seed: CVKTCPAVV (EGFR G598V)
CLKTCPAVA

SEQ ID NO: 4058 - protein, 9 aa, Artificial Sequence
  Description of Artificial Sequence: Synthetic peptide
  Seed: CVKTCPAVV (EGFR G598V)
CLKTCPAVI

SEQ ID NO: 4059 - protein, 9 aa, Artificial Sequence
  Description of Artificial Sequence: Synthetic peptide
  Seed: CVKTCPAVV (EGFR G598V)
CLKTCPAVL

SEQ ID NO: 4060 - protein, 9 aa, Artificial Sequence
  Description of Artificial Sequence: Synthetic peptide
  Seed: CVKTCPAVV (EGFR G598V)
CLKTCPAVM

SEQ ID NO: 4061 - protein, 9 aa, Artificial Sequence
  Description of Artificial Sequence: Synthetic peptide
  Seed: CVKTCPAVV (EGFR G598V)
CLKTCPAVT

SEQ ID NO: 4062 - protein, 9 aa, Artificial Sequence
  Description of Artificial Sequence: Synthetic peptide
  Seed: CVKTCPAVV (EGFR G598V)
CLKTCPAVV

SEQ ID NO: 4063 - protein, 9 aa, Artificial Sequence
  Description of Artificial Sequence: Synthetic peptide
  Seed: CVKTCPAVV (EGFR G598V)
CMKTCPAVA

SEQ ID NO: 4064 - protein, 9 aa, Artificial Sequence
  Description of Artificial Sequence: Synthetic peptide
  Seed: CVKTCPAVV (EGFR G598V)
CMKTCPAVI

SEQ ID NO: 4065 - protein, 9 aa, Artificial Sequence
  Description of Artificial Sequence: Synthetic peptide
  Seed: CVKTCPAVV (EGFR G598V)
CMKTCPAVL

SEQ ID NO: 4066 - protein, 9 aa, Artificial Sequence
  Description of Artificial Sequence: Synthetic peptide
  Seed: CVKTCPAVV (EGFR G598V)
CMKTCPAVM

SEQ ID NO: 4067 - protein, 9 aa, Artificial Sequence
  Description of Artificial Sequence: Synthetic peptide
  Seed: CVKTCPAVV (EGFR G598V)
CMKTCPAVV

SEQ ID NO: 4068 - protein, 9 aa, Artificial Sequence
  Description of Artificial Sequence: Synthetic peptide
  Seed: CVKTCPAVV (EGFR G598V)
CQKTCPAVV

SEQ ID NO: 4069 - protein, 9 aa, Artificial Sequence
  Description of Artificial Sequence: Synthetic peptide
  Seed: VVMGENNTL (EGFR G598V)
VAMGENNTF

SEQ ID NO: 4070 - protein, 9 aa, Artificial Sequence
  Description of Artificial Sequence: Synthetic peptide
  Seed: VVMGENNTL (EGFR G598V)
VAMGENNTI

SEQ ID NO: 4071 - protein, 10 aa, Artificial Sequence
  Description of Artificial Sequence: Synthetic peptide
  Seed: VVMGENNTLV (EGFR G598V)
VAMGENNTLL

SEQ ID NO: 4072 - protein, 10 aa, Artificial Sequence
  Description of Artificial Sequence: Synthetic peptide
  Seed: VVMGENNTLV (EGFR G598V)
VAMGENNTLV

SEQ ID NO: 4073 - protein, 11 aa, Artificial Sequence
  Description of Artificial Sequence: Synthetic peptide
  Seed: VVMGENNTLVW (EGFR G598V)
VAMGENNTLVF

SEQ ID NO: 4074 - protein, 11 aa, Artificial Sequence
  Description of Artificial Sequence: Synthetic peptide
  Seed: VVMGENNTLVW (EGFR G598V)
VAMGENNTLVL

SEQ ID NO: 4075 - protein, 11 aa, Artificial Sequence
  Description of Artificial Sequence: Synthetic peptide
  Seed: VVMGENNTLVW (EGFR G598V)
VAMGENNTLVM

SEQ ID NO: 4076 - protein, 11 aa, Artificial Sequence
  Description of Artificial Sequence: Synthetic peptide
  Seed: VVMGENNTLVW (EGFR G598V)
VAMGENNTLVW

SEQ ID NO: 4077 - protein, 11 aa, Artificial Sequence
  Description of Artificial Sequence: Synthetic peptide
  Seed: VVMGENNTLVW (EGFR G598V)
VAMGENNTLVY

SEQ ID NO: 4078 - protein, 9 aa, Artificial Sequence
  Description of Artificial Sequence: Synthetic peptide
  Seed: VVMGENNTL (EGFR G598V)
VAMGENNTV

SEQ ID NO: 4079 - protein, 9 aa, Artificial Sequence
  Description of Artificial Sequence: Synthetic peptide
  Seed: VVMGENNTL (EGFR G598V)
VAMGENNTW

SEQ ID NO: 4080 - protein, 9 aa, Artificial Sequence
  Description of Artificial Sequence: Synthetic peptide
  Seed: VVMGENNTL (EGFR G598V)
VAMGENNTY

SEQ ID NO: 4081 - protein, 9 aa, Artificial Sequence
  Description of Artificial Sequence: Synthetic peptide
  Seed: VKTCPAVVM (EGFR G598V)
VATCPAVVF

SEQ ID NO: 4082 - protein, 9 aa, Artificial Sequence
  Description of Artificial Sequence: Synthetic peptide
  Seed: VKTCPAVVM (EGFR G598V)
VATCPAVVM

SEQ ID NO: 4083 - protein, 9 aa, Artificial Sequence
  Description of Artificial Sequence: Synthetic peptide
  Seed: VKTCPAVVM (EGFR G598V)
VATCPAVVY

SEQ ID NO: 4084 - protein, 10 aa, Artificial Sequence
  Description of Artificial Sequence: Synthetic peptide
  Seed: VVMGENNTLV (EGFR G598V)
VCMGENNTLL

SEQ ID NO: 4085 - protein, 10 aa, Artificial Sequence
  Description of Artificial Sequence: Synthetic peptide
  Seed: VVMGENNTLV (EGFR G598V)
VCMGENNTLV

SEQ ID NO: 4086 - protein, 11 aa, Artificial Sequence
  Description of Artificial Sequence: Synthetic peptide
  Seed: VVMGENNTLVW (EGFR G598V)
VCMGENNTLVW

SEQ ID NO: 4087 - protein, 10 aa, Artificial Sequence
  Description of Artificial Sequence: Synthetic peptide
  Seed: VVMGENNTLV (EGFR G598V)
VDMGENNTLL

SEQ ID NO: 4088 - protein, 10 aa, Artificial Sequence
  Description of Artificial Sequence: Synthetic peptide
  Seed: VVMGENNTLV (EGFR G598V)
VDMGENNTLV

SEQ ID NO: 4089 - protein, 10 aa, Artificial Sequence
  Description of Artificial Sequence: Synthetic peptide
  Seed: VVMGENNTLV (EGFR G598V)
VEMGENNTLL

SEQ ID NO: 4090 - protein, 10 aa, Artificial Sequence
  Description of Artificial Sequence: Synthetic peptide
  Seed: VVMGENNTLV (EGFR G598V)
VEMGENNTLV

SEQ ID NO: 4091 - protein, 9 aa, Artificial Sequence
  Description of Artificial Sequence: Synthetic peptide
  Seed: VKTCPAVVM (EGFR G598V)
VETCPAVVF

SEQ ID NO: 4092 - protein, 9 aa, Artificial Sequence
  Description of Artificial Sequence: Synthetic peptide
  Seed: VKTCPAVVM (EGFR G598V)
VETCPAVVM

SEQ ID NO: 4093 - protein, 9 aa, Artificial Sequence
  Description of Artificial Sequence: Synthetic peptide
  Seed: VKTCPAVVM (EGFR G598V)
VETCPAVVY

SEQ ID NO: 4094 - protein, 10 aa, Artificial Sequence
  Description of Artificial Sequence: Synthetic peptide
  Seed: VVMGENNTLV (EGFR G598V)
VFMGENNTLA

SEQ ID NO: 4095 - protein, 10 aa, Artificial Sequence
  Description of Artificial Sequence: Synthetic peptide
  Seed: VVMGENNTLV (EGFR G598V)
VFMGENNTLI

SEQ ID NO: 4096 - protein, 10 aa, Artificial Sequence
  Description of Artificial Sequence: Synthetic peptide
  Seed: VVMGENNTLV (EGFR G598V)
VFMGENNTLL

SEQ ID NO: 4097 - protein, 10 aa, Artificial Sequence
  Description of Artificial Sequence: Synthetic peptide
  Seed: VVMGENNTLV (EGFR G598V)
VFMGENNTLM

SEQ ID NO: 4098 - protein, 10 aa, Artificial Sequence
  Description of Artificial Sequence: Synthetic peptide
  Seed: VVMGENNTLV (EGFR G598V)
VFMGENNTLV

SEQ ID NO: 4099 - protein, 9 aa, Artificial Sequence
  Description of Artificial Sequence: Synthetic peptide
  Seed: VKTCPAVVM (EGFR G598V)
VFTCPAVVF

SEQ ID NO: 4100 - protein, 9 aa, Artificial Sequence
  Description of Artificial Sequence: Synthetic peptide
  Seed: VKTCPAVVM (EGFR G598V)
VFTCPAVVY

SEQ ID NO: 4101 - protein, 9 aa, Artificial Sequence
  Description of Artificial Sequence: Synthetic peptide
  Seed: VVMGENNTL (EGFR G598V)
VGMGENNTF

SEQ ID NO: 4102 - protein, 10 aa, Artificial Sequence
  Description of Artificial Sequence: Synthetic peptide
  Seed: VVMGENNTLV (EGFR G598V)
VGMGENNTLL

SEQ ID NO: 4103 - protein, 10 aa, Artificial Sequence
  Description of Artificial Sequence: Synthetic peptide
  Seed: VVMGENNTLV (EGFR G598V)
VGMGENNTLV

SEQ ID NO: 4104 - protein, 11 aa, Artificial Sequence
  Description of Artificial Sequence: Synthetic peptide
  Seed: VVMGENNTLVW (EGFR G598V)
VGMGENNTLVW

SEQ ID NO: 4105 - protein, 9 aa, Artificial Sequence
  Description of Artificial Sequence: Synthetic peptide
  Seed: VVMGENNTL (EGFR G598V)
VGMGENNTM

SEQ ID NO: 4106 - protein, 9 aa, Artificial Sequence
  Description of Artificial Sequence: Synthetic peptide
  Seed: VVMGENNTL (EGFR G598V)
VGMGENNTY

SEQ ID NO: 4107 - protein, 9 aa, Artificial Sequence
  Description of Artificial Sequence: Synthetic peptide
  Seed: VKTCPAVVM (EGFR G598V)
VGTCPAVVF

SEQ ID NO: 4108 - protein, 9 aa, Artificial Sequence
  Description of Artificial Sequence: Synthetic peptide
  Seed: VKTCPAVVM (EGFR G598V)
VGTCPAVVY

SEQ ID NO: 4109 - protein, 10 aa, Artificial Sequence
  Description of Artificial Sequence: Synthetic peptide
  Seed: VVMGENNTLV (EGFR G598V)
VHMGENNTLL

SEQ ID NO: 4110 - protein, 10 aa, Artificial Sequence
  Description of Artificial Sequence: Synthetic peptide
  Seed: VVMGENNTLV (EGFR G598V)
VHMGENNTLV

SEQ ID NO: 4111 - protein, 9 aa, Artificial Sequence
  Description of Artificial Sequence: Synthetic peptide
  Seed: VKTCPAVVM (EGFR G598V)
VHTCPAVVF

SEQ ID NO: 4112 - protein, 9 aa, Artificial Sequence
  Description of Artificial Sequence: Synthetic peptide
  Seed: VKTCPAVVM (EGFR G598V)
VHTCPAVVL

SEQ ID NO: 4113 - protein, 9 aa, Artificial Sequence
  Description of Artificial Sequence: Synthetic peptide
  Seed: VKTCPAVVM (EGFR G598V)
VHTCPAVVM

SEQ ID NO: 4114 - protein, 9 aa, Artificial Sequence
  Description of Artificial Sequence: Synthetic peptide
  Seed: VKTCPAVVM (EGFR G598V)
VHTCPAVVY

SEQ ID NO: 4115 - protein, 9 aa, Artificial Sequence
  Description of Artificial Sequence: Synthetic peptide
  Seed: VVMGENNTL (EGFR G598V)
VIMGENNTF

SEQ ID NO: 4116 - protein, 9 aa, Artificial Sequence
  Description of Artificial Sequence: Synthetic peptide
  Seed: VVMGENNTL (EGFR G598V)
VIMGENNTI

SEQ ID NO: 4117 - protein, 9 aa, Artificial Sequence
  Description of Artificial Sequence: Synthetic peptide
  Seed: VVMGENNTL (EGFR G598V)
VIMGENNTL

SEQ ID NO: 4118 - protein, 10 aa, Artificial Sequence
  Description of Artificial Sequence: Synthetic peptide
  Seed: VVMGENNTLV (EGFR G598V)
VIMGENNTLI

SEQ ID NO: 4119 - protein, 10 aa, Artificial Sequence
  Description of Artificial Sequence: Synthetic peptide
  Seed: VVMGENNTLV (EGFR G598V)
VIMGENNTLL

SEQ ID NO: 4120 - protein, 10 aa, Artificial Sequence
  Description of Artificial Sequence: Synthetic peptide
  Seed: VVMGENNTLV (EGFR G598V)
VIMGENNTLV

SEQ ID NO: 4121 - protein, 11 aa, Artificial Sequence
  Description of Artificial Sequence: Synthetic peptide
  Seed: VVMGENNTLVW (EGFR G598V)
VIMGENNTLVW

SEQ ID NO: 4122 - protein, 9 aa, Artificial Sequence
  Description of Artificial Sequence: Synthetic peptide
  Seed: VVMGENNTL (EGFR G598V)
VIMGENNTM

SEQ ID NO: 4123 - protein, 9 aa, Artificial Sequence
  Description of Artificial Sequence: Synthetic peptide
  Seed: VVMGENNTL (EGFR G598V)
VIMGENNTV

SEQ ID NO: 4124 - protein, 9 aa, Artificial Sequence
  Description of Artificial Sequence: Synthetic peptide
  Seed: VVMGENNTL (EGFR G598V)
VIMGENNTY

SEQ ID NO: 4125 - protein, 9 aa, Artificial Sequence
  Description of Artificial Sequence: Synthetic peptide
  Seed: VKTCPAVVM (EGFR G598V)
VITCPAVVF

SEQ ID NO: 4126 - protein, 9 aa, Artificial Sequence
  Description of Artificial Sequence: Synthetic peptide
  Seed: VKTCPAVVM (EGFR G598V)
VITCPAVVM

SEQ ID NO: 4127 - protein, 9 aa, Artificial Sequence
  Description of Artificial Sequence: Synthetic peptide
  Seed: VKTCPAVVM (EGFR G598V)
VITCPAVVY

SEQ ID NO: 4128 - protein, 10 aa, Artificial Sequence
  Description of Artificial Sequence: Synthetic peptide
  Seed: VVMGENNTLV (EGFR G598V)
VKMGENNTLL

SEQ ID NO: 4129 - protein, 10 aa, Artificial Sequence
  Description of Artificial Sequence: Synthetic peptide
  Seed: VVMGENNTLV (EGFR G598V)
VKMGENNTLV

SEQ ID NO: 4130 - protein, 9 aa, Artificial Sequence
  Description of Artificial Sequence: Synthetic peptide
  Seed: VKTCPAVVM (EGFR G598V)
VKTCPAVVF

SEQ ID NO: 4131 - protein, 9 aa, Artificial Sequence
  Description of Artificial Sequence: Synthetic peptide
  Seed: VKTCPAVVM (EGFR G598V)
VKTCPAVVI

SEQ ID NO: 4132 - protein, 9 aa, Artificial Sequence
  Description of Artificial Sequence: Synthetic peptide
  Seed: VKTCPAVVM (EGFR G598V)
VKTCPAVVL

SEQ ID NO: 4133 - protein, 9 aa, Artificial Sequence
  Description of Artificial Sequence: Synthetic peptide
  Seed: VKTCPAVVM (EGFR G598V)
VKTCPAVVW

SEQ ID NO: 4134 - protein, 9 aa, Artificial Sequence
  Description of Artificial Sequence: Synthetic peptide
  Seed: VKTCPAVVM (EGFR G598V)
VKTCPAVVY

SEQ ID NO: 4135 - protein, 9 aa, Artificial Sequence
  Description of Artificial Sequence: Synthetic peptide
  Seed: VVMGENNTL (EGFR G598V)
VLMGENNTA

SEQ ID NO: 4136 - protein, 9 aa, Artificial Sequence
  Description of Artificial Sequence: Synthetic peptide
  Seed: VVMGENNTL (EGFR G598V)
VLMGENNTC

SEQ ID NO: 4137 - protein, 9 aa, Artificial Sequence
  Description of Artificial Sequence: Synthetic peptide
  Seed: VVMGENNTL (EGFR G598V)
VLMGENNTF

SEQ ID NO: 4138 - protein, 9 aa, Artificial Sequence
  Description of Artificial Sequence: Synthetic peptide
  Seed: VVMGENNTL (EGFR G598V)
VLMGENNTI

SEQ ID NO: 4139 - protein, 9 aa, Artificial Sequence
  Description of Artificial Sequence: Synthetic peptide
  Seed: VVMGENNTL (EGFR G598V)
VLMGENNTL

SEQ ID NO: 4140 - protein, 10 aa, Artificial Sequence
  Description of Artificial Sequence: Synthetic peptide
  Seed: VVMGENNTLV (EGFR G598V)
VLMGENNTLA

SEQ ID NO: 4141 - protein, 10 aa, Artificial Sequence
  Description of Artificial Sequence: Synthetic peptide
  Seed: VVMGENNTLV (EGFR G598V)
VLMGENNTLC

SEQ ID NO: 4142 - protein, 10 aa, Artificial Sequence
  Description of Artificial Sequence: Synthetic peptide
  Seed: VVMGENNTLV (EGFR G598V)
VLMGENNTLD

SEQ ID NO: 4143 - protein, 10 aa, Artificial Sequence
  Description of Artificial Sequence: Synthetic peptide
  Seed: VVMGENNTLV (EGFR G598V)
VLMGENNTLE

SEQ ID NO: 4144 - protein, 10 aa, Artificial Sequence
  Description of Artificial Sequence: Synthetic peptide
  Seed: VVMGENNTLV (EGFR G598V)
VLMGENNTLF

SEQ ID NO: 4145 - protein, 10 aa, Artificial Sequence
  Description of Artificial Sequence: Synthetic peptide
  Seed: VVMGENNTLV (EGFR G598V)
VLMGENNTLG

SEQ ID NO: 4146 - protein, 10 aa, Artificial Sequence
  Description of Artificial Sequence: Synthetic peptide
  Seed: VVMGENNTLV (EGFR G598V)
VLMGENNTLH

SEQ ID NO: 4147 - protein, 10 aa, Artificial Sequence
  Description of Artificial Sequence: Synthetic peptide
  Seed: VVMGENNTLV (EGFR G598V)
VLMGENNTLI

SEQ ID NO: 4148 - protein, 10 aa, Artificial Sequence
  Description of Artificial Sequence: Synthetic peptide
  Seed: VVMGENNTLV (EGFR G598V)
VLMGENNTLK

SEQ ID NO: 4149 - protein, 10 aa, Artificial Sequence
  Description of Artificial Sequence: Synthetic peptide
  Seed: VVMGENNTLV (EGFR G598V)
VLMGENNTLL

SEQ ID NO: 4150 - protein, 10 aa, Artificial Sequence
  Description of Artificial Sequence: Synthetic peptide
  Seed: VVMGENNTLV (EGFR G598V)
VLMGENNTLM

SEQ ID NO: 4151 - protein, 10 aa, Artificial Sequence
  Description of Artificial Sequence: Synthetic peptide
  Seed: VVMGENNTLV (EGFR G598V)
VLMGENNTLN

SEQ ID NO: 4152 - protein, 10 aa, Artificial Sequence
  Description of Artificial Sequence: Synthetic peptide
  Seed: VVMGENNTLV (EGFR G598V)
VLMGENNTLP

SEQ ID NO: 4153 - protein, 10 aa, Artificial Sequence
  Description of Artificial Sequence: Synthetic peptide
  Seed: VVMGENNTLV (EGFR G598V)
VLMGENNTLQ

SEQ ID NO: 4154 - protein, 10 aa, Artificial Sequence
  Description of Artificial Sequence: Synthetic peptide
  Seed: VVMGENNTLV (EGFR G598V)
VLMGENNTLR

SEQ ID NO: 4155 - protein, 10 aa, Artificial Sequence
  Description of Artificial Sequence: Synthetic peptide
  Seed: VVMGENNTLV (EGFR G598V)
VLMGENNTLS

SEQ ID NO: 4156 - protein, 10 aa, Artificial Sequence
  Description of Artificial Sequence: Synthetic peptide
  Seed: VVMGENNTLV (EGFR G598V)
VLMGENNTLT

SEQ ID NO: 4157 - protein, 10 aa, Artificial Sequence
  Description of Artificial Sequence: Synthetic peptide
  Seed: VVMGENNTLV (EGFR G598V)
VLMGENNTLV

SEQ ID NO: 4158 - protein, 11 aa, Artificial Sequence
  Description of Artificial Sequence: Synthetic peptide
  Seed: VVMGENNTLVW (EGFR G598V)
VLMGENNTLVW

SEQ ID NO: 4159 - protein, 10 aa, Artificial Sequence
  Description of Artificial Sequence: Synthetic peptide
  Seed: VVMGENNTLV (EGFR G598V)
VLMGENNTLW

SEQ ID NO: 4160 - protein, 10 aa, Artificial Sequence
  Description of Artificial Sequence: Synthetic peptide
  Seed: VVMGENNTLV (EGFR G598V)
VLMGENNTLY

SEQ ID NO: 4161 - protein, 9 aa, Artificial Sequence
  Description of Artificial Sequence: Synthetic peptide
  Seed: VVMGENNTL (EGFR G598V)
VLMGENNTM

SEQ ID NO: 4162 - protein, 9 aa, Artificial Sequence
  Description of Artificial Sequence: Synthetic peptide
  Seed: VVMGENNTL (EGFR G598V)
VLMGENNTT

SEQ ID NO: 4163 - protein, 9 aa, Artificial Sequence
  Description of Artificial Sequence: Synthetic peptide
  Seed: VVMGENNTL (EGFR G598V)
VLMGENNTV

SEQ ID NO: 4164 - protein, 9 aa, Artificial Sequence
  Description of Artificial Sequence: Synthetic peptide
  Seed: VVMGENNTL (EGFR G598V)
VLMGENNTY

SEQ ID NO: 4165 - protein, 9 aa, Artificial Sequence
  Description of Artificial Sequence: Synthetic peptide
  Seed: VKTCPAVVM (EGFR G598V)
VLTCPAVVF

SEQ ID NO: 4166 - protein, 9 aa, Artificial Sequence
  Description of Artificial Sequence: Synthetic peptide
  Seed: VKTCPAVVM (EGFR G598V)
VLTCPAVVM

SEQ ID NO: 4167 - protein, 9 aa, Artificial Sequence
  Description of Artificial Sequence: Synthetic peptide
  Seed: VKTCPAVVM (EGFR G598V)
VLTCPAVVY

SEQ ID NO: 4168 - protein, 9 aa, Artificial Sequence
  Description of Artificial Sequence: Synthetic peptide
  Seed: VVMGENNTL (EGFR G598V)
VMMGENNTA

SEQ ID NO: 4169 - protein, 9 aa, Artificial Sequence
  Description of Artificial Sequence: Synthetic peptide
  Seed: VVMGENNTL (EGFR G598V)
VMMGENNTC

SEQ ID NO: 4170 - protein, 9 aa, Artificial Sequence
  Description of Artificial Sequence: Synthetic peptide
  Seed: VVMGENNTL (EGFR G598V)
VMMGENNTF

SEQ ID NO: 4171 - protein, 9 aa, Artificial Sequence
  Description of Artificial Sequence: Synthetic peptide
  Seed: VVMGENNTL (EGFR G598V)
VMMGENNTI

SEQ ID NO: 4172 - protein, 9 aa, Artificial Sequence
  Description of Artificial Sequence: Synthetic peptide
  Seed: VVMGENNTL (EGFR G598V)
VMMGENNTL

SEQ ID NO: 4173 - protein, 10 aa, Artificial Sequence
  Description of Artificial Sequence: Synthetic peptide
  Seed: VVMGENNTLV (EGFR G598V)
VMMGENNTLA

SEQ ID NO: 4174 - protein, 10 aa, Artificial Sequence
  Description of Artificial Sequence: Synthetic peptide
  Seed: VVMGENNTLV (EGFR G598V)
VMMGENNTLC

SEQ ID NO: 4175 - protein, 10 aa, Artificial Sequence
  Description of Artificial Sequence: Synthetic peptide
  Seed: VVMGENNTLV (EGFR G598V)
VMMGENNTLF

SEQ ID NO: 4176 - protein, 10 aa, Artificial Sequence
  Description of Artificial Sequence: Synthetic peptide
  Seed: VVMGENNTLV (EGFR G598V)
VMMGENNTLI

SEQ ID NO: 4177 - protein, 10 aa, Artificial Sequence
  Description of Artificial Sequence: Synthetic peptide
  Seed: VVMGENNTLV (EGFR G598V)
VMMGENNTLL

SEQ ID NO: 4178 - protein, 10 aa, Artificial Sequence
  Description of Artificial Sequence: Synthetic peptide
  Seed: VVMGENNTLV (EGFR G598V)
VMMGENNTLM

SEQ ID NO: 4179 - protein, 10 aa, Artificial Sequence
  Description of Artificial Sequence: Synthetic peptide
  Seed: VVMGENNTLV (EGFR G598V)
VMMGENNTLT

SEQ ID NO: 4180 - protein, 11 aa, Artificial Sequence
  Description of Artificial Sequence: Synthetic peptide
  Seed: VVMGENNTLVW (EGFR G598V)
VMMGENNTLVW

SEQ ID NO: 4181 - protein, 9 aa, Artificial Sequence
  Description of Artificial Sequence: Synthetic peptide
  Seed: VVMGENNTL (EGFR G598V)
VMMGENNTM

SEQ ID NO: 4182 - protein, 9 aa, Artificial Sequence
  Description of Artificial Sequence: Synthetic peptide
  Seed: VVMGENNTL (EGFR G598V)
VMMGENNTT

SEQ ID NO: 4183 - protein, 9 aa, Artificial Sequence
  Description of Artificial Sequence: Synthetic peptide
  Seed: VVMGENNTL (EGFR G598V)
VMMGENNTY

SEQ ID NO: 4184 - protein, 9 aa, Artificial Sequence
  Description of Artificial Sequence: Synthetic peptide
  Seed: VKTCPAVVM (EGFR G598V)
VMTCPAVVF

SEQ ID NO: 4185 - protein, 9 aa, Artificial Sequence
  Description of Artificial Sequence: Synthetic peptide
  Seed: VKTCPAVVM (EGFR G598V)
VMTCPAVVH

SEQ ID NO: 4186 - protein, 9 aa, Artificial Sequence
  Description of Artificial Sequence: Synthetic peptide
  Seed: VKTCPAVVM (EGFR G598V)
VMTCPAVVI

SEQ ID NO: 4187 - protein, 9 aa, Artificial Sequence
  Description of Artificial Sequence: Synthetic peptide
  Seed: VKTCPAVVM (EGFR G598V)
VMTCPAVVL

SEQ ID NO: 4188 - protein, 9 aa, Artificial Sequence
  Description of Artificial Sequence: Synthetic peptide
  Seed: VKTCPAVVM (EGFR G598V)
VMTCPAVVM

SEQ ID NO: 4189 - protein, 9 aa, Artificial Sequence
  Description of Artificial Sequence: Synthetic peptide
  Seed: VKTCPAVVM (EGFR G598V)
VMTCPAVVV

SEQ ID NO: 4190 - protein, 9 aa, Artificial Sequence
  Description of Artificial Sequence: Synthetic peptide
  Seed: VKTCPAVVM (EGFR G598V)
VMTCPAVVW

SEQ ID NO: 4191 - protein, 9 aa, Artificial Sequence
  Description of Artificial Sequence: Synthetic peptide
  Seed: VKTCPAVVM (EGFR G598V)
VMTCPAVVY

SEQ ID NO: 4192 - protein, 10 aa, Artificial Sequence
  Description of Artificial Sequence: Synthetic peptide
  Seed: VVMGENNTLV (EGFR G598V)
VNMGENNTLL

SEQ ID NO: 4193 - protein, 10 aa, Artificial Sequence
  Description of Artificial Sequence: Synthetic peptide
  Seed: VVMGENNTLV (EGFR G598V)
VNMGENNTLV

SEQ ID NO: 4194 - protein, 11 aa, Artificial Sequence
  Description of Artificial Sequence: Synthetic peptide
  Seed: VVMGENNTLVW (EGFR G598V)
VNMGENNTLVW

SEQ ID NO: 4195 - protein, 9 aa, Artificial Sequence
  Description of Artificial Sequence: Synthetic peptide
  Seed: VKTCPAVVM (EGFR G598V)
VNTCPAVVF

SEQ ID NO: 4196 - protein, 9 aa, Artificial Sequence
  Description of Artificial Sequence: Synthetic peptide
  Seed: VKTCPAVVM (EGFR G598V)
VNTCPAVVY

SEQ ID NO: 4197 - protein, 10 aa, Artificial Sequence
  Description of Artificial Sequence: Synthetic peptide
  Seed: VVMGENNTLV (EGFR G598V)
VPMGENNTLL

SEQ ID NO: 4198 - protein, 10 aa, Artificial Sequence
  Description of Artificial Sequence: Synthetic peptide
  Seed: VVMGENNTLV (EGFR G598V)
VPMGENNTLV

SEQ ID NO: 4199 - protein, 9 aa, Artificial Sequence
  Description of Artificial Sequence: Synthetic peptide
  Seed: VVMGENNTL (EGFR G598V)
VQMGENNTA

SEQ ID NO: 4200 - protein, 9 aa, Artificial Sequence
  Description of Artificial Sequence: Synthetic peptide
  Seed: VVMGENNTL (EGFR G598V)
VQMGENNTF

SEQ ID NO: 4201 - protein, 9 aa, Artificial Sequence
  Description of Artificial Sequence: Synthetic peptide
  Seed: VVMGENNTL (EGFR G598V)
VQMGENNTI

SEQ ID NO: 4202 - protein, 9 aa, Artificial Sequence
  Description of Artificial Sequence: Synthetic peptide
  Seed: VVMGENNTL (EGFR G598V)
VQMGENNTL

SEQ ID NO: 4203 - protein, 10 aa, Artificial Sequence
  Description of Artificial Sequence: Synthetic peptide
  Seed: VVMGENNTLV (EGFR G598V)
VQMGENNTLI

SEQ ID NO: 4204 - protein, 10 aa, Artificial Sequence
  Description of Artificial Sequence: Synthetic peptide
  Seed: VVMGENNTLV (EGFR G598V)
VQMGENNTLL

SEQ ID NO: 4205 - protein, 10 aa, Artificial Sequence
  Description of Artificial Sequence: Synthetic peptide
  Seed: VVMGENNTLV (EGFR G598V)
VQMGENNTLM

SEQ ID NO: 4206 - protein, 10 aa, Artificial Sequence
  Description of Artificial Sequence: Synthetic peptide
  Seed: VVMGENNTLV (EGFR G598V)
VQMGENNTLV

SEQ ID NO: 4207 - protein, 11 aa, Artificial Sequence
  Description of Artificial Sequence: Synthetic peptide
  Seed: VVMGENNTLVW (EGFR G598V)
VQMGENNTLVW

SEQ ID NO: 4208 - protein, 9 aa, Artificial Sequence
  Description of Artificial Sequence: Synthetic peptide
  Seed: VVMGENNTL (EGFR G598V)
VQMGENNTM

SEQ ID NO: 4209 - protein, 9 aa, Artificial Sequence
  Description of Artificial Sequence: Synthetic peptide
  Seed: VVMGENNTL (EGFR G598V)
VQMGENNTV

SEQ ID NO: 4210 - protein, 9 aa, Artificial Sequence
  Description of Artificial Sequence: Synthetic peptide
  Seed: VVMGENNTL (EGFR G598V)
VQMGENNTY

SEQ ID NO: 4211 - protein, 9 aa, Artificial Sequence
  Description of Artificial Sequence: Synthetic peptide
  Seed: VKTCPAVVM (EGFR G598V)
VQTCPAVVA

SEQ ID NO: 4212 - protein, 9 aa, Artificial Sequence
  Description of Artificial Sequence: Synthetic peptide
  Seed: VKTCPAVVM (EGFR G598V)
VQTCPAVVH

SEQ ID NO: 4213 - protein, 9 aa, Artificial Sequence
  Description of Artificial Sequence: Synthetic peptide
  Seed: VKTCPAVVM (EGFR G598V)
VQTCPAVVI

SEQ ID NO: 4214 - protein, 9 aa, Artificial Sequence
  Description of Artificial Sequence: Synthetic peptide
  Seed: VKTCPAVVM (EGFR G598V)
VQTCPAVVM

SEQ ID NO: 4215 - protein, 9 aa, Artificial Sequence
  Description of Artificial Sequence: Synthetic peptide
  Seed: VKTCPAVVM (EGFR G598V)
VQTCPAVVV

SEQ ID NO: 4216 - protein, 9 aa, Artificial Sequence
  Description of Artificial Sequence: Synthetic peptide
  Seed: VKTCPAVVM (EGFR G598V)
VQTCPAVVW

SEQ ID NO: 4217 - protein, 9 aa, Artificial Sequence
  Description of Artificial Sequence: Synthetic peptide
  Seed: VKTCPAVVM (EGFR G598V)
VQTCPAVVY

SEQ ID NO: 4218 - protein, 10 aa, Artificial Sequence
  Description of Artificial Sequence: Synthetic peptide
  Seed: VVMGENNTLV (EGFR G598V)
VRMGENNTLL

SEQ ID NO: 4219 - protein, 10 aa, Artificial Sequence
  Description of Artificial Sequence: Synthetic peptide
  Seed: VVMGENNTLV (EGFR G598V)
VRMGENNTLV

SEQ ID NO: 4220 - protein, 9 aa, Artificial Sequence
  Description of Artificial Sequence: Synthetic peptide
  Seed: VKTCPAVVM (EGFR G598V)
VRTCPAVVF

SEQ ID NO: 4221 - protein, 9 aa, Artificial Sequence
  Description of Artificial Sequence: Synthetic peptide
  Seed: VKTCPAVVM (EGFR G598V)
VRTCPAVVM

SEQ ID NO: 4222 - protein, 9 aa, Artificial Sequence
  Description of Artificial Sequence: Synthetic peptide
  Seed: VKTCPAVVM (EGFR G598V)
VRTCPAVVY

SEQ ID NO: 4223 - protein, 9 aa, Artificial Sequence
  Description of Artificial Sequence: Synthetic peptide
  Seed: VVMGENNTL (EGFR G598V)
VSMGENNTF

SEQ ID NO: 4224 - protein, 9 aa, Artificial Sequence
  Description of Artificial Sequence: Synthetic peptide
  Seed: VVMGENNTL (EGFR G598V)
VSMGENNTI

SEQ ID NO: 4225 - protein, 9 aa, Artificial Sequence
  Description of Artificial Sequence: Synthetic peptide
  Seed: VVMGENNTL (EGFR G598V)
VSMGENNTL

SEQ ID NO: 4226 - protein, 10 aa, Artificial Sequence
  Description of Artificial Sequence: Synthetic peptide
  Seed: VVMGENNTLV (EGFR G598V)
VSMGENNTLL

SEQ ID NO: 4227 - protein, 10 aa, Artificial Sequence
  Description of Artificial Sequence: Synthetic peptide
  Seed: VVMGENNTLV (EGFR G598V)
VSMGENNTLV

SEQ ID NO: 4228 - protein, 11 aa, Artificial Sequence
  Description of Artificial Sequence: Synthetic peptide
  Seed: VVMGENNTLVW (EGFR G598V)
VSMGENNTLVF

SEQ ID NO: 4229 - protein, 11 aa, Artificial Sequence
  Description of Artificial Sequence: Synthetic peptide
  Seed: VVMGENNTLVW (EGFR G598V)
VSMGENNTLVI

SEQ ID NO: 4230 - protein, 11 aa, Artificial Sequence
  Description of Artificial Sequence: Synthetic peptide
  Seed: VVMGENNTLVW (EGFR G598V)
VSMGENNTLVL

SEQ ID NO: 4231 - protein, 11 aa, Artificial Sequence
  Description of Artificial Sequence: Synthetic peptide
  Seed: VVMGENNTLVW (EGFR G598V)
VSMGENNTLVM

SEQ ID NO: 4232 - protein, 11 aa, Artificial Sequence
  Description of Artificial Sequence: Synthetic peptide
  Seed: VVMGENNTLVW (EGFR G598V)
VSMGENNTLVY

SEQ ID NO: 4233 - protein, 9 aa, Artificial Sequence
  Description of Artificial Sequence: Synthetic peptide
  Seed: VVMGENNTL (EGFR G598V)
VSMGENNTV

SEQ ID NO: 4234 - protein, 9 aa, Artificial Sequence
  Description of Artificial Sequence: Synthetic peptide
  Seed: VVMGENNTL (EGFR G598V)
VSMGENNTY

SEQ ID NO: 4235 - protein, 9 aa, Artificial Sequence
  Description of Artificial Sequence: Synthetic peptide
  Seed: VKTCPAVVM (EGFR G598V)
VSTCPAVVM

SEQ ID NO: 4236 - protein, 9 aa, Artificial Sequence
  Description of Artificial Sequence: Synthetic peptide
  Seed: VKTCPAVVM (EGFR G598V)
VSTCPAVVY

SEQ ID NO: 4237 - protein, 9 aa, Artificial Sequence
  Description of Artificial Sequence: Synthetic peptide
  Seed: VVMGENNTL (EGFR G598V)
VTMGENNTF

SEQ ID NO: 4238 - protein, 9 aa, Artificial Sequence
  Description of Artificial Sequence: Synthetic peptide
  Seed: VVMGENNTL (EGFR G598V)
VTMGENNTI

SEQ ID NO: 4239 - protein, 9 aa, Artificial Sequence
  Description of Artificial Sequence: Synthetic peptide
  Seed: VVMGENNTL (EGFR G598V)
VTMGENNTL

SEQ ID NO: 4240 - protein, 10 aa, Artificial Sequence
  Description of Artificial Sequence: Synthetic peptide
  Seed: VVMGENNTLV (EGFR G598V)
VTMGENNTLL

SEQ ID NO: 4241 - protein, 10 aa, Artificial Sequence
  Description of Artificial Sequence: Synthetic peptide
  Seed: VVMGENNTLV (EGFR G598V)
VTMGENNTLV

SEQ ID NO: 4242 - protein, 11 aa, Artificial Sequence
  Description of Artificial Sequence: Synthetic peptide
  Seed: VVMGENNTLVW (EGFR G598V)
VTMGENNTLVF

SEQ ID NO: 4243 - protein, 11 aa, Artificial Sequence
  Description of Artificial Sequence: Synthetic peptide
  Seed: VVMGENNTLVW (EGFR G598V)
VTMGENNTLVI

SEQ ID NO: 4244 - protein, 11 aa, Artificial Sequence
  Description of Artificial Sequence: Synthetic peptide
  Seed: VVMGENNTLVW (EGFR G598V)
VTMGENNTLVL

SEQ ID NO: 4245 - protein, 11 aa, Artificial Sequence
  Description of Artificial Sequence: Synthetic peptide
  Seed: VVMGENNTLVW (EGFR G598V)
VTMGENNTLVM

SEQ ID NO: 4246 - protein, 11 aa, Artificial Sequence
  Description of Artificial Sequence: Synthetic peptide
  Seed: VVMGENNTLVW (EGFR G598V)
VTMGENNTLVY

SEQ ID NO: 4247 - protein, 9 aa, Artificial Sequence
  Description of Artificial Sequence: Synthetic peptide
  Seed: VVMGENNTL (EGFR G598V)
VTMGENNTM

SEQ ID NO: 4248 - protein, 9 aa, Artificial Sequence
  Description of Artificial Sequence: Synthetic peptide
  Seed: VVMGENNTL (EGFR G598V)
VTMGENNTY

SEQ ID NO: 4249 - protein, 9 aa, Artificial Sequence
  Description of Artificial Sequence: Synthetic peptide
  Seed: VKTCPAVVM (EGFR G598V)
VTTCPAVVF

SEQ ID NO: 4250 - protein, 9 aa, Artificial Sequence
  Description of Artificial Sequence: Synthetic peptide
  Seed: VKTCPAVVM (EGFR G598V)
VTTCPAVVM

SEQ ID NO: 4251 - protein, 9 aa, Artificial Sequence
  Description of Artificial Sequence: Synthetic peptide
  Seed: VKTCPAVVM (EGFR G598V)
VTTCPAVVY

SEQ ID NO: 4252 - protein, 9 aa, Artificial Sequence
  Description of Artificial Sequence: Synthetic peptide
  Seed: VVMGENNTL (EGFR G598V)
VVMGENNTF

SEQ ID NO: 4253 - protein, 9 aa, Artificial Sequence
  Description of Artificial Sequence: Synthetic peptide
  Seed: VVMGENNTL (EGFR G598V)
VVMGENNTI

SEQ ID NO: 4254 - protein, 10 aa, Artificial Sequence
  Description of Artificial Sequence: Synthetic peptide
  Seed: VVMGENNTLV (EGFR G598V)
VVMGENNTLI

SEQ ID NO: 4255 - protein, 10 aa, Artificial Sequence
  Description of Artificial Sequence: Synthetic peptide
  Seed: VVMGENNTLV (EGFR G598V)
VVMGENNTLL

SEQ ID NO: 4256 - protein, 11 aa, Artificial Sequence
  Description of Artificial Sequence: Synthetic peptide
  Seed: VVMGENNTLVW (EGFR G598V)
VVMGENNTLVF

SEQ ID NO: 4257 - protein, 11 aa, Artificial Sequence
  Description of Artificial Sequence: Synthetic peptide
  Seed: VVMGENNTLVW (EGFR G598V)
VVMGENNTLVY

SEQ ID NO: 4258 - protein, 9 aa, Artificial Sequence
  Description of Artificial Sequence: Synthetic peptide
  Seed: VVMGENNTL (EGFR G598V)
VVMGENNTM

SEQ ID NO: 4259 - protein, 9 aa, Artificial Sequence
  Description of Artificial Sequence: Synthetic peptide
  Seed: VVMGENNTL (EGFR G598V)
VVMGENNTV

SEQ ID NO: 4260 - protein, 9 aa, Artificial Sequence
  Description of Artificial Sequence: Synthetic peptide
  Seed: VVMGENNTL (EGFR G598V)
VVMGENNTY

SEQ ID NO: 4261 - protein, 9 aa, Artificial Sequence
  Description of Artificial Sequence: Synthetic peptide
  Seed: VKTCPAVVM (EGFR G598V)
VVTCPAVVF

SEQ ID NO: 4262 - protein, 9 aa, Artificial Sequence
  Description of Artificial Sequence: Synthetic peptide
  Seed: VKTCPAVVM (EGFR G598V)
VVTCPAVVM

SEQ ID NO: 4263 - protein, 9 aa, Artificial Sequence
  Description of Artificial Sequence: Synthetic peptide
  Seed: VKTCPAVVM (EGFR G598V)
VVTCPAVVY

SEQ ID NO: 4264 - protein, 10 aa, Artificial Sequence
  Description of Artificial Sequence: Synthetic peptide
  Seed: VVMGENNTLV (EGFR G598V)
VWMGENNTLI

SEQ ID NO: 4265 - protein, 10 aa, Artificial Sequence
  Description of Artificial Sequence: Synthetic peptide
  Seed: VVMGENNTLV (EGFR G598V)
VWMGENNTLL

SEQ ID NO: 4266 - protein, 10 aa, Artificial Sequence
  Description of Artificial Sequence: Synthetic peptide
  Seed: VVMGENNTLV (EGFR G598V)
VWMGENNTLV

SEQ ID NO: 4267 - protein, 10 aa, Artificial Sequence
  Description of Artificial Sequence: Synthetic peptide
  Seed: VVMGENNTLV (EGFR G598V)
VYMGENNTLI

SEQ ID NO: 4268 - protein, 10 aa, Artificial Sequence
  Description of Artificial Sequence: Synthetic peptide
  Seed: VVMGENNTLV (EGFR G598V)
VYMGENNTLL

SEQ ID NO: 4269 - protein, 10 aa, Artificial Sequence
  Description of Artificial Sequence: Synthetic peptide
  Seed: VVMGENNTLV (EGFR G598V)
VYMGENNTLM

SEQ ID NO: 4270 - protein, 10 aa, Artificial Sequence
  Description of Artificial Sequence: Synthetic peptide
  Seed: VVMGENNTLV (EGFR G598V)
VYMGENNTLV

SEQ ID NO: 4271 - protein, 9 aa, Artificial Sequence
  Description of Artificial Sequence: Synthetic peptide
  Seed: VKTCPAVVM (EGFR G598V)
VYTCPAVVF

SEQ ID NO: 4272 - protein, 9 aa, Artificial Sequence
  Description of Artificial Sequence: Synthetic peptide
  Seed: VKTCPAVVM (EGFR G598V)
VYTCPAVVY

SEQ ID NO: 4273 - protein, 9 aa, Artificial Sequence
  Description of Artificial Sequence: Synthetic peptide
  Seed: CVKTCPAVV (EGFR G598V)
CAKTCPAVA

SEQ ID NO: 4274 - protein, 9 aa, Artificial Sequence
  Description of Artificial Sequence: Synthetic peptide
  Seed: CVKTCPAVV (EGFR G598V)
CAKTCPAVC

SEQ ID NO: 4275 - protein, 9 aa, Artificial Sequence
  Description of Artificial Sequence: Synthetic peptide
  Seed: CVKTCPAVV (EGFR G598V)
CAKTCPAVF

SEQ ID NO: 4276 - protein, 9 aa, Artificial Sequence
  Description of Artificial Sequence: Synthetic peptide
  Seed: CVKTCPAVV (EGFR G598V)
CAKTCPAVH

SEQ ID NO: 4277 - protein, 9 aa, Artificial Sequence
  Description of Artificial Sequence: Synthetic peptide
  Seed: CVKTCPAVV (EGFR G598V)
CAKTCPAVI

SEQ ID NO: 4278 - protein, 9 aa, Artificial Sequence
  Description of Artificial Sequence: Synthetic peptide
  Seed: CVKTCPAVV (EGFR G598V)
CAKTCPAVK

SEQ ID NO: 4279 - protein, 9 aa, Artificial Sequence
  Description of Artificial Sequence: Synthetic peptide
  Seed: CVKTCPAVV (EGFR G598V)
CAKTCPAVL

SEQ ID NO: 4280 - protein, 9 aa, Artificial Sequence
  Description of Artificial Sequence: Synthetic peptide
  Seed: CVKTCPAVV (EGFR G598V)
CAKTCPAVM

SEQ ID NO: 4281 - protein, 9 aa, Artificial Sequence
  Description of Artificial Sequence: Synthetic peptide
  Seed: CVKTCPAVV (EGFR G598V)
CAKTCPAVT

SEQ ID NO: 4282 - protein, 9 aa, Artificial Sequence
  Description of Artificial Sequence: Synthetic peptide
  Seed: CVKTCPAVV (EGFR G598V)
CAKTCPAVV

SEQ ID NO: 4283 - protein, 10 aa, Artificial Sequence
  Description of Artificial Sequence: Synthetic peptide
  Seed: CVKTCPAVVM (EGFR G598V)
CAKTCPAVVF

SEQ ID NO: 4284 - protein, 10 aa, Artificial Sequence
  Description of Artificial Sequence: Synthetic peptide
  Seed: CVKTCPAVVM (EGFR G598V)
CAKTCPAVVH

SEQ ID NO: 4285 - protein, 10 aa, Artificial Sequence
  Description of Artificial Sequence: Synthetic peptide
  Seed: CVKTCPAVVM (EGFR G598V)
CAKTCPAVVL

SEQ ID NO: 4286 - protein, 10 aa, Artificial Sequence
  Description of Artificial Sequence: Synthetic peptide
  Seed: CVKTCPAVVM (EGFR G598V)
CAKTCPAVVM

SEQ ID NO: 4287 - protein, 10 aa, Artificial Sequence
  Description of Artificial Sequence: Synthetic peptide
  Seed: CVKTCPAVVM (EGFR G598V)
CAKTCPAVVY

SEQ ID NO: 4288 - protein, 9 aa, Artificial Sequence
  Description of Artificial Sequence: Synthetic peptide
  Seed: CVKTCPAVV (EGFR G598V)
CAKTCPAVW

SEQ ID NO: 4289 - protein, 9 aa, Artificial Sequence
  Description of Artificial Sequence: Synthetic peptide
  Seed: CVKTCPAVV (EGFR G598V)
CAKTCPAVY

SEQ ID NO: 4290 - protein, 9 aa, Artificial Sequence
  Description of Artificial Sequence: Synthetic peptide
  Seed: CVKTCPAVV (EGFR G598V)
CCKTCPAVF

SEQ ID NO: 4291 - protein, 9 aa, Artificial Sequence
  Description of Artificial Sequence: Synthetic peptide
  Seed: CVKTCPAVV (EGFR G598V)
CCKTCPAVM

SEQ ID NO: 4292 - protein, 9 aa, Artificial Sequence
  Description of Artificial Sequence: Synthetic peptide
  Seed: CVKTCPAVV (EGFR G598V)
CCKTCPAVY

SEQ ID NO: 4293 - protein, 9 aa, Artificial Sequence
  Description of Artificial Sequence: Synthetic peptide
  Seed: CVKTCPAVV (EGFR G598V)
CDKTCPAVY

SEQ ID NO: 4294 - protein, 9 aa, Artificial Sequence
  Description of Artificial Sequence: Synthetic peptide
  Seed: CVKTCPAVV (EGFR G598V)
CEKTCPAVF

SEQ ID NO: 4295 - protein, 9 aa, Artificial Sequence
  Description of Artificial Sequence: Synthetic peptide
  Seed: CVKTCPAVV (EGFR G598V)
CEKTCPAVI

SEQ ID NO: 4296 - protein, 9 aa, Artificial Sequence
  Description of Artificial Sequence: Synthetic peptide
  Seed: CVKTCPAVV (EGFR G598V)
CEKTCPAVL

SEQ ID NO: 4297 - protein, 9 aa, Artificial Sequence
  Description of Artificial Sequence: Synthetic peptide
  Seed: CVKTCPAVV (EGFR G598V)
CEKTCPAVV

SEQ ID NO: 4298 - protein, 9 aa, Artificial Sequence
  Description of Artificial Sequence: Synthetic peptide
  Seed: CVKTCPAVV (EGFR G598V)
CEKTCPAVY

SEQ ID NO: 4299 - protein, 9 aa, Artificial Sequence
  Description of Artificial Sequence: Synthetic peptide
  Seed: CVKTCPAVV (EGFR G598V)
CFKTCPAVF

SEQ ID NO: 4300 - protein, 9 aa, Artificial Sequence
  Description of Artificial Sequence: Synthetic peptide
  Seed: CVKTCPAVV (EGFR G598V)
CFKTCPAVM

SEQ ID NO: 4301 - protein, 9 aa, Artificial Sequence
  Description of Artificial Sequence: Synthetic peptide
  Seed: CVKTCPAVV (EGFR G598V)
CFKTCPAVY

SEQ ID NO: 4302 - protein, 9 aa, Artificial Sequence
  Description of Artificial Sequence: Synthetic peptide
  Seed: CVKTCPAVV (EGFR G598V)
CGKTCPAVF

SEQ ID NO: 4303 - protein, 9 aa, Artificial Sequence
  Description of Artificial Sequence: Synthetic peptide
  Seed: CVKTCPAVV (EGFR G598V)
CGKTCPAVH

SEQ ID NO: 4304 - protein, 9 aa, Artificial Sequence
  Description of Artificial Sequence: Synthetic peptide
  Seed: CVKTCPAVV (EGFR G598V)
CGKTCPAVL

SEQ ID NO: 4305 - protein, 9 aa, Artificial Sequence
  Description of Artificial Sequence: Synthetic peptide
  Seed: CVKTCPAVV (EGFR G598V)
CGKTCPAVM

SEQ ID NO: 4306 - protein, 10 aa, Artificial Sequence
  Description of Artificial Sequence: Synthetic peptide
  Seed: CVKTCPAVVM (EGFR G598V)
CGKTCPAVVY

SEQ ID NO: 4307 - protein, 9 aa, Artificial Sequence
  Description of Artificial Sequence: Synthetic peptide
  Seed: CVKTCPAVV (EGFR G598V)
CGKTCPAVY

SEQ ID NO: 4308 - protein, 9 aa, Artificial Sequence
  Description of Artificial Sequence: Synthetic peptide
  Seed: CVKTCPAVV (EGFR G598V)
CIKTCPAVF

SEQ ID NO: 4309 - protein, 9 aa, Artificial Sequence
  Description of Artificial Sequence: Synthetic peptide
  Seed: CVKTCPAVV (EGFR G598V)
CIKTCPAVH

SEQ ID NO: 4310 - protein, 9 aa, Artificial Sequence
  Description of Artificial Sequence: Synthetic peptide
  Seed: CVKTCPAVV (EGFR G598V)
CIKTCPAVI

SEQ ID NO: 4311 - protein, 9 aa, Artificial Sequence
  Description of Artificial Sequence: Synthetic peptide
  Seed: CVKTCPAVV (EGFR G598V)
CIKTCPAVL

SEQ ID NO: 4312 - protein, 9 aa, Artificial Sequence
  Description of Artificial Sequence: Synthetic peptide
  Seed: CVKTCPAVV (EGFR G598V)
CIKTCPAVM

SEQ ID NO: 4313 - protein, 10 aa, Artificial Sequence
  Description of Artificial Sequence: Synthetic peptide
  Seed: CVKTCPAVVM (EGFR G598V)
CIKTCPAVVF

SEQ ID NO: 4314 - protein, 10 aa, Artificial Sequence
  Description of Artificial Sequence: Synthetic peptide
  Seed: CVKTCPAVVM (EGFR G598V)
CIKTCPAVVY

SEQ ID NO: 4315 - protein, 9 aa, Artificial Sequence
  Description of Artificial Sequence: Synthetic peptide
  Seed: CVKTCPAVV (EGFR G598V)
CIKTCPAVY

SEQ ID NO: 4316 - protein, 9 aa, Artificial Sequence
  Description of Artificial Sequence: Synthetic peptide
  Seed: CVKTCPAVV (EGFR G598V)
CLKTCPAVF

SEQ ID NO: 4317 - protein, 9 aa, Artificial Sequence
  Description of Artificial Sequence: Synthetic peptide
  Seed: CVKTCPAVV (EGFR G598V)
CLKTCPAVH

SEQ ID NO: 4318 - protein, 10 aa, Artificial Sequence
  Description of Artificial Sequence: Synthetic peptide
  Seed: CVKTCPAVVM (EGFR G598V)
CLKTCPAVVY

SEQ ID NO: 4319 - protein, 9 aa, Artificial Sequence
  Description of Artificial Sequence: Synthetic peptide
  Seed: CVKTCPAVV (EGFR G598V)
CLKTCPAVY

SEQ ID NO: 4320 - protein, 9 aa, Artificial Sequence
  Description of Artificial Sequence: Synthetic peptide
  Seed: CVKTCPAVV (EGFR G598V)
CMKTCPAVF

SEQ ID NO: 4321 - protein, 9 aa, Artificial Sequence
  Description of Artificial Sequence: Synthetic peptide
  Seed: CVKTCPAVV (EGFR G598V)
CMKTCPAVH

SEQ ID NO: 4322 - protein, 10 aa, Artificial Sequence
  Description of Artificial Sequence: Synthetic peptide
  Seed: CVKTCPAVVM (EGFR G598V)
CMKTCPAVVF

SEQ ID NO: 4323 - protein, 10 aa, Artificial Sequence
  Description of Artificial Sequence: Synthetic peptide
  Seed: CVKTCPAVVM (EGFR G598V)
CMKTCPAVVY

SEQ ID NO: 4324 - protein, 9 aa, Artificial Sequence
  Description of Artificial Sequence: Synthetic peptide
  Seed: CVKTCPAVV (EGFR G598V)
CMKTCPAVY

SEQ ID NO: 4325 - protein, 9 aa, Artificial Sequence
  Description of Artificial Sequence: Synthetic peptide
  Seed: CVKTCPAVV (EGFR G598V)
CNKTCPAVF

SEQ ID NO: 4326 - protein, 9 aa, Artificial Sequence
  Description of Artificial Sequence: Synthetic peptide
  Seed: CVKTCPAVV (EGFR G598V)
CNKTCPAVM

SEQ ID NO: 4327 - protein, 9 aa, Artificial Sequence
  Description of Artificial Sequence: Synthetic peptide
  Seed: CVKTCPAVV (EGFR G598V)
CNKTCPAVY

SEQ ID NO: 4328 - protein, 9 aa, Artificial Sequence
  Description of Artificial Sequence: Synthetic peptide
  Seed: CVKTCPAVV (EGFR G598V)
CPKTCPAVA

SEQ ID NO: 4329 - protein, 9 aa, Artificial Sequence
  Description of Artificial Sequence: Synthetic peptide
  Seed: CVKTCPAVV (EGFR G598V)
CPKTCPAVC

SEQ ID NO: 4330 - protein, 9 aa, Artificial Sequence
  Description of Artificial Sequence: Synthetic peptide
  Seed: CVKTCPAVV (EGFR G598V)
CPKTCPAVF

SEQ ID NO: 4331 - protein, 9 aa, Artificial Sequence
  Description of Artificial Sequence: Synthetic peptide
  Seed: CVKTCPAVV (EGFR G598V)
CPKTCPAVI

SEQ ID NO: 4332 - protein, 9 aa, Artificial Sequence
  Description of Artificial Sequence: Synthetic peptide
  Seed: CVKTCPAVV (EGFR G598V)
CPKTCPAVL

SEQ ID NO: 4333 - protein, 9 aa, Artificial Sequence
  Description of Artificial Sequence: Synthetic peptide
  Seed: CVKTCPAVV (EGFR G598V)
CPKTCPAVM

SEQ ID NO: 4334 - protein, 9 aa, Artificial Sequence
  Description of Artificial Sequence: Synthetic peptide
  Seed: CVKTCPAVV (EGFR G598V)
CPKTCPAVP

SEQ ID NO: 4335 - protein, 9 aa, Artificial Sequence
  Description of Artificial Sequence: Synthetic peptide
  Seed: CVKTCPAVV (EGFR G598V)
CPKTCPAVS

SEQ ID NO: 4336 - protein, 9 aa, Artificial Sequence
  Description of Artificial Sequence: Synthetic peptide
  Seed: CVKTCPAVV (EGFR G598V)
CPKTCPAVT

SEQ ID NO: 4337 - protein, 9 aa, Artificial Sequence
  Description of Artificial Sequence: Synthetic peptide
  Seed: CVKTCPAVV (EGFR G598V)
CPKTCPAVV

SEQ ID NO: 4338 - protein, 9 aa, Artificial Sequence
  Description of Artificial Sequence: Synthetic peptide
  Seed: CVKTCPAVV (EGFR G598V)
CPKTCPAVW

SEQ ID NO: 4339 - protein, 9 aa, Artificial Sequence
  Description of Artificial Sequence: Synthetic peptide
  Seed: CVKTCPAVV (EGFR G598V)
CPKTCPAVY

SEQ ID NO: 4340 - protein, 9 aa, Artificial Sequence
  Description of Artificial Sequence: Synthetic peptide
  Seed: CVKTCPAVV (EGFR G598V)
CQKTCPAVF

SEQ ID NO: 4341 - protein, 9 aa, Artificial Sequence
  Description of Artificial Sequence: Synthetic peptide
  Seed: CVKTCPAVV (EGFR G598V)
CQKTCPAVH

SEQ ID NO: 4342 - protein, 9 aa, Artificial Sequence
  Description of Artificial Sequence: Synthetic peptide
  Seed: CVKTCPAVV (EGFR G598V)
CQKTCPAVI

SEQ ID NO: 4343 - protein, 9 aa, Artificial Sequence
  Description of Artificial Sequence: Synthetic peptide
  Seed: CVKTCPAVV (EGFR G598V)
CQKTCPAVL

SEQ ID NO: 4344 - protein, 9 aa, Artificial Sequence
  Description of Artificial Sequence: Synthetic peptide
  Seed: CVKTCPAVV (EGFR G598V)
CQKTCPAVM

SEQ ID NO: 4345 - protein, 10 aa, Artificial Sequence
  Description of Artificial Sequence: Synthetic peptide
  Seed: CVKTCPAVVM (EGFR G598V)
CQKTCPAVVY

SEQ ID NO: 4346 - protein, 9 aa, Artificial Sequence
  Description of Artificial Sequence: Synthetic peptide
  Seed: CVKTCPAVV (EGFR G598V)
CQKTCPAVY

SEQ ID NO: 4347 - protein, 9 aa, Artificial Sequence
  Description of Artificial Sequence: Synthetic peptide
  Seed: CVKTCPAVV (EGFR G598V)
CSKTCPAVA

SEQ ID NO: 4348 - protein, 9 aa, Artificial Sequence
  Description of Artificial Sequence: Synthetic peptide
  Seed: CVKTCPAVV (EGFR G598V)
CSKTCPAVF

SEQ ID NO: 4349 - protein, 9 aa, Artificial Sequence
  Description of Artificial Sequence: Synthetic peptide
  Seed: CVKTCPAVV (EGFR G598V)
CSKTCPAVH

SEQ ID NO: 4350 - protein, 9 aa, Artificial Sequence
  Description of Artificial Sequence: Synthetic peptide
  Seed: CVKTCPAVV (EGFR G598V)
CSKTCPAVI

SEQ ID NO: 4351 - protein, 9 aa, Artificial Sequence
  Description of Artificial Sequence: Synthetic peptide
  Seed: CVKTCPAVV (EGFR G598V)
CSKTCPAVL

SEQ ID NO: 4352 - protein, 9 aa, Artificial Sequence
  Description of Artificial Sequence: Synthetic peptide
  Seed: CVKTCPAVV (EGFR G598V)
CSKTCPAVM

SEQ ID NO: 4353 - protein, 9 aa, Artificial Sequence
  Description of Artificial Sequence: Synthetic peptide
  Seed: CVKTCPAVV (EGFR G598V)
CSKTCPAVV

SEQ ID NO: 4354 - protein, 10 aa, Artificial Sequence
  Description of Artificial Sequence: Synthetic peptide
  Seed: CVKTCPAVVM (EGFR G598V)
CSKTCPAVVF

SEQ ID NO: 4355 - protein, 10 aa, Artificial Sequence
  Description of Artificial Sequence: Synthetic peptide
  Seed: CVKTCPAVVM (EGFR G598V)
CSKTCPAVVL

SEQ ID NO: 4356 - protein, 10 aa, Artificial Sequence
  Description of Artificial Sequence: Synthetic peptide
  Seed: CVKTCPAVVM (EGFR G598V)
CSKTCPAVVM

SEQ ID NO: 4357 - protein, 10 aa, Artificial Sequence
  Description of Artificial Sequence: Synthetic peptide
  Seed: CVKTCPAVVM (EGFR G598V)
CSKTCPAVVY

SEQ ID NO: 4358 - protein, 9 aa, Artificial Sequence
  Description of Artificial Sequence: Synthetic peptide
  Seed: CVKTCPAVV (EGFR G598V)
CSKTCPAVY

SEQ ID NO: 4359 - protein, 9 aa, Artificial Sequence
  Description of Artificial Sequence: Synthetic peptide
  Seed: CVKTCPAVV (EGFR G598V)
CTKTCPAVF

SEQ ID NO: 4360 - protein, 9 aa, Artificial Sequence
  Description of Artificial Sequence: Synthetic peptide
  Seed: CVKTCPAVV (EGFR G598V)
CTKTCPAVH

SEQ ID NO: 4361 - protein, 9 aa, Artificial Sequence
  Description of Artificial Sequence: Synthetic peptide
  Seed: CVKTCPAVV (EGFR G598V)
CTKTCPAVI

SEQ ID NO: 4362 - protein, 9 aa, Artificial Sequence
  Description of Artificial Sequence: Synthetic peptide
  Seed: CVKTCPAVV (EGFR G598V)
CTKTCPAVL

SEQ ID NO: 4363 - protein, 9 aa, Artificial Sequence
  Description of Artificial Sequence: Synthetic peptide
  Seed: CVKTCPAVV (EGFR G598V)
CTKTCPAVM

SEQ ID NO: 4364 - protein, 9 aa, Artificial Sequence
  Description of Artificial Sequence: Synthetic peptide
  Seed: CVKTCPAVV (EGFR G598V)
CTKTCPAVV

SEQ ID NO: 4365 - protein, 10 aa, Artificial Sequence
  Description of Artificial Sequence: Synthetic peptide
  Seed: CVKTCPAVVM (EGFR G598V)
CTKTCPAVVF

SEQ ID NO: 4366 - protein, 10 aa, Artificial Sequence
  Description of Artificial Sequence: Synthetic peptide
  Seed: CVKTCPAVVM (EGFR G598V)
CTKTCPAVVM

SEQ ID NO: 4367 - protein, 10 aa, Artificial Sequence
  Description of Artificial Sequence: Synthetic peptide
  Seed: CVKTCPAVVM (EGFR G598V)
CTKTCPAVVY

SEQ ID NO: 4368 - protein, 9 aa, Artificial Sequence
  Description of Artificial Sequence: Synthetic peptide
  Seed: CVKTCPAVV (EGFR G598V)
CTKTCPAVY

SEQ ID NO: 4369 - protein, 9 aa, Artificial Sequence
  Description of Artificial Sequence: Synthetic peptide
  Seed: CVKTCPAVV (EGFR G598V)
CVKTCPAVA

SEQ ID NO: 4370 - protein, 9 aa, Artificial Sequence
  Description of Artificial Sequence: Synthetic peptide
  Seed: CVKTCPAVV (EGFR G598V)
CVKTCPAVF

SEQ ID NO: 4371 - protein, 9 aa, Artificial Sequence
  Description of Artificial Sequence: Synthetic peptide
  Seed: CVKTCPAVV (EGFR G598V)
CVKTCPAVH

SEQ ID NO: 4372 - protein, 9 aa, Artificial Sequence
  Description of Artificial Sequence: Synthetic peptide
  Seed: CVKTCPAVV (EGFR G598V)
CVKTCPAVI

SEQ ID NO: 4373 - protein, 9 aa, Artificial Sequence
  Description of Artificial Sequence: Synthetic peptide
  Seed: CVKTCPAVV (EGFR G598V)
CVKTCPAVL

SEQ ID NO: 4374 - protein, 9 aa, Artificial Sequence
  Description of Artificial Sequence: Synthetic peptide
  Seed: CVKTCPAVV (EGFR G598V)
CVKTCPAVM

SEQ ID NO: 4375 - protein, 10 aa, Artificial Sequence
  Description of Artificial Sequence: Synthetic peptide
  Seed: CVKTCPAVVM (EGFR G598V)
CVKTCPAVVF

SEQ ID NO: 4376 - protein, 10 aa, Artificial Sequence
  Description of Artificial Sequence: Synthetic peptide
  Seed: CVKTCPAVVM (EGFR G598V)
CVKTCPAVVY

SEQ ID NO: 4377 - protein, 9 aa, Artificial Sequence
  Description of Artificial Sequence: Synthetic peptide
  Seed: CVKTCPAVV (EGFR G598V)
CVKTCPAVY

SEQ ID NO: 4378 - protein, 9 aa, Artificial Sequence
  Description of Artificial Sequence: Synthetic peptide
  Seed: CVKTCPAVV (EGFR G598V)
CYKTCPAVY

SEQ ID NO: 4379 - protein, 8 aa, Artificial Sequence
  Description of Artificial Sequence: Synthetic peptide
  Seed: KTCPAVVM (EGFR G598V)
KACPAVVA

SEQ ID NO: 4380 - protein, 8 aa, Artificial Sequence
  Description of Artificial Sequence: Synthetic peptide
  Seed: KTCPAVVM (EGFR G598V)
KACPAVVF

SEQ ID NO: 4381 - protein, 8 aa, Artificial Sequence
  Description of Artificial Sequence: Synthetic peptide
  Seed: KTCPAVVM (EGFR G598V)
KACPAVVH

SEQ ID NO: 4382 - protein, 8 aa, Artificial Sequence
  Description of Artificial Sequence: Synthetic peptide
  Seed: KTCPAVVM (EGFR G598V)
KACPAVVI

SEQ ID NO: 4383 - protein, 8 aa, Artificial Sequence
  Description of Artificial Sequence: Synthetic peptide
  Seed: KTCPAVVM (EGFR G598V)
KACPAVVK

SEQ ID NO: 4384 - protein, 8 aa, Artificial Sequence
  Description of Artificial Sequence: Synthetic peptide
  Seed: KTCPAVVM (EGFR G598V)
KACPAVVL

SEQ ID NO: 4385 - protein, 8 aa, Artificial Sequence
  Description of Artificial Sequence: Synthetic peptide
  Seed: KTCPAVVM (EGFR G598V)
KACPAVVM

SEQ ID NO: 4386 - protein, 8 aa, Artificial Sequence
  Description of Artificial Sequence: Synthetic peptide
  Seed: KTCPAVVM (EGFR G598V)
KACPAVVV

SEQ ID NO: 4387 - protein, 8 aa, Artificial Sequence
  Description of Artificial Sequence: Synthetic peptide
  Seed: KTCPAVVM (EGFR G598V)
KACPAVVW

SEQ ID NO: 4388 - protein, 8 aa, Artificial Sequence
  Description of Artificial Sequence: Synthetic peptide
  Seed: KTCPAVVM (EGFR G598V)
KACPAVVY

SEQ ID NO: 4389 - protein, 8 aa, Artificial Sequence
  Description of Artificial Sequence: Synthetic peptide
  Seed: KTCPAVVM (EGFR G598V)
KCCPAVVF

SEQ ID NO: 4390 - protein, 8 aa, Artificial Sequence
  Description of Artificial Sequence: Synthetic peptide
  Seed: KTCPAVVM (EGFR G598V)
KCCPAVVL

SEQ ID NO: 4391 - protein, 8 aa, Artificial Sequence
  Description of Artificial Sequence: Synthetic peptide
  Seed: KTCPAVVM (EGFR G598V)
KCCPAVVW

SEQ ID NO: 4392 - protein, 8 aa, Artificial Sequence
  Description of Artificial Sequence: Synthetic peptide
  Seed: KTCPAVVM (EGFR G598V)
KDCPAVVW

SEQ ID NO: 4393 - protein, 8 aa, Artificial Sequence
  Description of Artificial Sequence: Synthetic peptide
  Seed: KTCPAVVM (EGFR G598V)
KGCPAVVF

SEQ ID NO: 4394 - protein, 8 aa, Artificial Sequence
  Description of Artificial Sequence: Synthetic peptide
  Seed: KTCPAVVM (EGFR G598V)
KGCPAVVL

SEQ ID NO: 4395 - protein, 8 aa, Artificial Sequence
  Description of Artificial Sequence: Synthetic peptide
  Seed: KTCPAVVM (EGFR G598V)
KGCPAVVM

SEQ ID NO: 4396 - protein, 8 aa, Artificial Sequence
  Description of Artificial Sequence: Synthetic peptide
  Seed: KTCPAVVM (EGFR G598V)
KGCPAVVW

SEQ ID NO: 4397 - protein, 8 aa, Artificial Sequence
  Description of Artificial Sequence: Synthetic peptide
  Seed: KTCPAVVM (EGFR G598V)
KGCPAVVY

SEQ ID NO: 4398 - protein, 8 aa, Artificial Sequence
  Description of Artificial Sequence: Synthetic peptide
  Seed: KTCPAVVM (EGFR G598V)
KICPAVVF

SEQ ID NO: 4399 - protein, 8 aa, Artificial Sequence
  Description of Artificial Sequence: Synthetic peptide
  Seed: KTCPAVVM (EGFR G598V)
KICPAVVI

SEQ ID NO: 4400 - protein, 8 aa, Artificial Sequence
  Description of Artificial Sequence: Synthetic peptide
  Seed: KTCPAVVM (EGFR G598V)
KICPAVVL

SEQ ID NO: 4401 - protein, 8 aa, Artificial Sequence
  Description of Artificial Sequence: Synthetic peptide
  Seed: KTCPAVVM (EGFR G598V)
KICPAVVM

SEQ ID NO: 4402 - protein, 8 aa, Artificial Sequence
  Description of Artificial Sequence: Synthetic peptide
  Seed: KTCPAVVM (EGFR G598V)
KICPAVVV

SEQ ID NO: 4403 - protein, 8 aa, Artificial Sequence
  Description of Artificial Sequence: Synthetic peptide
  Seed: KTCPAVVM (EGFR G598V)
KICPAVVW

SEQ ID NO: 4404 - protein, 8 aa, Artificial Sequence
  Description of Artificial Sequence: Synthetic peptide
  Seed: KTCPAVVM (EGFR G598V)
KICPAVVY

SEQ ID NO: 4405 - protein, 8 aa, Artificial Sequence
  Description of Artificial Sequence: Synthetic peptide
  Seed: KTCPAVVM (EGFR G598V)
KLCPAVVL

SEQ ID NO: 4406 - protein, 8 aa, Artificial Sequence
  Description of Artificial Sequence: Synthetic peptide
  Seed: KTCPAVVM (EGFR G598V)
KLCPAVVW

SEQ ID NO: 4407 - protein, 8 aa, Artificial Sequence
  Description of Artificial Sequence: Synthetic peptide
  Seed: KTCPAVVM (EGFR G598V)
KLCPAVVY

SEQ ID NO: 4408 - protein, 8 aa, Artificial Sequence
  Description of Artificial Sequence: Synthetic peptide
  Seed: KTCPAVVM (EGFR G598V)
KMCPAVVF

SEQ ID NO: 4409 - protein, 8 aa, Artificial Sequence
  Description of Artificial Sequence: Synthetic peptide
  Seed: KTCPAVVM (EGFR G598V)
KMCPAVVL

SEQ ID NO: 4410 - protein, 8 aa, Artificial Sequence
  Description of Artificial Sequence: Synthetic peptide
  Seed: KTCPAVVM (EGFR G598V)
KMCPAVVW

SEQ ID NO: 4411 - protein, 8 aa, Artificial Sequence
  Description of Artificial Sequence: Synthetic peptide
  Seed: KTCPAVVM (EGFR G598V)
KMCPAVVY

SEQ ID NO: 4412 - protein, 8 aa, Artificial Sequence
  Description of Artificial Sequence: Synthetic peptide
  Seed: KTCPAVVM (EGFR G598V)
KNCPAVVL

SEQ ID NO: 4413 - protein, 8 aa, Artificial Sequence
  Description of Artificial Sequence: Synthetic peptide
  Seed: KTCPAVVM (EGFR G598V)
KNCPAVVW

SEQ ID NO: 4414 - protein, 8 aa, Artificial Sequence
  Description of Artificial Sequence: Synthetic peptide
  Seed: KTCPAVVM (EGFR G598V)
KNCPAVVY

SEQ ID NO: 4415 - protein, 8 aa, Artificial Sequence
  Description of Artificial Sequence: Synthetic peptide
  Seed: KTCPAVVM (EGFR G598V)
KPCPAVVW

SEQ ID NO: 4416 - protein, 8 aa, Artificial Sequence
  Description of Artificial Sequence: Synthetic peptide
  Seed: KTCPAVVM (EGFR G598V)
KQCPAVVL

SEQ ID NO: 4417 - protein, 8 aa, Artificial Sequence
  Description of Artificial Sequence: Synthetic peptide
  Seed: KTCPAVVM (EGFR G598V)
KQCPAVVW

SEQ ID NO: 4418 - protein, 8 aa, Artificial Sequence
  Description of Artificial Sequence: Synthetic peptide
  Seed: KTCPAVVM (EGFR G598V)
KQCPAVVY

SEQ ID NO: 4419 - protein, 8 aa, Artificial Sequence
  Description of Artificial Sequence: Synthetic peptide
  Seed: KTCPAVVM (EGFR G598V)
KSCPAVVF

SEQ ID NO: 4420 - protein, 8 aa, Artificial Sequence
  Description of Artificial Sequence: Synthetic peptide
  Seed: KTCPAVVM (EGFR G598V)
KSCPAVVH

SEQ ID NO: 4421 - protein, 8 aa, Artificial Sequence
  Description of Artificial Sequence: Synthetic peptide
  Seed: KTCPAVVM (EGFR G598V)
KSCPAVVI

SEQ ID NO: 4422 - protein, 8 aa, Artificial Sequence
  Description of Artificial Sequence: Synthetic peptide
  Seed: KTCPAVVM (EGFR G598V)
KSCPAVVL

SEQ ID NO: 4423 - protein, 8 aa, Artificial Sequence
  Description of Artificial Sequence: Synthetic peptide
  Seed: KTCPAVVM (EGFR G598V)
KSCPAVVM

SEQ ID NO: 4424 - protein, 8 aa, Artificial Sequence
  Description of Artificial Sequence: Synthetic peptide
  Seed: KTCPAVVM (EGFR G598V)
KSCPAVVV

SEQ ID NO: 4425 - protein, 8 aa, Artificial Sequence
  Description of Artificial Sequence: Synthetic peptide
  Seed: KTCPAVVM (EGFR G598V)
KSCPAVVW

SEQ ID NO: 4426 - protein, 8 aa, Artificial Sequence
  Description of Artificial Sequence: Synthetic peptide
  Seed: KTCPAVVM (EGFR G598V)
KSCPAVVY

SEQ ID NO: 4427 - protein, 8 aa, Artificial Sequence
  Description of Artificial Sequence: Synthetic peptide
  Seed: KTCPAVVM (EGFR G598V)
KTCPAVVF

SEQ ID NO: 4428 - protein, 8 aa, Artificial Sequence
  Description of Artificial Sequence: Synthetic peptide
  Seed: KTCPAVVM (EGFR G598V)
KTCPAVVI

SEQ ID NO: 4429 - protein, 8 aa, Artificial Sequence
  Description of Artificial Sequence: Synthetic peptide
  Seed: KTCPAVVM (EGFR G598V)
KTCPAVVL

SEQ ID NO: 4430 - protein, 8 aa, Artificial Sequence
  Description of Artificial Sequence: Synthetic peptide
  Seed: KTCPAVVM (EGFR G598V)
KTCPAVVV

SEQ ID NO: 4431 - protein, 8 aa, Artificial Sequence
  Description of Artificial Sequence: Synthetic peptide
  Seed: KTCPAVVM (EGFR G598V)
KTCPAVVW

SEQ ID NO: 4432 - protein, 8 aa, Artificial Sequence
  Description of Artificial Sequence: Synthetic peptide
  Seed: KTCPAVVM (EGFR G598V)
KTCPAVVY

SEQ ID NO: 4433 - protein, 8 aa, Artificial Sequence
  Description of Artificial Sequence: Synthetic peptide
  Seed: KTCPAVVM (EGFR G598V)
KVCPAVVF

SEQ ID NO: 4434 - protein, 8 aa, Artificial Sequence
  Description of Artificial Sequence: Synthetic peptide
  Seed: KTCPAVVM (EGFR G598V)
KVCPAVVH

SEQ ID NO: 4435 - protein, 8 aa, Artificial Sequence
  Description of Artificial Sequence: Synthetic peptide
  Seed: KTCPAVVM (EGFR G598V)
KVCPAVVI

SEQ ID NO: 4436 - protein, 8 aa, Artificial Sequence
  Description of Artificial Sequence: Synthetic peptide
  Seed: KTCPAVVM (EGFR G598V)
KVCPAVVL

SEQ ID NO: 4437 - protein, 8 aa, Artificial Sequence
  Description of Artificial Sequence: Synthetic peptide
  Seed: KTCPAVVM (EGFR G598V)
KVCPAVVM

SEQ ID NO: 4438 - protein, 8 aa, Artificial Sequence
  Description of Artificial Sequence: Synthetic peptide
  Seed: KTCPAVVM (EGFR G598V)
KVCPAVVV

SEQ ID NO: 4439 - protein, 8 aa, Artificial Sequence
  Description of Artificial Sequence: Synthetic peptide
  Seed: KTCPAVVM (EGFR G598V)
KVCPAVVW

SEQ ID NO: 4440 - protein, 8 aa, Artificial Sequence
  Description of Artificial Sequence: Synthetic peptide
  Seed: KTCPAVVM (EGFR G598V)
KVCPAVVY

SEQ ID NO: 4441 - protein, 9 aa, Artificial Sequence
  Description of Artificial Sequence: Synthetic peptide
  Seed: VVMGENNTL (EGFR G598V)
VAMGENNTA

SEQ ID NO: 4442 - protein, 9 aa, Artificial Sequence
  Description of Artificial Sequence: Synthetic peptide
  Seed: VVMGENNTL (EGFR G598V)
VAMGENNTC

SEQ ID NO: 4443 - protein, 9 aa, Artificial Sequence
  Description of Artificial Sequence: Synthetic peptide
  Seed: VVMGENNTL (EGFR G598V)
VAMGENNTH

SEQ ID NO: 4444 - protein, 9 aa, Artificial Sequence
  Description of Artificial Sequence: Synthetic peptide
  Seed: VVMGENNTL (EGFR G598V)
VAMGENNTK

SEQ ID NO: 4445 - protein, 10 aa, Artificial Sequence
  Description of Artificial Sequence: Synthetic peptide
  Seed: VVMGENNTLV (EGFR G598V)
VAMGENNTLA

SEQ ID NO: 4446 - protein, 10 aa, Artificial Sequence
  Description of Artificial Sequence: Synthetic peptide
  Seed: VVMGENNTLV (EGFR G598V)
VAMGENNTLI

SEQ ID NO: 4447 - protein, 11 aa, Artificial Sequence
  Description of Artificial Sequence: Synthetic peptide
  Seed: VVMGENNTLVW (EGFR G598V)
VAMGENNTLVA

SEQ ID NO: 4448 - protein, 11 aa, Artificial Sequence
  Description of Artificial Sequence: Synthetic peptide
  Seed: VVMGENNTLVW (EGFR G598V)
VAMGENNTLVH

SEQ ID NO: 4449 - protein, 11 aa, Artificial Sequence
  Description of Artificial Sequence: Synthetic peptide
  Seed: VVMGENNTLVW (EGFR G598V)
VAMGENNTLVI

SEQ ID NO: 4450 - protein, 11 aa, Artificial Sequence
  Description of Artificial Sequence: Synthetic peptide
  Seed: VVMGENNTLVW (EGFR G598V)
VAMGENNTLVK

SEQ ID NO: 4451 - protein, 11 aa, Artificial Sequence
  Description of Artificial Sequence: Synthetic peptide
  Seed: VVMGENNTLVW (EGFR G598V)
VAMGENNTLVQ

SEQ ID NO: 4452 - protein, 11 aa, Artificial Sequence
  Description of Artificial Sequence: Synthetic peptide
  Seed: VVMGENNTLVW (EGFR G598V)
VAMGENNTLVR

SEQ ID NO: 4453 - protein, 11 aa, Artificial Sequence
  Description of Artificial Sequence: Synthetic peptide
  Seed: VVMGENNTLVW (EGFR G598V)
VAMGENNTLVV

SEQ ID NO: 4454 - protein, 9 aa, Artificial Sequence
  Description of Artificial Sequence: Synthetic peptide
  Seed: VVMGENNTL (EGFR G598V)
VAMGENNTQ

SEQ ID NO: 4455 - protein, 9 aa, Artificial Sequence
  Description of Artificial Sequence: Synthetic peptide
  Seed: VVMGENNTL (EGFR G598V)
VAMGENNTR

SEQ ID NO: 4456 - protein, 9 aa, Artificial Sequence
  Description of Artificial Sequence: Synthetic peptide
  Seed: VVMGENNTL (EGFR G598V)
VAMGENNTT

SEQ ID NO: 4457 - protein, 9 aa, Artificial Sequence
  Description of Artificial Sequence: Synthetic peptide
  Seed: VVMGENNTL (EGFR G598V)
VCMGENNTF

SEQ ID NO: 4458 - protein, 9 aa, Artificial Sequence
  Description of Artificial Sequence: Synthetic peptide
  Seed: VVMGENNTL (EGFR G598V)
VCMGENNTK

SEQ ID NO: 4459 - protein, 9 aa, Artificial Sequence
  Description of Artificial Sequence: Synthetic peptide
  Seed: VVMGENNTL (EGFR G598V)
VCMGENNTL

SEQ ID NO: 4460 - protein, 11 aa, Artificial Sequence
  Description of Artificial Sequence: Synthetic peptide
  Seed: VVMGENNTLVW (EGFR G598V)
VCMGENNTLVF

SEQ ID NO: 4461 - protein, 11 aa, Artificial Sequence
  Description of Artificial Sequence: Synthetic peptide
  Seed: VVMGENNTLVW (EGFR G598V)
VCMGENNTLVK

SEQ ID NO: 4462 - protein, 11 aa, Artificial Sequence
  Description of Artificial Sequence: Synthetic peptide
  Seed: VVMGENNTLVW (EGFR G598V)
VCMGENNTLVL

SEQ ID NO: 4463 - protein, 11 aa, Artificial Sequence
  Description of Artificial Sequence: Synthetic peptide
  Seed: VVMGENNTLVW (EGFR G598V)
VCMGENNTLVM

SEQ ID NO: 4464 - protein, 11 aa, Artificial Sequence
  Description of Artificial Sequence: Synthetic peptide
  Seed: VVMGENNTLVW (EGFR G598V)
VCMGENNTLVY

SEQ ID NO: 4465 - protein, 9 aa, Artificial Sequence
  Description of Artificial Sequence: Synthetic peptide
  Seed: VVMGENNTL (EGFR G598V)
VCMGENNTM

SEQ ID NO: 4466 - protein, 9 aa, Artificial Sequence
  Description of Artificial Sequence: Synthetic peptide
  Seed: VVMGENNTL (EGFR G598V)
VCMGENNTR

SEQ ID NO: 4467 - protein, 9 aa, Artificial Sequence
  Description of Artificial Sequence: Synthetic peptide
  Seed: VVMGENNTL (EGFR G598V)
VCMGENNTV

SEQ ID NO: 4468 - protein, 9 aa, Artificial Sequence
  Description of Artificial Sequence: Synthetic peptide
  Seed: VVMGENNTL (EGFR G598V)
VCMGENNTW

SEQ ID NO: 4469 - protein, 9 aa, Artificial Sequence
  Description of Artificial Sequence: Synthetic peptide
  Seed: VVMGENNTL (EGFR G598V)
VCMGENNTY

SEQ ID NO: 4470 - protein, 9 aa, Artificial Sequence
  Description of Artificial Sequence: Synthetic peptide
  Seed: VVMGENNTL (EGFR G598V)
VDMGENNTF

SEQ ID NO: 4471 - protein, 9 aa, Artificial Sequence
  Description of Artificial Sequence: Synthetic peptide
  Seed: VVMGENNTL (EGFR G598V)
VDMGENNTI

SEQ ID NO: 4472 - protein, 9 aa, Artificial Sequence
  Description of Artificial Sequence: Synthetic peptide
  Seed: VVMGENNTL (EGFR G598V)
VDMGENNTK

SEQ ID NO: 4473 - protein, 9 aa, Artificial Sequence
  Description of Artificial Sequence: Synthetic peptide
  Seed: VVMGENNTL (EGFR G598V)
VDMGENNTL

SEQ ID NO: 4474 - protein, 11 aa, Artificial Sequence
  Description of Artificial Sequence: Synthetic peptide
  Seed: VVMGENNTLVW (EGFR G598V)
VDMGENNTLVF

SEQ ID NO: 4475 - protein, 11 aa, Artificial Sequence
  Description of Artificial Sequence: Synthetic peptide
  Seed: VVMGENNTLVW (EGFR G598V)
VDMGENNTLVK

SEQ ID NO: 4476 - protein, 11 aa, Artificial Sequence
  Description of Artificial Sequence: Synthetic peptide
  Seed: VVMGENNTLVW (EGFR G598V)
VDMGENNTLVW

SEQ ID NO: 4477 - protein, 11 aa, Artificial Sequence
  Description of Artificial Sequence: Synthetic peptide
  Seed: VVMGENNTLVW (EGFR G598V)
VDMGENNTLVY

SEQ ID NO: 4478 - protein, 9 aa, Artificial Sequence
  Description of Artificial Sequence: Synthetic peptide
  Seed: VVMGENNTL (EGFR G598V)
VDMGENNTM

SEQ ID NO: 4479 - protein, 9 aa, Artificial Sequence
  Description of Artificial Sequence: Synthetic peptide
  Seed: VVMGENNTL (EGFR G598V)
VDMGENNTR

SEQ ID NO: 4480 - protein, 9 aa, Artificial Sequence
  Description of Artificial Sequence: Synthetic peptide
  Seed: VVMGENNTL (EGFR G598V)
VDMGENNTV

SEQ ID NO: 4481 - protein, 9 aa, Artificial Sequence
  Description of Artificial Sequence: Synthetic peptide
  Seed: VVMGENNTL (EGFR G598V)
VDMGENNTW

SEQ ID NO: 4482 - protein, 9 aa, Artificial Sequence
  Description of Artificial Sequence: Synthetic peptide
  Seed: VVMGENNTL (EGFR G598V)
VDMGENNTY

SEQ ID NO: 4483 - protein, 9 aa, Artificial Sequence
  Description of Artificial Sequence: Synthetic peptide
  Seed: VVMGENNTL (EGFR G598V)
VEMGENNTF

SEQ ID NO: 4484 - protein, 9 aa, Artificial Sequence
  Description of Artificial Sequence: Synthetic peptide
  Seed: VVMGENNTL (EGFR G598V)
VEMGENNTI

SEQ ID NO: 4485 - protein, 9 aa, Artificial Sequence
  Description of Artificial Sequence: Synthetic peptide
  Seed: VVMGENNTL (EGFR G598V)
VEMGENNTK

SEQ ID NO: 4486 - protein, 9 aa, Artificial Sequence
  Description of Artificial Sequence: Synthetic peptide
  Seed: VVMGENNTL (EGFR G598V)
VEMGENNTL

SEQ ID NO: 4487 - protein, 10 aa, Artificial Sequence
  Description of Artificial Sequence: Synthetic peptide
  Seed: VVMGENNTLV (EGFR G598V)
VEMGENNTLI

SEQ ID NO: 4488 - protein, 11 aa, Artificial Sequence
  Description of Artificial Sequence: Synthetic peptide
  Seed: VVMGENNTLVW (EGFR G598V)
VEMGENNTLVF

SEQ ID NO: 4489 - protein, 11 aa, Artificial Sequence
  Description of Artificial Sequence: Synthetic peptide
  Seed: VVMGENNTLVW (EGFR G598V)
VEMGENNTLVI

SEQ ID NO: 4490 - protein, 11 aa, Artificial Sequence
  Description of Artificial Sequence: Synthetic peptide
  Seed: VVMGENNTLVW (EGFR G598V)
VEMGENNTLVK

SEQ ID NO: 4491 - protein, 11 aa, Artificial Sequence
  Description of Artificial Sequence: Synthetic peptide
  Seed: VVMGENNTLVW (EGFR G598V)
VEMGENNTLVL

SEQ ID NO: 4492 - protein, 11 aa, Artificial Sequence
  Description of Artificial Sequence: Synthetic peptide
  Seed: VVMGENNTLVW (EGFR G598V)
VEMGENNTLVM

SEQ ID NO: 4493 - protein, 11 aa, Artificial Sequence
  Description of Artificial Sequence: Synthetic peptide
  Seed: VVMGENNTLVW (EGFR G598V)
VEMGENNTLVW

SEQ ID NO: 4494 - protein, 11 aa, Artificial Sequence
  Description of Artificial Sequence: Synthetic peptide
  Seed: VVMGENNTLVW (EGFR G598V)
VEMGENNTLVY

SEQ ID NO: 4495 - protein, 9 aa, Artificial Sequence
  Description of Artificial Sequence: Synthetic peptide
  Seed: VVMGENNTL (EGFR G598V)
VEMGENNTM

SEQ ID NO: 4496 - protein, 9 aa, Artificial Sequence
  Description of Artificial Sequence: Synthetic peptide
  Seed: VVMGENNTL (EGFR G598V)
VEMGENNTR

SEQ ID NO: 4497 - protein, 9 aa, Artificial Sequence
  Description of Artificial Sequence: Synthetic peptide
  Seed: VVMGENNTL (EGFR G598V)
VEMGENNTV

SEQ ID NO: 4498 - protein, 9 aa, Artificial Sequence
  Description of Artificial Sequence: Synthetic peptide
  Seed: VVMGENNTL (EGFR G598V)
VEMGENNTW

SEQ ID NO: 4499 - protein, 9 aa, Artificial Sequence
  Description of Artificial Sequence: Synthetic peptide
  Seed: VVMGENNTL (EGFR G598V)
VEMGENNTY

SEQ ID NO: 4500 - protein, 9 aa, Artificial Sequence
  Description of Artificial Sequence: Synthetic peptide
  Seed: VVMGENNTL (EGFR G598V)
VFMGENNTF

SEQ ID NO: 4501 - protein, 9 aa, Artificial Sequence
  Description of Artificial Sequence: Synthetic peptide
  Seed: VVMGENNTL (EGFR G598V)
VFMGENNTI

SEQ ID NO: 4502 - protein, 9 aa, Artificial Sequence
  Description of Artificial Sequence: Synthetic peptide
  Seed: VVMGENNTL (EGFR G598V)
VFMGENNTK

SEQ ID NO: 4503 - protein, 9 aa, Artificial Sequence
  Description of Artificial Sequence: Synthetic peptide
  Seed: VVMGENNTL (EGFR G598V)
VFMGENNTL

SEQ ID NO: 4504 - protein, 11 aa, Artificial Sequence
  Description of Artificial Sequence: Synthetic peptide
  Seed: VVMGENNTLVW (EGFR G598V)
VFMGENNTLVF

SEQ ID NO: 4505 - protein, 11 aa, Artificial Sequence
  Description of Artificial Sequence: Synthetic peptide
  Seed: VVMGENNTLVW (EGFR G598V)
VFMGENNTLVK

SEQ ID NO: 4506 - protein, 11 aa, Artificial Sequence
  Description of Artificial Sequence: Synthetic peptide
  Seed: VVMGENNTLVW (EGFR G598V)
VFMGENNTLVW

SEQ ID NO: 4507 - protein, 11 aa, Artificial Sequence
  Description of Artificial Sequence: Synthetic peptide
  Seed: VVMGENNTLVW (EGFR G598V)
VFMGENNTLVY

SEQ ID NO: 4508 - protein, 9 aa, Artificial Sequence
  Description of Artificial Sequence: Synthetic peptide
  Seed: VVMGENNTL (EGFR G598V)
VFMGENNTM

SEQ ID NO: 4509 - protein, 9 aa, Artificial Sequence
  Description of Artificial Sequence: Synthetic peptide
  Seed: VVMGENNTL (EGFR G598V)
VFMGENNTR

SEQ ID NO: 4510 - protein, 9 aa, Artificial Sequence
  Description of Artificial Sequence: Synthetic peptide
  Seed: VVMGENNTL (EGFR G598V)
VFMGENNTV

SEQ ID NO: 4511 - protein, 9 aa, Artificial Sequence
  Description of Artificial Sequence: Synthetic peptide
  Seed: VVMGENNTL (EGFR G598V)
VFMGENNTW

SEQ ID NO: 4512 - protein, 9 aa, Artificial Sequence
  Description of Artificial Sequence: Synthetic peptide
  Seed: VVMGENNTL (EGFR G598V)
VFMGENNTY

SEQ ID NO: 4513 - protein, 9 aa, Artificial Sequence
  Description of Artificial Sequence: Synthetic peptide
  Seed: VVMGENNTL (EGFR G598V)
VGMGENNTH

SEQ ID NO: 4514 - protein, 9 aa, Artificial Sequence
  Description of Artificial Sequence: Synthetic peptide
  Seed: VVMGENNTL (EGFR G598V)
VGMGENNTI

SEQ ID NO: 4515 - protein, 9 aa, Artificial Sequence
  Description of Artificial Sequence: Synthetic peptide
  Seed: VVMGENNTL (EGFR G598V)
VGMGENNTK

SEQ ID NO: 4516 - protein, 9 aa, Artificial Sequence
  Description of Artificial Sequence: Synthetic peptide
  Seed: VVMGENNTL (EGFR G598V)
VGMGENNTL

SEQ ID NO: 4517 - protein, 11 aa, Artificial Sequence
  Description of Artificial Sequence: Synthetic peptide
  Seed: VVMGENNTLVW (EGFR G598V)
VGMGENNTLVF

SEQ ID NO: 4518 - protein, 11 aa, Artificial Sequence
  Description of Artificial Sequence: Synthetic peptide
  Seed: VVMGENNTLVW (EGFR G598V)
VGMGENNTLVH

SEQ ID NO: 4519 - protein, 11 aa, Artificial Sequence
  Description of Artificial Sequence: Synthetic peptide
  Seed: VVMGENNTLVW (EGFR G598V)
VGMGENNTLVK

SEQ ID NO: 4520 - protein, 11 aa, Artificial Sequence
  Description of Artificial Sequence: Synthetic peptide
  Seed: VVMGENNTLVW (EGFR G598V)
VGMGENNTLVL

SEQ ID NO: 4521 - protein, 11 aa, Artificial Sequence
  Description of Artificial Sequence: Synthetic peptide
  Seed: VVMGENNTLVW (EGFR G598V)
VGMGENNTLVM

SEQ ID NO: 4522 - protein, 11 aa, Artificial Sequence
  Description of Artificial Sequence: Synthetic peptide
  Seed: VVMGENNTLVW (EGFR G598V)
VGMGENNTLVR

SEQ ID NO: 4523 - protein, 11 aa, Artificial Sequence
  Description of Artificial Sequence: Synthetic peptide
  Seed: VVMGENNTLVW (EGFR G598V)
VGMGENNTLVY

SEQ ID NO: 4524 - protein, 9 aa, Artificial Sequence
  Description of Artificial Sequence: Synthetic peptide
  Seed: VVMGENNTL (EGFR G598V)
VGMGENNTR

SEQ ID NO: 4525 - protein, 9 aa, Artificial Sequence
  Description of Artificial Sequence: Synthetic peptide
  Seed: VVMGENNTL (EGFR G598V)
VGMGENNTV

SEQ ID NO: 4526 - protein, 9 aa, Artificial Sequence
  Description of Artificial Sequence: Synthetic peptide
  Seed: VVMGENNTL (EGFR G598V)
VGMGENNTW

SEQ ID NO: 4527 - protein, 9 aa, Artificial Sequence
  Description of Artificial Sequence: Synthetic peptide
  Seed: VVMGENNTL (EGFR G598V)
VHMGENNTF

SEQ ID NO: 4528 - protein, 9 aa, Artificial Sequence
  Description of Artificial Sequence: Synthetic peptide
  Seed: VVMGENNTL (EGFR G598V)
VHMGENNTI

SEQ ID NO: 4529 - protein, 9 aa, Artificial Sequence
  Description of Artificial Sequence: Synthetic peptide
  Seed: VVMGENNTL (EGFR G598V)
VHMGENNTL

SEQ ID NO: 4530 - protein, 11 aa, Artificial Sequence
  Description of Artificial Sequence: Synthetic peptide
  Seed: VVMGENNTLVW (EGFR G598V)
VHMGENNTLVW

SEQ ID NO: 4531 - protein, 11 aa, Artificial Sequence
  Description of Artificial Sequence: Synthetic peptide
  Seed: VVMGENNTLVW (EGFR G598V)
VHMGENNTLVY

SEQ ID NO: 4532 - protein, 9 aa, Artificial Sequence
  Description of Artificial Sequence: Synthetic peptide
  Seed: VVMGENNTL (EGFR G598V)
VHMGENNTM

SEQ ID NO: 4533 - protein, 9 aa, Artificial Sequence
  Description of Artificial Sequence: Synthetic peptide
  Seed: VVMGENNTL (EGFR G598V)
VHMGENNTV

SEQ ID NO: 4534 - protein, 9 aa, Artificial Sequence
  Description of Artificial Sequence: Synthetic peptide
  Seed: VVMGENNTL (EGFR G598V)
VHMGENNTY

SEQ ID NO: 4535 - protein, 9 aa, Artificial Sequence
  Description of Artificial Sequence: Synthetic peptide
  Seed: VVMGENNTL (EGFR G598V)
VIMGENNTA

SEQ ID NO: 4536 - protein, 9 aa, Artificial Sequence
  Description of Artificial Sequence: Synthetic peptide
  Seed: VVMGENNTL (EGFR G598V)
VIMGENNTH

SEQ ID NO: 4537 - protein, 9 aa, Artificial Sequence
  Description of Artificial Sequence: Synthetic peptide
  Seed: VVMGENNTL (EGFR G598V)
VIMGENNTK

SEQ ID NO: 4538 - protein, 10 aa, Artificial Sequence
  Description of Artificial Sequence: Synthetic peptide
  Seed: VVMGENNTLV (EGFR G598V)
VIMGENNTLA

SEQ ID NO: 4539 - protein, 10 aa, Artificial Sequence
  Description of Artificial Sequence: Synthetic peptide
  Seed: VVMGENNTLV (EGFR G598V)
VIMGENNTLM

SEQ ID NO: 4540 - protein, 10 aa, Artificial Sequence
  Description of Artificial Sequence: Synthetic peptide
  Seed: VVMGENNTLV (EGFR G598V)
VIMGENNTLT

SEQ ID NO: 4541 - protein, 11 aa, Artificial Sequence
  Description of Artificial Sequence: Synthetic peptide
  Seed: VVMGENNTLVW (EGFR G598V)
VIMGENNTLVF

SEQ ID NO: 4542 - protein, 11 aa, Artificial Sequence
  Description of Artificial Sequence: Synthetic peptide
  Seed: VVMGENNTLVW (EGFR G598V)
VIMGENNTLVH

SEQ ID NO: 4543 - protein, 11 aa, Artificial Sequence
  Description of Artificial Sequence: Synthetic peptide
  Seed: VVMGENNTLVW (EGFR G598V)
VIMGENNTLVI

SEQ ID NO: 4544 - protein, 11 aa, Artificial Sequence
  Description of Artificial Sequence: Synthetic peptide
  Seed: VVMGENNTLVW (EGFR G598V)
VIMGENNTLVK

SEQ ID NO: 4545 - protein, 11 aa, Artificial Sequence
  Description of Artificial Sequence: Synthetic peptide
  Seed: VVMGENNTLVW (EGFR G598V)
VIMGENNTLVL

SEQ ID NO: 4546 - protein, 11 aa, Artificial Sequence
  Description of Artificial Sequence: Synthetic peptide
  Seed: VVMGENNTLVW (EGFR G598V)
VIMGENNTLVM

SEQ ID NO: 4547 - protein, 11 aa, Artificial Sequence
  Description of Artificial Sequence: Synthetic peptide
  Seed: VVMGENNTLVW (EGFR G598V)
VIMGENNTLVR

SEQ ID NO: 4548 - protein, 11 aa, Artificial Sequence
  Description of Artificial Sequence: Synthetic peptide
  Seed: VVMGENNTLVW (EGFR G598V)
VIMGENNTLVY

SEQ ID NO: 4549 - protein, 9 aa, Artificial Sequence
  Description of Artificial Sequence: Synthetic peptide
  Seed: VVMGENNTL (EGFR G598V)
VIMGENNTR

SEQ ID NO: 4550 - protein, 9 aa, Artificial Sequence
  Description of Artificial Sequence: Synthetic peptide
  Seed: VVMGENNTL (EGFR G598V)
VIMGENNTW

SEQ ID NO: 4551 - protein, 9 aa, Artificial Sequence
  Description of Artificial Sequence: Synthetic peptide
  Seed: VVMGENNTL (EGFR G598V)
VKMGENNTF

SEQ ID NO: 4552 - protein, 9 aa, Artificial Sequence
  Description of Artificial Sequence: Synthetic peptide
  Seed: VVMGENNTL (EGFR G598V)
VKMGENNTL

SEQ ID NO: 4553 - protein, 11 aa, Artificial Sequence
  Description of Artificial Sequence: Synthetic peptide
  Seed: VVMGENNTLVW (EGFR G598V)
VKMGENNTLVF

SEQ ID NO: 4554 - protein, 11 aa, Artificial Sequence
  Description of Artificial Sequence: Synthetic peptide
  Seed: VVMGENNTLVW (EGFR G598V)
VKMGENNTLVW

SEQ ID NO: 4555 - protein, 11 aa, Artificial Sequence
  Description of Artificial Sequence: Synthetic peptide
  Seed: VVMGENNTLVW (EGFR G598V)
VKMGENNTLVY

SEQ ID NO: 4556 - protein, 9 aa, Artificial Sequence
  Description of Artificial Sequence: Synthetic peptide
  Seed: VVMGENNTL (EGFR G598V)
VKMGENNTM

SEQ ID NO: 4557 - protein, 9 aa, Artificial Sequence
  Description of Artificial Sequence: Synthetic peptide
  Seed: VVMGENNTL (EGFR G598V)
VKMGENNTW

SEQ ID NO: 4558 - protein, 9 aa, Artificial Sequence
  Description of Artificial Sequence: Synthetic peptide
  Seed: VVMGENNTL (EGFR G598V)
VKMGENNTY

SEQ ID NO: 4559 - protein, 9 aa, Artificial Sequence
  Description of Artificial Sequence: Synthetic peptide
  Seed: VVMGENNTL (EGFR G598V)
VLMGENNTH

SEQ ID NO: 4560 - protein, 9 aa, Artificial Sequence
  Description of Artificial Sequence: Synthetic peptide
  Seed: VVMGENNTL (EGFR G598V)
VLMGENNTK

SEQ ID NO: 4561 - protein, 11 aa, Artificial Sequence
  Description of Artificial Sequence: Synthetic peptide
  Seed: VVMGENNTLVW (EGFR G598V)
VLMGENNTLVF

SEQ ID NO: 4562 - protein, 11 aa, Artificial Sequence
  Description of Artificial Sequence: Synthetic peptide
  Seed: VVMGENNTLVW (EGFR G598V)
VLMGENNTLVI

SEQ ID NO: 4563 - protein, 11 aa, Artificial Sequence
  Description of Artificial Sequence: Synthetic peptide
  Seed: VVMGENNTLVW (EGFR G598V)
VLMGENNTLVK

SEQ ID NO: 4564 - protein, 11 aa, Artificial Sequence
  Description of Artificial Sequence: Synthetic peptide
  Seed: VVMGENNTLVW (EGFR G598V)
VLMGENNTLVL

SEQ ID NO: 4565 - protein, 11 aa, Artificial Sequence
  Description of Artificial Sequence: Synthetic peptide
  Seed: VVMGENNTLVW (EGFR G598V)
VLMGENNTLVM

SEQ ID NO: 4566 - protein, 11 aa, Artificial Sequence
  Description of Artificial Sequence: Synthetic peptide
  Seed: VVMGENNTLVW (EGFR G598V)
VLMGENNTLVR

SEQ ID NO: 4567 - protein, 11 aa, Artificial Sequence
  Description of Artificial Sequence: Synthetic peptide
  Seed: VVMGENNTLVW (EGFR G598V)
VLMGENNTLVV

SEQ ID NO: 4568 - protein, 11 aa, Artificial Sequence
  Description of Artificial Sequence: Synthetic peptide
  Seed: VVMGENNTLVW (EGFR G598V)
VLMGENNTLVY

SEQ ID NO: 4569 - protein, 9 aa, Artificial Sequence
  Description of Artificial Sequence: Synthetic peptide
  Seed: VVMGENNTL (EGFR G598V)
VLMGENNTR

SEQ ID NO: 4570 - protein, 9 aa, Artificial Sequence
  Description of Artificial Sequence: Synthetic peptide
  Seed: VVMGENNTL (EGFR G598V)
VMMGENNTH

SEQ ID NO: 4571 - protein, 9 aa, Artificial Sequence
  Description of Artificial Sequence: Synthetic peptide
  Seed: VVMGENNTL (EGFR G598V)
VMMGENNTK

SEQ ID NO: 4572 - protein, 11 aa, Artificial Sequence
  Description of Artificial Sequence: Synthetic peptide
  Seed: VVMGENNTLVW (EGFR G598V)
VMMGENNTLVF

SEQ ID NO: 4573 - protein, 11 aa, Artificial Sequence
  Description of Artificial Sequence: Synthetic peptide
  Seed: VVMGENNTLVW (EGFR G598V)
VMMGENNTLVH

SEQ ID NO: 4574 - protein, 11 aa, Artificial Sequence
  Description of Artificial Sequence: Synthetic peptide
  Seed: VVMGENNTLVW (EGFR G598V)
VMMGENNTLVI

SEQ ID NO: 4575 - protein, 11 aa, Artificial Sequence
  Description of Artificial Sequence: Synthetic peptide
  Seed: VVMGENNTLVW (EGFR G598V)
VMMGENNTLVK

SEQ ID NO: 4576 - protein, 11 aa, Artificial Sequence
  Description of Artificial Sequence: Synthetic peptide
  Seed: VVMGENNTLVW (EGFR G598V)
VMMGENNTLVL

SEQ ID NO: 4577 - protein, 11 aa, Artificial Sequence
  Description of Artificial Sequence: Synthetic peptide
  Seed: VVMGENNTLVW (EGFR G598V)
VMMGENNTLVM

SEQ ID NO: 4578 - protein, 11 aa, Artificial Sequence
  Description of Artificial Sequence: Synthetic peptide
  Seed: VVMGENNTLVW (EGFR G598V)
VMMGENNTLVR

SEQ ID NO: 4579 - protein, 11 aa, Artificial Sequence
  Description of Artificial Sequence: Synthetic peptide
  Seed: VVMGENNTLVW (EGFR G598V)
VMMGENNTLVV

SEQ ID NO: 4580 - protein, 11 aa, Artificial Sequence
  Description of Artificial Sequence: Synthetic peptide
  Seed: VVMGENNTLVW (EGFR G598V)
VMMGENNTLVY

SEQ ID NO: 4581 - protein, 9 aa, Artificial Sequence
  Description of Artificial Sequence: Synthetic peptide
  Seed: VVMGENNTL (EGFR G598V)
VMMGENNTR

SEQ ID NO: 4582 - protein, 9 aa, Artificial Sequence
  Description of Artificial Sequence: Synthetic peptide
  Seed: VVMGENNTL (EGFR G598V)
VMMGENNTW

SEQ ID NO: 4583 - protein, 9 aa, Artificial Sequence
  Description of Artificial Sequence: Synthetic peptide
  Seed: VVMGENNTL (EGFR G598V)
VNMGENNTF

SEQ ID NO: 4584 - protein, 9 aa, Artificial Sequence
  Description of Artificial Sequence: Synthetic peptide
  Seed: VVMGENNTL (EGFR G598V)
VNMGENNTI

SEQ ID NO: 4585 - protein, 9 aa, Artificial Sequence
  Description of Artificial Sequence: Synthetic peptide
  Seed: VVMGENNTL (EGFR G598V)
VNMGENNTK

SEQ ID NO: 4586 - protein, 9 aa, Artificial Sequence
  Description of Artificial Sequence: Synthetic peptide
  Seed: VVMGENNTL (EGFR G598V)
VNMGENNTL

SEQ ID NO: 4587 - protein, 11 aa, Artificial Sequence
  Description of Artificial Sequence: Synthetic peptide
  Seed: VVMGENNTLVW (EGFR G598V)
VNMGENNTLVF

SEQ ID NO: 4588 - protein, 11 aa, Artificial Sequence
  Description of Artificial Sequence: Synthetic peptide
  Seed: VVMGENNTLVW (EGFR G598V)
VNMGENNTLVK

SEQ ID NO: 4589 - protein, 11 aa, Artificial Sequence
  Description of Artificial Sequence: Synthetic peptide
  Seed: VVMGENNTLVW (EGFR G598V)
VNMGENNTLVR

SEQ ID NO: 4590 - protein, 11 aa, Artificial Sequence
  Description of Artificial Sequence: Synthetic peptide
  Seed: VVMGENNTLVW (EGFR G598V)
VNMGENNTLVY

SEQ ID NO: 4591 - protein, 9 aa, Artificial Sequence
  Description of Artificial Sequence: Synthetic peptide
  Seed: VVMGENNTL (EGFR G598V)
VNMGENNTM

SEQ ID NO: 4592 - protein, 9 aa, Artificial Sequence
  Description of Artificial Sequence: Synthetic peptide
  Seed: VVMGENNTL (EGFR G598V)
VNMGENNTR

SEQ ID NO: 4593 - protein, 9 aa, Artificial Sequence
  Description of Artificial Sequence: Synthetic peptide
  Seed: VVMGENNTL (EGFR G598V)
VNMGENNTV

SEQ ID NO: 4594 - protein, 9 aa, Artificial Sequence
  Description of Artificial Sequence: Synthetic peptide
  Seed: VVMGENNTL (EGFR G598V)
VNMGENNTW

SEQ ID NO: 4595 - protein, 9 aa, Artificial Sequence
  Description of Artificial Sequence: Synthetic peptide
  Seed: VVMGENNTL (EGFR G598V)
VNMGENNTY

SEQ ID NO: 4596 - protein, 9 aa, Artificial Sequence
  Description of Artificial Sequence: Synthetic peptide
  Seed: VVMGENNTL (EGFR G598V)
VPMGENNTA

SEQ ID NO: 4597 - protein, 9 aa, Artificial Sequence
  Description of Artificial Sequence: Synthetic peptide
  Seed: VVMGENNTL (EGFR G598V)
VPMGENNTC

SEQ ID NO: 4598 - protein, 9 aa, Artificial Sequence
  Description of Artificial Sequence: Synthetic peptide
  Seed: VVMGENNTL (EGFR G598V)
VPMGENNTF

SEQ ID NO: 4599 - protein, 9 aa, Artificial Sequence
  Description of Artificial Sequence: Synthetic peptide
  Seed: VVMGENNTL (EGFR G598V)
VPMGENNTI

SEQ ID NO: 4600 - protein, 9 aa, Artificial Sequence
  Description of Artificial Sequence: Synthetic peptide
  Seed: VVMGENNTL (EGFR G598V)
VPMGENNTK

SEQ ID NO: 4601 - protein, 11 aa, Artificial Sequence
  Description of Artificial Sequence: Synthetic peptide
  Seed: VVMGENNTLVW (EGFR G598V)
VPMGENNTLVF

SEQ ID NO: 4602 - protein, 11 aa, Artificial Sequence
  Description of Artificial Sequence: Synthetic peptide
  Seed: VVMGENNTLVW (EGFR G598V)
VPMGENNTLVI

SEQ ID NO: 4603 - protein, 11 aa, Artificial Sequence
  Description of Artificial Sequence: Synthetic peptide
  Seed: VVMGENNTLVW (EGFR G598V)
VPMGENNTLVL

SEQ ID NO: 4604 - protein, 11 aa, Artificial Sequence
  Description of Artificial Sequence: Synthetic peptide
  Seed: VVMGENNTLVW (EGFR G598V)
VPMGENNTLVM

SEQ ID NO: 4605 - protein, 11 aa, Artificial Sequence
  Description of Artificial Sequence: Synthetic peptide
  Seed: VVMGENNTLVW (EGFR G598V)
VPMGENNTLVV

SEQ ID NO: 4606 - protein, 11 aa, Artificial Sequence
  Description of Artificial Sequence: Synthetic peptide
  Seed: VVMGENNTLVW (EGFR G598V)
VPMGENNTLVY

SEQ ID NO: 4607 - protein, 9 aa, Artificial Sequence
  Description of Artificial Sequence: Synthetic peptide
  Seed: VVMGENNTL (EGFR G598V)
VPMGENNTM

SEQ ID NO: 4608 - protein, 9 aa, Artificial Sequence
  Description of Artificial Sequence: Synthetic peptide
  Seed: VVMGENNTL (EGFR G598V)
VPMGENNTP

SEQ ID NO: 4609 - protein, 9 aa, Artificial Sequence
  Description of Artificial Sequence: Synthetic peptide
  Seed: VVMGENNTL (EGFR G598V)
VPMGENNTR

SEQ ID NO: 4610 - protein, 9 aa, Artificial Sequence
  Description of Artificial Sequence: Synthetic peptide
  Seed: VVMGENNTL (EGFR G598V)
VPMGENNTS

SEQ ID NO: 4611 - protein, 9 aa, Artificial Sequence
  Description of Artificial Sequence: Synthetic peptide
  Seed: VVMGENNTL (EGFR G598V)
VPMGENNTT

SEQ ID NO: 4612 - protein, 9 aa, Artificial Sequence
  Description of Artificial Sequence: Synthetic peptide
  Seed: VVMGENNTL (EGFR G598V)
VPMGENNTV

SEQ ID NO: 4613 - protein, 9 aa, Artificial Sequence
  Description of Artificial Sequence: Synthetic peptide
  Seed: VVMGENNTL (EGFR G598V)
VPMGENNTW

SEQ ID NO: 4614 - protein, 9 aa, Artificial Sequence
  Description of Artificial Sequence: Synthetic peptide
  Seed: VVMGENNTL (EGFR G598V)
VPMGENNTY

SEQ ID NO: 4615 - protein, 9 aa, Artificial Sequence
  Description of Artificial Sequence: Synthetic peptide
  Seed: VKTCPAVVM (EGFR G598V)
VPTCPAVVY

SEQ ID NO: 4616 - protein, 9 aa, Artificial Sequence
  Description of Artificial Sequence: Synthetic peptide
  Seed: VVMGENNTL (EGFR G598V)
VQMGENNTC

SEQ ID NO: 4617 - protein, 9 aa, Artificial Sequence
  Description of Artificial Sequence: Synthetic peptide
  Seed: VVMGENNTL (EGFR G598V)
VQMGENNTH

SEQ ID NO: 4618 - protein, 9 aa, Artificial Sequence
  Description of Artificial Sequence: Synthetic peptide
  Seed: VVMGENNTL (EGFR G598V)
VQMGENNTK

SEQ ID NO: 4619 - protein, 10 aa, Artificial Sequence
  Description of Artificial Sequence: Synthetic peptide
  Seed: VVMGENNTLV (EGFR G598V)
VQMGENNTLA

SEQ ID NO: 4620 - protein, 10 aa, Artificial Sequence
  Description of Artificial Sequence: Synthetic peptide
  Seed: VVMGENNTLV (EGFR G598V)
VQMGENNTLC

SEQ ID NO: 4621 - protein, 10 aa, Artificial Sequence
  Description of Artificial Sequence: Synthetic peptide
  Seed: VVMGENNTLV (EGFR G598V)
VQMGENNTLF

SEQ ID NO: 4622 - protein, 11 aa, Artificial Sequence
  Description of Artificial Sequence: Synthetic peptide
  Seed: VVMGENNTLVW (EGFR G598V)
VQMGENNTLVC

SEQ ID NO: 4623 - protein, 11 aa, Artificial Sequence
  Description of Artificial Sequence: Synthetic peptide
  Seed: VVMGENNTLVW (EGFR G598V)
VQMGENNTLVF

SEQ ID NO: 4624 - protein, 11 aa, Artificial Sequence
  Description of Artificial Sequence: Synthetic peptide
  Seed: VVMGENNTLVW (EGFR G598V)
VQMGENNTLVH

SEQ ID NO: 4625 - protein, 11 aa, Artificial Sequence
  Description of Artificial Sequence: Synthetic peptide
  Seed: VVMGENNTLVW (EGFR G598V)
VQMGENNTLVI

SEQ ID NO: 4626 - protein, 11 aa, Artificial Sequence
  Description of Artificial Sequence: Synthetic peptide
  Seed: VVMGENNTLVW (EGFR G598V)
VQMGENNTLVK

SEQ ID NO: 4627 - protein, 11 aa, Artificial Sequence
  Description of Artificial Sequence: Synthetic peptide
  Seed: VVMGENNTLVW (EGFR G598V)
VQMGENNTLVL

SEQ ID NO: 4628 - protein, 11 aa, Artificial Sequence
  Description of Artificial Sequence: Synthetic peptide
  Seed: VVMGENNTLVW (EGFR G598V)
VQMGENNTLVM

SEQ ID NO: 4629 - protein, 11 aa, Artificial Sequence
  Description of Artificial Sequence: Synthetic peptide
  Seed: VVMGENNTLVW (EGFR G598V)
VQMGENNTLVR

SEQ ID NO: 4630 - protein, 11 aa, Artificial Sequence
  Description of Artificial Sequence: Synthetic peptide
  Seed: VVMGENNTLVW (EGFR G598V)
VQMGENNTLVV

SEQ ID NO: 4631 - protein, 11 aa, Artificial Sequence
  Description of Artificial Sequence: Synthetic peptide
  Seed: VVMGENNTLVW (EGFR G598V)
VQMGENNTLVY

SEQ ID NO: 4632 - protein, 10 aa, Artificial Sequence
  Description of Artificial Sequence: Synthetic peptide
  Seed: VVMGENNTLV (EGFR G598V)
VQMGENNTLW

SEQ ID NO: 4633 - protein, 10 aa, Artificial Sequence
  Description of Artificial Sequence: Synthetic peptide
  Seed: VVMGENNTLV (EGFR G598V)
VQMGENNTLY

SEQ ID NO: 4634 - protein, 9 aa, Artificial Sequence
  Description of Artificial Sequence: Synthetic peptide
  Seed: VVMGENNTL (EGFR G598V)
VQMGENNTR

SEQ ID NO: 4635 - protein, 9 aa, Artificial Sequence
  Description of Artificial Sequence: Synthetic peptide
  Seed: VVMGENNTL (EGFR G598V)
VQMGENNTT

SEQ ID NO: 4636 - protein, 9 aa, Artificial Sequence
  Description of Artificial Sequence: Synthetic peptide
  Seed: VVMGENNTL (EGFR G598V)
VQMGENNTW

SEQ ID NO: 4637 - protein, 9 aa, Artificial Sequence
  Description of Artificial Sequence: Synthetic peptide
  Seed: VVMGENNTL (EGFR G598V)
VRMGENNTA

SEQ ID NO: 4638 - protein, 9 aa, Artificial Sequence
  Description of Artificial Sequence: Synthetic peptide
  Seed: VVMGENNTL (EGFR G598V)
VRMGENNTC

SEQ ID NO: 4639 - protein, 9 aa, Artificial Sequence
  Description of Artificial Sequence: Synthetic peptide
  Seed: VVMGENNTL (EGFR G598V)
VRMGENNTF

SEQ ID NO: 4640 - protein, 9 aa, Artificial Sequence
  Description of Artificial Sequence: Synthetic peptide
  Seed: VVMGENNTL (EGFR G598V)
VRMGENNTH

SEQ ID NO: 4641 - protein, 9 aa, Artificial Sequence
  Description of Artificial Sequence: Synthetic peptide
  Seed: VVMGENNTL (EGFR G598V)
VRMGENNTI

SEQ ID NO: 4642 - protein, 9 aa, Artificial Sequence
  Description of Artificial Sequence: Synthetic peptide
  Seed: VVMGENNTL (EGFR G598V)
VRMGENNTK

SEQ ID NO: 4643 - protein, 11 aa, Artificial Sequence
  Description of Artificial Sequence: Synthetic peptide
  Seed: VVMGENNTLVW (EGFR G598V)
VRMGENNTLVW

SEQ ID NO: 4644 - protein, 11 aa, Artificial Sequence
  Description of Artificial Sequence: Synthetic peptide
  Seed: VVMGENNTLVW (EGFR G598V)
VRMGENNTLVY

SEQ ID NO: 4645 - protein, 9 aa, Artificial Sequence
  Description of Artificial Sequence: Synthetic peptide
  Seed: VVMGENNTL (EGFR G598V)
VRMGENNTM

SEQ ID NO: 4646 - protein, 9 aa, Artificial Sequence
  Description of Artificial Sequence: Synthetic peptide
  Seed: VVMGENNTL (EGFR G598V)
VRMGENNTR

SEQ ID NO: 4647 - protein, 9 aa, Artificial Sequence
  Description of Artificial Sequence: Synthetic peptide
  Seed: VVMGENNTL (EGFR G598V)
VRMGENNTV

SEQ ID NO: 4648 - protein, 9 aa, Artificial Sequence
  Description of Artificial Sequence: Synthetic peptide
  Seed: VVMGENNTL (EGFR G598V)
VRMGENNTW

SEQ ID NO: 4649 - protein, 9 aa, Artificial Sequence
  Description of Artificial Sequence: Synthetic peptide
  Seed: VVMGENNTL (EGFR G598V)
VRMGENNTY

SEQ ID NO: 4650 - protein, 9 aa, Artificial Sequence
  Description of Artificial Sequence: Synthetic peptide
  Seed: VKTCPAVVM (EGFR G598V)
VRTCPAVVL

SEQ ID NO: 4651 - protein, 9 aa, Artificial Sequence
  Description of Artificial Sequence: Synthetic peptide
  Seed: VVMGENNTL (EGFR G598V)
VSMGENNTA

SEQ ID NO: 4652 - protein, 9 aa, Artificial Sequence
  Description of Artificial Sequence: Synthetic peptide
  Seed: VVMGENNTL (EGFR G598V)
VSMGENNTC

SEQ ID NO: 4653 - protein, 9 aa, Artificial Sequence
  Description of Artificial Sequence: Synthetic peptide
  Seed: VVMGENNTL (EGFR G598V)
VSMGENNTH

SEQ ID NO: 4654 - protein, 9 aa, Artificial Sequence
  Description of Artificial Sequence: Synthetic peptide
  Seed: VVMGENNTL (EGFR G598V)
VSMGENNTK

SEQ ID NO: 4655 - protein, 10 aa, Artificial Sequence
  Description of Artificial Sequence: Synthetic peptide
  Seed: VVMGENNTLV (EGFR G598V)
VSMGENNTLI

SEQ ID NO: 4656 - protein, 11 aa, Artificial Sequence
  Description of Artificial Sequence: Synthetic peptide
  Seed: VVMGENNTLVW (EGFR G598V)
VSMGENNTLVC

SEQ ID NO: 4657 - protein, 11 aa, Artificial Sequence
  Description of Artificial Sequence: Synthetic peptide
  Seed: VVMGENNTLVW (EGFR G598V)
VSMGENNTLVH

SEQ ID NO: 4658 - protein, 11 aa, Artificial Sequence
  Description of Artificial Sequence: Synthetic peptide
  Seed: VVMGENNTLVW (EGFR G598V)
VSMGENNTLVK

SEQ ID NO: 4659 - protein, 11 aa, Artificial Sequence
  Description of Artificial Sequence: Synthetic peptide
  Seed: VVMGENNTLVW (EGFR G598V)
VSMGENNTLVR

SEQ ID NO: 4660 - protein, 11 aa, Artificial Sequence
  Description of Artificial Sequence: Synthetic peptide
  Seed: VVMGENNTLVW (EGFR G598V)
VSMGENNTLVV

SEQ ID NO: 4661 - protein, 9 aa, Artificial Sequence
  Description of Artificial Sequence: Synthetic peptide
  Seed: VVMGENNTL (EGFR G598V)
VSMGENNTR

SEQ ID NO: 4662 - protein, 9 aa, Artificial Sequence
  Description of Artificial Sequence: Synthetic peptide
  Seed: VVMGENNTL (EGFR G598V)
VSMGENNTW

SEQ ID NO: 4663 - protein, 9 aa, Artificial Sequence
  Description of Artificial Sequence: Synthetic peptide
  Seed: VVMGENNTL (EGFR G598V)
VTMGENNTA

SEQ ID NO: 4664 - protein, 9 aa, Artificial Sequence
  Description of Artificial Sequence: Synthetic peptide
  Seed: VVMGENNTL (EGFR G598V)
VTMGENNTC

SEQ ID NO: 4665 - protein, 9 aa, Artificial Sequence
  Description of Artificial Sequence: Synthetic peptide
  Seed: VVMGENNTL (EGFR G598V)
VTMGENNTH

SEQ ID NO: 4666 - protein, 9 aa, Artificial Sequence
  Description of Artificial Sequence: Synthetic peptide
  Seed: VVMGENNTL (EGFR G598V)
VTMGENNTK

SEQ ID NO: 4667 - protein, 10 aa, Artificial Sequence
  Description of Artificial Sequence: Synthetic peptide
  Seed: VVMGENNTLV (EGFR G598V)
VTMGENNTLA

SEQ ID NO: 4668 - protein, 10 aa, Artificial Sequence
  Description of Artificial Sequence: Synthetic peptide
  Seed: VVMGENNTLV (EGFR G598V)
VTMGENNTLI

SEQ ID NO: 4669 - protein, 10 aa, Artificial Sequence
  Description of Artificial Sequence: Synthetic peptide
  Seed: VVMGENNTLV (EGFR G598V)
VTMGENNTLM

SEQ ID NO: 4670 - protein, 11 aa, Artificial Sequence
  Description of Artificial Sequence: Synthetic peptide
  Seed: VVMGENNTLVW (EGFR G598V)
VTMGENNTLVC

SEQ ID NO: 4671 - protein, 11 aa, Artificial Sequence
  Description of Artificial Sequence: Synthetic peptide
  Seed: VVMGENNTLVW (EGFR G598V)
VTMGENNTLVH

SEQ ID NO: 4672 - protein, 11 aa, Artificial Sequence
  Description of Artificial Sequence: Synthetic peptide
  Seed: VVMGENNTLVW (EGFR G598V)
VTMGENNTLVK

SEQ ID NO: 4673 - protein, 11 aa, Artificial Sequence
  Description of Artificial Sequence: Synthetic peptide
  Seed: VVMGENNTLVW (EGFR G598V)
VTMGENNTLVR

SEQ ID NO: 4674 - protein, 11 aa, Artificial Sequence
  Description of Artificial Sequence: Synthetic peptide
  Seed: VVMGENNTLVW (EGFR G598V)
VTMGENNTLVV

SEQ ID NO: 4675 - protein, 9 aa, Artificial Sequence
  Description of Artificial Sequence: Synthetic peptide
  Seed: VVMGENNTL (EGFR G598V)
VTMGENNTR

SEQ ID NO: 4676 - protein, 9 aa, Artificial Sequence
  Description of Artificial Sequence: Synthetic peptide
  Seed: VVMGENNTL (EGFR G598V)
VTMGENNTW

SEQ ID NO: 4677 - protein, 9 aa, Artificial Sequence
  Description of Artificial Sequence: Synthetic peptide
  Seed: VVMGENNTL (EGFR G598V)
VVMGENNTA

SEQ ID NO: 4678 - protein, 9 aa, Artificial Sequence
  Description of Artificial Sequence: Synthetic peptide
  Seed: VVMGENNTL (EGFR G598V)
VVMGENNTH

SEQ ID NO: 4679 - protein, 9 aa, Artificial Sequence
  Description of Artificial Sequence: Synthetic peptide
  Seed: VVMGENNTL (EGFR G598V)
VVMGENNTK

SEQ ID NO: 4680 - protein, 10 aa, Artificial Sequence
  Description of Artificial Sequence: Synthetic peptide
  Seed: VVMGENNTLV (EGFR G598V)
VVMGENNTLA

SEQ ID NO: 4681 - protein, 10 aa, Artificial Sequence
  Description of Artificial Sequence: Synthetic peptide
  Seed: VVMGENNTLV (EGFR G598V)
VVMGENNTLM

SEQ ID NO: 4682 - protein, 10 aa, Artificial Sequence
  Description of Artificial Sequence: Synthetic peptide
  Seed: VVMGENNTLV (EGFR G598V)
VVMGENNTLT

SEQ ID NO: 4683 - protein, 11 aa, Artificial Sequence
  Description of Artificial Sequence: Synthetic peptide
  Seed: VVMGENNTLVW (EGFR G598V)
VVMGENNTLVH

SEQ ID NO: 4684 - protein, 11 aa, Artificial Sequence
  Description of Artificial Sequence: Synthetic peptide
  Seed: VVMGENNTLVW (EGFR G598V)
VVMGENNTLVI

SEQ ID NO: 4685 - protein, 11 aa, Artificial Sequence
  Description of Artificial Sequence: Synthetic peptide
  Seed: VVMGENNTLVW (EGFR G598V)
VVMGENNTLVK

SEQ ID NO: 4686 - protein, 11 aa, Artificial Sequence
  Description of Artificial Sequence: Synthetic peptide
  Seed: VVMGENNTLVW (EGFR G598V)
VVMGENNTLVL

SEQ ID NO: 4687 - protein, 11 aa, Artificial Sequence
  Description of Artificial Sequence: Synthetic peptide
  Seed: VVMGENNTLVW (EGFR G598V)
VVMGENNTLVM

SEQ ID NO: 4688 - protein, 11 aa, Artificial Sequence
  Description of Artificial Sequence: Synthetic peptide
  Seed: VVMGENNTLVW (EGFR G598V)
VVMGENNTLVR

SEQ ID NO: 4689 - protein, 9 aa, Artificial Sequence
  Description of Artificial Sequence: Synthetic peptide
  Seed: VVMGENNTL (EGFR G598V)
VVMGENNTR

SEQ ID NO: 4690 - protein, 9 aa, Artificial Sequence
  Description of Artificial Sequence: Synthetic peptide
  Seed: VVMGENNTL (EGFR G598V)
VVMGENNTW

SEQ ID NO: 4691 - protein, 9 aa, Artificial Sequence
  Description of Artificial Sequence: Synthetic peptide
  Seed: VVMGENNTL (EGFR G598V)
VWMGENNTF

SEQ ID NO: 4692 - protein, 9 aa, Artificial Sequence
  Description of Artificial Sequence: Synthetic peptide
  Seed: VVMGENNTL (EGFR G598V)
VWMGENNTI

SEQ ID NO: 4693 - protein, 9 aa, Artificial Sequence
  Description of Artificial Sequence: Synthetic peptide
  Seed: VVMGENNTL (EGFR G598V)
VWMGENNTK

SEQ ID NO: 4694 - protein, 9 aa, Artificial Sequence
  Description of Artificial Sequence: Synthetic peptide
  Seed: VVMGENNTL (EGFR G598V)
VWMGENNTL

SEQ ID NO: 4695 - protein, 11 aa, Artificial Sequence
  Description of Artificial Sequence: Synthetic peptide
  Seed: VVMGENNTLVW (EGFR G598V)
VWMGENNTLVW

SEQ ID NO: 4696 - protein, 11 aa, Artificial Sequence
  Description of Artificial Sequence: Synthetic peptide
  Seed: VVMGENNTLVW (EGFR G598V)
VWMGENNTLVY

SEQ ID NO: 4697 - protein, 9 aa, Artificial Sequence
  Description of Artificial Sequence: Synthetic peptide
  Seed: VVMGENNTL (EGFR G598V)
VWMGENNTM

SEQ ID NO: 4698 - protein, 9 aa, Artificial Sequence
  Description of Artificial Sequence: Synthetic peptide
  Seed: VVMGENNTL (EGFR G598V)
VWMGENNTR

SEQ ID NO: 4699 - protein, 9 aa, Artificial Sequence
  Description of Artificial Sequence: Synthetic peptide
  Seed: VVMGENNTL (EGFR G598V)
VWMGENNTW

SEQ ID NO: 4700 - protein, 9 aa, Artificial Sequence
  Description of Artificial Sequence: Synthetic peptide
  Seed: VVMGENNTL (EGFR G598V)
VWMGENNTY

SEQ ID NO: 4701 - protein, 9 aa, Artificial Sequence
  Description of Artificial Sequence: Synthetic peptide
  Seed: VVMGENNTL (EGFR G598V)
VYMGENNTF

SEQ ID NO: 4702 - protein, 9 aa, Artificial Sequence
  Description of Artificial Sequence: Synthetic peptide
  Seed: VVMGENNTL (EGFR G598V)
VYMGENNTI

SEQ ID NO: 4703 - protein, 9 aa, Artificial Sequence
  Description of Artificial Sequence: Synthetic peptide
  Seed: VVMGENNTL (EGFR G598V)
VYMGENNTK

SEQ ID NO: 4704 - protein, 9 aa, Artificial Sequence
  Description of Artificial Sequence: Synthetic peptide
  Seed: VVMGENNTL (EGFR G598V)
VYMGENNTL

SEQ ID NO: 4705 - protein, 11 aa, Artificial Sequence
  Description of Artificial Sequence: Synthetic peptide
  Seed: VVMGENNTLVW (EGFR G598V)
VYMGENNTLVW

SEQ ID NO: 4706 - protein, 11 aa, Artificial Sequence
  Description of Artificial Sequence: Synthetic peptide
  Seed: VVMGENNTLVW (EGFR G598V)
VYMGENNTLVY

SEQ ID NO: 4707 - protein, 9 aa, Artificial Sequence
  Description of Artificial Sequence: Synthetic peptide
  Seed: VVMGENNTL (EGFR G598V)
VYMGENNTM

SEQ ID NO: 4708 - protein, 9 aa, Artificial Sequence
  Description of Artificial Sequence: Synthetic peptide
  Seed: VVMGENNTL (EGFR G598V)
VYMGENNTR

SEQ ID NO: 4709 - protein, 9 aa, Artificial Sequence
  Description of Artificial Sequence: Synthetic peptide
  Seed: VVMGENNTL (EGFR G598V)
VYMGENNTV

SEQ ID NO: 4710 - protein, 9 aa, Artificial Sequence
  Description of Artificial Sequence: Synthetic peptide
  Seed: VVMGENNTL (EGFR G598V)
VYMGENNTW

SEQ ID NO: 4711 - protein, 9 aa, Artificial Sequence
  Description of Artificial Sequence: Synthetic peptide
  Seed: VVMGENNTL (EGFR G598V)
VYMGENNTY

SEQ ID NO: 4712 - protein, 9 aa, Homo sapiens
  Native (EGFR G598V)
CVKTCPAVV

SEQ ID NO: 4713 - protein, 9 aa, Homo sapiens
  Native (EGFR G598V)
VKTCPAVVM

SEQ ID NO: 4714 - protein, 9 aa, Homo sapiens
  Native (EGFR G598V)
VVMGENNTL

SEQ ID NO: 4715 - protein, 10 aa, Homo sapiens
  Native (EGFR G598V)
VVMGENNTLV

SEQ ID NO: 4716 - protein, 11 aa, Homo sapiens
  Native (EGFR G598V)
VVMGENNTLVW

SEQ ID NO: 4717 - protein, 10 aa, Homo sapiens
  Native (EGFR G598V)
CVKTCPAVVM

SEQ ID NO: 4718 - protein, 8 aa, Homo sapiens
  Native (EGFR G598V)
KTCPAVVM

SEQ ID NO: 4719 - protein, 9 aa, Artificial Sequence
  Description of Artificial Sequence: Synthetic peptide
  Seed: FGRAKLLGA (EGFR L858R)
FARAKLLGA

SEQ ID NO: 4720 - protein, 9 aa, Artificial Sequence
  Description of Artificial Sequence: Synthetic peptide
  Seed: FGRAKLLGA (EGFR L858R)
FARAKLLGC

SEQ ID NO: 4721 - protein, 9 aa, Artificial Sequence
  Description of Artificial Sequence: Synthetic peptide
  Seed: FGRAKLLGA (EGFR L858R)
FARAKLLGF

SEQ ID NO: 4722 - protein, 9 aa, Artificial Sequence
  Description of Artificial Sequence: Synthetic peptide
  Seed: FGRAKLLGA (EGFR L858R)
FARAKLLGI

SEQ ID NO: 4723 - protein, 9 aa, Artificial Sequence
  Description of Artificial Sequence: Synthetic peptide
  Seed: FGRAKLLGA (EGFR L858R)
FARAKLLGK

SEQ ID NO: 4724 - protein, 9 aa, Artificial Sequence
  Description of Artificial Sequence: Synthetic peptide
  Seed: FGRAKLLGA (EGFR L858R)
FARAKLLGL

SEQ ID NO: 4725 - protein, 9 aa, Artificial Sequence
  Description of Artificial Sequence: Synthetic peptide
  Seed: FGRAKLLGA (EGFR L858R)
FARAKLLGM

SEQ ID NO: 4726 - protein, 9 aa, Artificial Sequence
  Description of Artificial Sequence: Synthetic peptide
  Seed: FGRAKLLGA (EGFR L858R)
FARAKLLGV

SEQ ID NO: 4727 - protein, 9 aa, Artificial Sequence
  Description of Artificial Sequence: Synthetic peptide
  Seed: FGRAKLLGA (EGFR L858R)
FCRAKLLGL

SEQ ID NO: 4728 - protein, 9 aa, Artificial Sequence
  Description of Artificial Sequence: Synthetic peptide
  Seed: FGRAKLLGA (EGFR L858R)
FCRAKLLGM

SEQ ID NO: 4729 - protein, 9 aa, Artificial Sequence
  Description of Artificial Sequence: Synthetic peptide
  Seed: FGRAKLLGA (EGFR L858R)
FERAKLLGL

SEQ ID NO: 4730 - protein, 9 aa, Artificial Sequence
  Description of Artificial Sequence: Synthetic peptide
  Seed: FGRAKLLGA (EGFR L858R)
FERAKLLGM

SEQ ID NO: 4731 - protein, 9 aa, Artificial Sequence
  Description of Artificial Sequence: Synthetic peptide
  Seed: FGRAKLLGA (EGFR L858R)
FFRAKLLGA

SEQ ID NO: 4732 - protein, 9 aa, Artificial Sequence
  Description of Artificial Sequence: Synthetic peptide
  Seed: FGRAKLLGA (EGFR L858R)
FFRAKLLGF

SEQ ID NO: 4733 - protein, 9 aa, Artificial Sequence
  Description of Artificial Sequence: Synthetic peptide
  Seed: FGRAKLLGA (EGFR L858R)
FFRAKLLGI

SEQ ID NO: 4734 - protein, 9 aa, Artificial Sequence
  Description of Artificial Sequence: Synthetic peptide
  Seed: FGRAKLLGA (EGFR L858R)
FFRAKLLGK

SEQ ID NO: 4735 - protein, 9 aa, Artificial Sequence
  Description of Artificial Sequence: Synthetic peptide
  Seed: FGRAKLLGA (EGFR L858R)
FFRAKLLGL

SEQ ID NO: 4736 - protein, 9 aa, Artificial Sequence
  Description of Artificial Sequence: Synthetic peptide
  Seed: FGRAKLLGA (EGFR L858R)
FFRAKLLGM

SEQ ID NO: 4737 - protein, 9 aa, Artificial Sequence
  Description of Artificial Sequence: Synthetic peptide
  Seed: FGRAKLLGA (EGFR L858R)
FFRAKLLGV

SEQ ID NO: 4738 - protein, 9 aa, Artificial Sequence
  Description of Artificial Sequence: Synthetic peptide
  Seed: FGRAKLLGA (EGFR L858R)
FGRAKLLGF

SEQ ID NO: 4739 - protein, 9 aa, Artificial Sequence
  Description of Artificial Sequence: Synthetic peptide
  Seed: FGRAKLLGA (EGFR L858R)
FGRAKLLGI

SEQ ID NO: 4740 - protein, 9 aa, Artificial Sequence
  Description of Artificial Sequence: Synthetic peptide
  Seed: FGRAKLLGA (EGFR L858R)
FGRAKLLGK

SEQ ID NO: 4741 - protein, 9 aa, Artificial Sequence
  Description of Artificial Sequence: Synthetic peptide
  Seed: FGRAKLLGA (EGFR L858R)
FGRAKLLGL

SEQ ID NO: 4742 - protein, 9 aa, Artificial Sequence
  Description of Artificial Sequence: Synthetic peptide
  Seed: FGRAKLLGA (EGFR L858R)
FGRAKLLGM

SEQ ID NO: 4743 - protein, 9 aa, Artificial Sequence
  Description of Artificial Sequence: Synthetic peptide
  Seed: FGRAKLLGA (EGFR L858R)
FGRAKLLGV

SEQ ID NO: 4744 - protein, 9 aa, Artificial Sequence
  Description of Artificial Sequence: Synthetic peptide
  Seed: FGRAKLLGA (EGFR L858R)
FHRAKLLGK

SEQ ID NO: 4745 - protein, 9 aa, Artificial Sequence
  Description of Artificial Sequence: Synthetic peptide
  Seed: FGRAKLLGA (EGFR L858R)
FIRAKLLGA

SEQ ID NO: 4746 - protein, 9 aa, Artificial Sequence
  Description of Artificial Sequence: Synthetic peptide
  Seed: FGRAKLLGA (EGFR L858R)
FIRAKLLGC

SEQ ID NO: 4747 - protein, 9 aa, Artificial Sequence
  Description of Artificial Sequence: Synthetic peptide
  Seed: FGRAKLLGA (EGFR L858R)
FIRAKLLGF

SEQ ID NO: 4748 - protein, 9 aa, Artificial Sequence
  Description of Artificial Sequence: Synthetic peptide
  Seed: FGRAKLLGA (EGFR L858R)
FIRAKLLGI

SEQ ID NO: 4749 - protein, 9 aa, Artificial Sequence
  Description of Artificial Sequence: Synthetic peptide
  Seed: FGRAKLLGA (EGFR L858R)
FIRAKLLGK

SEQ ID NO: 4750 - protein, 9 aa, Artificial Sequence
  Description of Artificial Sequence: Synthetic peptide
  Seed: FGRAKLLGA (EGFR L858R)
FIRAKLLGL

SEQ ID NO: 4751 - protein, 9 aa, Artificial Sequence
  Description of Artificial Sequence: Synthetic peptide
  Seed: FGRAKLLGA (EGFR L858R)
FIRAKLLGM

SEQ ID NO: 4752 - protein, 9 aa, Artificial Sequence
  Description of Artificial Sequence: Synthetic peptide
  Seed: FGRAKLLGA (EGFR L858R)
FIRAKLLGV

SEQ ID NO: 4753 - protein, 9 aa, Artificial Sequence
  Description of Artificial Sequence: Synthetic peptide
  Seed: FGRAKLLGA (EGFR L858R)
FKRAKLLGF

SEQ ID NO: 4754 - protein, 9 aa, Artificial Sequence
  Description of Artificial Sequence: Synthetic peptide
  Seed: FGRAKLLGA (EGFR L858R)
FKRAKLLGI

SEQ ID NO: 4755 - protein, 9 aa, Artificial Sequence
  Description of Artificial Sequence: Synthetic peptide
  Seed: FGRAKLLGA (EGFR L858R)
FKRAKLLGL

SEQ ID NO: 4756 - protein, 9 aa, Artificial Sequence
  Description of Artificial Sequence: Synthetic peptide
  Seed: FGRAKLLGA (EGFR L858R)
FKRAKLLGM

SEQ ID NO: 4757 - protein, 9 aa, Artificial Sequence
  Description of Artificial Sequence: Synthetic peptide
  Seed: FGRAKLLGA (EGFR L858R)
FKRAKLLGV

SEQ ID NO: 4758 - protein, 9 aa, Artificial Sequence
  Description of Artificial Sequence: Synthetic peptide
  Seed: FGRAKLLGA (EGFR L858R)
FLRAKLLGA

SEQ ID NO: 4759 - protein, 9 aa, Artificial Sequence
  Description of Artificial Sequence: Synthetic peptide
  Seed: FGRAKLLGA (EGFR L858R)
FLRAKLLGC

SEQ ID NO: 4760 - protein, 9 aa, Artificial Sequence
  Description of Artificial Sequence: Synthetic peptide
  Seed: FGRAKLLGA (EGFR L858R)
FLRAKLLGF

SEQ ID NO: 4761 - protein, 9 aa, Artificial Sequence
  Description of Artificial Sequence: Synthetic peptide
  Seed: FGRAKLLGA (EGFR L858R)
FLRAKLLGG

SEQ ID NO: 4762 - protein, 9 aa, Artificial Sequence
  Description of Artificial Sequence: Synthetic peptide
  Seed: FGRAKLLGA (EGFR L858R)
FLRAKLLGI

SEQ ID NO: 4763 - protein, 9 aa, Artificial Sequence
  Description of Artificial Sequence: Synthetic peptide
  Seed: FGRAKLLGA (EGFR L858R)
FLRAKLLGK

SEQ ID NO: 4764 - protein, 9 aa, Artificial Sequence
  Description of Artificial Sequence: Synthetic peptide
  Seed: FGRAKLLGA (EGFR L858R)
FLRAKLLGL

SEQ ID NO: 4765 - protein, 9 aa, Artificial Sequence
  Description of Artificial Sequence: Synthetic peptide
  Seed: FGRAKLLGA (EGFR L858R)
FLRAKLLGM

SEQ ID NO: 4766 - protein, 9 aa, Artificial Sequence
  Description of Artificial Sequence: Synthetic peptide
  Seed: FGRAKLLGA (EGFR L858R)
FLRAKLLGS

SEQ ID NO: 4767 - protein, 9 aa, Artificial Sequence
  Description of Artificial Sequence: Synthetic peptide
  Seed: FGRAKLLGA (EGFR L858R)
FLRAKLLGT

SEQ ID NO: 4768 - protein, 9 aa, Artificial Sequence
  Description of Artificial Sequence: Synthetic peptide
  Seed: FGRAKLLGA (EGFR L858R)
FLRAKLLGV

SEQ ID NO: 4769 - protein, 9 aa, Artificial Sequence
  Description of Artificial Sequence: Synthetic peptide
  Seed: FGRAKLLGA (EGFR L858R)
FMRAKLLGA

SEQ ID NO: 4770 - protein, 9 aa, Artificial Sequence
  Description of Artificial Sequence: Synthetic peptide
  Seed: FGRAKLLGA (EGFR L858R)
FMRAKLLGC

SEQ ID NO: 4771 - protein, 9 aa, Artificial Sequence
  Description of Artificial Sequence: Synthetic peptide
  Seed: FGRAKLLGA (EGFR L858R)
FMRAKLLGE

SEQ ID NO: 4772 - protein, 9 aa, Artificial Sequence
  Description of Artificial Sequence: Synthetic peptide
  Seed: FGRAKLLGA (EGFR L858R)
FMRAKLLGF

SEQ ID NO: 4773 - protein, 9 aa, Artificial Sequence
  Description of Artificial Sequence: Synthetic peptide
  Seed: FGRAKLLGA (EGFR L858R)
FMRAKLLGG

SEQ ID NO: 4774 - protein, 9 aa, Artificial Sequence
  Description of Artificial Sequence: Synthetic peptide
  Seed: FGRAKLLGA (EGFR L858R)
FMRAKLLGI

SEQ ID NO: 4775 - protein, 9 aa, Artificial Sequence
  Description of Artificial Sequence: Synthetic peptide
  Seed: FGRAKLLGA (EGFR L858R)
FMRAKLLGK

SEQ ID NO: 4776 - protein, 9 aa, Artificial Sequence
  Description of Artificial Sequence: Synthetic peptide
  Seed: FGRAKLLGA (EGFR L858R)
FMRAKLLGM

SEQ ID NO: 4777 - protein, 9 aa, Artificial Sequence
  Description of Artificial Sequence: Synthetic peptide
  Seed: FGRAKLLGA (EGFR L858R)
FMRAKLLGP

SEQ ID NO: 4778 - protein, 9 aa, Artificial Sequence
  Description of Artificial Sequence: Synthetic peptide
  Seed: FGRAKLLGA (EGFR L858R)
FMRAKLLGS

SEQ ID NO: 4779 - protein, 9 aa, Artificial Sequence
  Description of Artificial Sequence: Synthetic peptide
  Seed: FGRAKLLGA (EGFR L858R)
FMRAKLLGT

SEQ ID NO: 4780 - protein, 9 aa, Artificial Sequence
  Description of Artificial Sequence: Synthetic peptide
  Seed: FGRAKLLGA (EGFR L858R)
FMRAKLLGV

SEQ ID NO: 4781 - protein, 9 aa, Artificial Sequence
  Description of Artificial Sequence: Synthetic peptide
  Seed: FGRAKLLGA (EGFR L858R)
FMRAKLLGW

SEQ ID NO: 4782 - protein, 9 aa, Artificial Sequence
  Description of Artificial Sequence: Synthetic peptide
  Seed: FGRAKLLGA (EGFR L858R)
FNRAKLLGA

SEQ ID NO: 4783 - protein, 9 aa, Artificial Sequence
  Description of Artificial Sequence: Synthetic peptide
  Seed: FGRAKLLGA (EGFR L858R)
FNRAKLLGF

SEQ ID NO: 4784 - protein, 9 aa, Artificial Sequence
  Description of Artificial Sequence: Synthetic peptide
  Seed: FGRAKLLGA (EGFR L858R)
FNRAKLLGI

SEQ ID NO: 4785 - protein, 9 aa, Artificial Sequence
  Description of Artificial Sequence: Synthetic peptide
  Seed: FGRAKLLGA (EGFR L858R)
FNRAKLLGK

SEQ ID NO: 4786 - protein, 9 aa, Artificial Sequence
  Description of Artificial Sequence: Synthetic peptide
  Seed: FGRAKLLGA (EGFR L858R)
FNRAKLLGL

SEQ ID NO: 4787 - protein, 9 aa, Artificial Sequence
  Description of Artificial Sequence: Synthetic peptide
  Seed: FGRAKLLGA (EGFR L858R)
FNRAKLLGM

SEQ ID NO: 4788 - protein, 9 aa, Artificial Sequence
  Description of Artificial Sequence: Synthetic peptide
  Seed: FGRAKLLGA (EGFR L858R)
FNRAKLLGV

SEQ ID NO: 4789 - protein, 9 aa, Artificial Sequence
  Description of Artificial Sequence: Synthetic peptide
  Seed: FGRAKLLGA (EGFR L858R)
FPRAKLLGA

SEQ ID NO: 4790 - protein, 9 aa, Artificial Sequence
  Description of Artificial Sequence: Synthetic peptide
  Seed: FGRAKLLGA (EGFR L858R)
FPRAKLLGC

SEQ ID NO: 4791 - protein, 9 aa, Artificial Sequence
  Description of Artificial Sequence: Synthetic peptide
  Seed: FGRAKLLGA (EGFR L858R)
FPRAKLLGF

SEQ ID NO: 4792 - protein, 9 aa, Artificial Sequence
  Description of Artificial Sequence: Synthetic peptide
  Seed: FGRAKLLGA (EGFR L858R)
FPRAKLLGG

SEQ ID NO: 4793 - protein, 9 aa, Artificial Sequence
  Description of Artificial Sequence: Synthetic peptide
  Seed: FGRAKLLGA (EGFR L858R)
FPRAKLLGI

SEQ ID NO: 4794 - protein, 9 aa, Artificial Sequence
  Description of Artificial Sequence: Synthetic peptide
  Seed: FGRAKLLGA (EGFR L858R)
FPRAKLLGM

SEQ ID NO: 4795 - protein, 9 aa, Artificial Sequence
  Description of Artificial Sequence: Synthetic peptide
  Seed: FGRAKLLGA (EGFR L858R)
FPRAKLLGT

SEQ ID NO: 4796 - protein, 9 aa, Artificial Sequence
  Description of Artificial Sequence: Synthetic peptide
  Seed: FGRAKLLGA (EGFR L858R)
FPRAKLLGV

SEQ ID NO: 4797 - protein, 9 aa, Artificial Sequence
  Description of Artificial Sequence: Synthetic peptide
  Seed: FGRAKLLGA (EGFR L858R)
FQRAKLLGA

SEQ ID NO: 4798 - protein, 9 aa, Artificial Sequence
  Description of Artificial Sequence: Synthetic peptide
  Seed: FGRAKLLGA (EGFR L858R)
FQRAKLLGF

SEQ ID NO: 4799 - protein, 9 aa, Artificial Sequence
  Description of Artificial Sequence: Synthetic peptide
  Seed: FGRAKLLGA (EGFR L858R)
FQRAKLLGI

SEQ ID NO: 4800 - protein, 9 aa, Artificial Sequence
  Description of Artificial Sequence: Synthetic peptide
  Seed: FGRAKLLGA (EGFR L858R)
FQRAKLLGK

SEQ ID NO: 4801 - protein, 9 aa, Artificial Sequence
  Description of Artificial Sequence: Synthetic peptide
  Seed: FGRAKLLGA (EGFR L858R)
FQRAKLLGM

SEQ ID NO: 4802 - protein, 9 aa, Artificial Sequence
  Description of Artificial Sequence: Synthetic peptide
  Seed: FGRAKLLGA (EGFR L858R)
FQRAKLLGV

SEQ ID NO: 4803 - protein, 9 aa, Artificial Sequence
  Description of Artificial Sequence: Synthetic peptide
  Seed: FGRAKLLGA (EGFR L858R)
FRRAKLLGF

SEQ ID NO: 4804 - protein, 9 aa, Artificial Sequence
  Description of Artificial Sequence: Synthetic peptide
  Seed: FGRAKLLGA (EGFR L858R)
FRRAKLLGI

SEQ ID NO: 4805 - protein, 9 aa, Artificial Sequence
  Description of Artificial Sequence: Synthetic peptide
  Seed: FGRAKLLGA (EGFR L858R)
FRRAKLLGL

SEQ ID NO: 4806 - protein, 9 aa, Artificial Sequence
  Description of Artificial Sequence: Synthetic peptide
  Seed: FGRAKLLGA (EGFR L858R)
FRRAKLLGM

SEQ ID NO: 4807 - protein, 9 aa, Artificial Sequence
  Description of Artificial Sequence: Synthetic peptide
  Seed: FGRAKLLGA (EGFR L858R)
FRRAKLLGV

SEQ ID NO: 4808 - protein, 9 aa, Artificial Sequence
  Description of Artificial Sequence: Synthetic peptide
  Seed: FGRAKLLGA (EGFR L858R)
FSRAKLLGA

SEQ ID NO: 4809 - protein, 9 aa, Artificial Sequence
  Description of Artificial Sequence: Synthetic peptide
  Seed: FGRAKLLGA (EGFR L858R)
FSRAKLLGF

SEQ ID NO: 4810 - protein, 9 aa, Artificial Sequence
  Description of Artificial Sequence: Synthetic peptide
  Seed: FGRAKLLGA (EGFR L858R)
FSRAKLLGG

SEQ ID NO: 4811 - protein, 9 aa, Artificial Sequence
  Description of Artificial Sequence: Synthetic peptide
  Seed: FGRAKLLGA (EGFR L858R)
FSRAKLLGI

SEQ ID NO: 4812 - protein, 9 aa, Artificial Sequence
  Description of Artificial Sequence: Synthetic peptide
  Seed: FGRAKLLGA (EGFR L858R)
FSRAKLLGK

SEQ ID NO: 4813 - protein, 9 aa, Artificial Sequence
  Description of Artificial Sequence: Synthetic peptide
  Seed: FGRAKLLGA (EGFR L858R)
FSRAKLLGL

SEQ ID NO: 4814 - protein, 9 aa, Artificial Sequence
  Description of Artificial Sequence: Synthetic peptide
  Seed: FGRAKLLGA (EGFR L858R)
FSRAKLLGM

SEQ ID NO: 4815 - protein, 9 aa, Artificial Sequence
  Description of Artificial Sequence: Synthetic peptide
  Seed: FGRAKLLGA (EGFR L858R)
FSRAKLLGR

SEQ ID NO: 4816 - protein, 9 aa, Artificial Sequence
  Description of Artificial Sequence: Synthetic peptide
  Seed: FGRAKLLGA (EGFR L858R)
FSRAKLLGS

SEQ ID NO: 4817 - protein, 9 aa, Artificial Sequence
  Description of Artificial Sequence: Synthetic peptide
  Seed: FGRAKLLGA (EGFR L858R)
FSRAKLLGT

SEQ ID NO: 4818 - protein, 9 aa, Artificial Sequence
  Description of Artificial Sequence: Synthetic peptide
  Seed: FGRAKLLGA (EGFR L858R)
FSRAKLLGV

SEQ ID NO: 4819 - protein, 9 aa, Artificial Sequence
  Description of Artificial Sequence: Synthetic peptide
  Seed: FGRAKLLGA (EGFR L858R)
FSRAKLLGY

SEQ ID NO: 4820 - protein, 9 aa, Artificial Sequence
  Description of Artificial Sequence: Synthetic peptide
  Seed: FGRAKLLGA (EGFR L858R)
FTRAKLLGA

SEQ ID NO: 4821 - protein, 9 aa, Artificial Sequence
  Description of Artificial Sequence: Synthetic peptide
  Seed: FGRAKLLGA (EGFR L858R)
FTRAKLLGF

SEQ ID NO: 4822 - protein, 9 aa, Artificial Sequence
  Description of Artificial Sequence: Synthetic peptide
  Seed: FGRAKLLGA (EGFR L858R)
FTRAKLLGG

SEQ ID NO: 4823 - protein, 9 aa, Artificial Sequence
  Description of Artificial Sequence: Synthetic peptide
  Seed: FGRAKLLGA (EGFR L858R)
FTRAKLLGI

SEQ ID NO: 4824 - protein, 9 aa, Artificial Sequence
  Description of Artificial Sequence: Synthetic peptide
  Seed: FGRAKLLGA (EGFR L858R)
FTRAKLLGK

SEQ ID NO: 4825 - protein, 9 aa, Artificial Sequence
  Description of Artificial Sequence: Synthetic peptide
  Seed: FGRAKLLGA (EGFR L858R)
FTRAKLLGL

SEQ ID NO: 4826 - protein, 9 aa, Artificial Sequence
  Description of Artificial Sequence: Synthetic peptide
  Seed: FGRAKLLGA (EGFR L858R)
FTRAKLLGM

SEQ ID NO: 4827 - protein, 9 aa, Artificial Sequence
  Description of Artificial Sequence: Synthetic peptide
  Seed: FGRAKLLGA (EGFR L858R)
FTRAKLLGS

SEQ ID NO: 4828 - protein, 9 aa, Artificial Sequence
  Description of Artificial Sequence: Synthetic peptide
  Seed: FGRAKLLGA (EGFR L858R)
FTRAKLLGT

SEQ ID NO: 4829 - protein, 9 aa, Artificial Sequence
  Description of Artificial Sequence: Synthetic peptide
  Seed: FGRAKLLGA (EGFR L858R)
FTRAKLLGV

SEQ ID NO: 4830 - protein, 9 aa, Artificial Sequence
  Description of Artificial Sequence: Synthetic peptide
  Seed: FGRAKLLGA (EGFR L858R)
FTRAKLLGY

SEQ ID NO: 4831 - protein, 9 aa, Artificial Sequence
  Description of Artificial Sequence: Synthetic peptide
  Seed: FGRAKLLGA (EGFR L858R)
FVRAKLLGA

SEQ ID NO: 4832 - protein, 9 aa, Artificial Sequence
  Description of Artificial Sequence: Synthetic peptide
  Seed: FGRAKLLGA (EGFR L858R)
FVRAKLLGF

SEQ ID NO: 4833 - protein, 9 aa, Artificial Sequence
  Description of Artificial Sequence: Synthetic peptide
  Seed: FGRAKLLGA (EGFR L858R)
FVRAKLLGG

SEQ ID NO: 4834 - protein, 9 aa, Artificial Sequence
  Description of Artificial Sequence: Synthetic peptide
  Seed: FGRAKLLGA (EGFR L858R)
FVRAKLLGI

SEQ ID NO: 4835 - protein, 9 aa, Artificial Sequence
  Description of Artificial Sequence: Synthetic peptide
  Seed: FGRAKLLGA (EGFR L858R)
FVRAKLLGK

SEQ ID NO: 4836 - protein, 9 aa, Artificial Sequence
  Description of Artificial Sequence: Synthetic peptide
  Seed: FGRAKLLGA (EGFR L858R)
FVRAKLLGL

SEQ ID NO: 4837 - protein, 9 aa, Artificial Sequence
  Description of Artificial Sequence: Synthetic peptide
  Seed: FGRAKLLGA (EGFR L858R)
FVRAKLLGM

SEQ ID NO: 4838 - protein, 9 aa, Artificial Sequence
  Description of Artificial Sequence: Synthetic peptide
  Seed: FGRAKLLGA (EGFR L858R)
FVRAKLLGV

SEQ ID NO: 4839 - protein, 9 aa, Artificial Sequence
  Description of Artificial Sequence: Synthetic peptide
  Seed: FGRAKLLGA (EGFR L858R)
FWRAKLLGI

SEQ ID NO: 4840 - protein, 9 aa, Artificial Sequence
  Description of Artificial Sequence: Synthetic peptide
  Seed: FGRAKLLGA (EGFR L858R)
FWRAKLLGK

SEQ ID NO: 4841 - protein, 9 aa, Artificial Sequence
  Description of Artificial Sequence: Synthetic peptide
  Seed: FGRAKLLGA (EGFR L858R)
FWRAKLLGL

SEQ ID NO: 4842 - protein, 9 aa, Artificial Sequence
  Description of Artificial Sequence: Synthetic peptide
  Seed: FGRAKLLGA (EGFR L858R)
FWRAKLLGM

SEQ ID NO: 4843 - protein, 9 aa, Artificial Sequence
  Description of Artificial Sequence: Synthetic peptide
  Seed: FGRAKLLGA (EGFR L858R)
FWRAKLLGV

SEQ ID NO: 4844 - protein, 9 aa, Artificial Sequence
  Description of Artificial Sequence: Synthetic peptide
  Seed: FGRAKLLGA (EGFR L858R)
FYRAKLLGA

SEQ ID NO: 4845 - protein, 9 aa, Artificial Sequence
  Description of Artificial Sequence: Synthetic peptide
  Seed: FGRAKLLGA (EGFR L858R)
FYRAKLLGK

SEQ ID NO: 4846 - protein, 9 aa, Artificial Sequence
  Description of Artificial Sequence: Synthetic peptide
  Seed: FGRAKLLGA (EGFR L858R)
FYRAKLLGL

SEQ ID NO: 4847 - protein, 9 aa, Artificial Sequence
  Description of Artificial Sequence: Synthetic peptide
  Seed: FGRAKLLGA (EGFR L858R)
FYRAKLLGM

SEQ ID NO: 4848 - protein, 9 aa, Artificial Sequence
  Description of Artificial Sequence: Synthetic peptide
  Seed: FGRAKLLGA (EGFR L858R)
FYRAKLLGV

SEQ ID NO: 4849 - protein, 11 aa, Artificial Sequence
  Description of Artificial Sequence: Synthetic peptide
  Seed: HVKITDFGRAK (EGFR L858R)
HMKITDFGRAK

SEQ ID NO: 4850 - protein, 11 aa, Artificial Sequence
  Description of Artificial Sequence: Synthetic peptide
  Seed: HVKITDFGRAK (EGFR L858R)
HSKITDFGRAK

SEQ ID NO: 4851 - protein, 11 aa, Artificial Sequence
  Description of Artificial Sequence: Synthetic peptide
  Seed: HVKITDFGRAK (EGFR L858R)
HTKITDFGRAK

SEQ ID NO: 4852 - protein, 11 aa, Artificial Sequence
  Description of Artificial Sequence: Synthetic peptide
  Seed: HVKITDFGRAK (EGFR L858R)
HYKITDFGRAK

SEQ ID NO: 4853 - protein, 9 aa, Artificial Sequence
  Description of Artificial Sequence: Synthetic peptide
  Seed: ITDFGRAKL (EGFR L858R)
IADFGRAKF

SEQ ID NO: 4854 - protein, 9 aa, Artificial Sequence
  Description of Artificial Sequence: Synthetic peptide
  Seed: ITDFGRAKL (EGFR L858R)
IADFGRAKI

SEQ ID NO: 4855 - protein, 10 aa, Artificial Sequence
  Description of Artificial Sequence: Synthetic peptide
  Seed: ITDFGRAKLL (EGFR L858R)
IADFGRAKLF

SEQ ID NO: 4856 - protein, 10 aa, Artificial Sequence
  Description of Artificial Sequence: Synthetic peptide
  Seed: ITDFGRAKLL (EGFR L858R)
IADFGRAKLL

SEQ ID NO: 4857 - protein, 10 aa, Artificial Sequence
  Description of Artificial Sequence: Synthetic peptide
  Seed: ITDFGRAKLL (EGFR L858R)
IADFGRAKLM

SEQ ID NO: 4858 - protein, 10 aa, Artificial Sequence
  Description of Artificial Sequence: Synthetic peptide
  Seed: ITDFGRAKLL (EGFR L858R)
IADFGRAKLW

SEQ ID NO: 4859 - protein, 10 aa, Artificial Sequence
  Description of Artificial Sequence: Synthetic peptide
  Seed: ITDFGRAKLL (EGFR L858R)
IADFGRAKLY

SEQ ID NO: 4860 - protein, 9 aa, Artificial Sequence
  Description of Artificial Sequence: Synthetic peptide
  Seed: ITDFGRAKL (EGFR L858R)
IADFGRAKV

SEQ ID NO: 4861 - protein, 9 aa, Artificial Sequence
  Description of Artificial Sequence: Synthetic peptide
  Seed: ITDFGRAKL (EGFR L858R)
IADFGRAKY

SEQ ID NO: 4862 - protein, 9 aa, Artificial Sequence
  Description of Artificial Sequence: Synthetic peptide
  Seed: ITDFGRAKL (EGFR L858R)
ICDFGRAKL

SEQ ID NO: 4863 - protein, 9 aa, Artificial Sequence
  Description of Artificial Sequence: Synthetic peptide
  Seed: ITDFGRAKL (EGFR L858R)
ICDFGRAKM

SEQ ID NO: 4864 - protein, 9 aa, Artificial Sequence
  Description of Artificial Sequence: Synthetic peptide
  Seed: ITDFGRAKL (EGFR L858R)
IGDFGRAKF

SEQ ID NO: 4865 - protein, 9 aa, Artificial Sequence
  Description of Artificial Sequence: Synthetic peptide
  Seed: ITDFGRAKL (EGFR L858R)
IGDFGRAKL

SEQ ID NO: 4866 - protein, 9 aa, Artificial Sequence
  Description of Artificial Sequence: Synthetic peptide
  Seed: ITDFGRAKL (EGFR L858R)
IGDFGRAKM

SEQ ID NO: 4867 - protein, 9 aa, Artificial Sequence
  Description of Artificial Sequence: Synthetic peptide
  Seed: ITDFGRAKL (EGFR L858R)
IIDFGRAKF

SEQ ID NO: 4868 - protein, 9 aa, Artificial Sequence
  Description of Artificial Sequence: Synthetic peptide
  Seed: ITDFGRAKL (EGFR L858R)
IIDFGRAKI

SEQ ID NO: 4869 - protein, 9 aa, Artificial Sequence
  Description of Artificial Sequence: Synthetic peptide
  Seed: ITDFGRAKL (EGFR L858R)
IIDFGRAKL

SEQ ID NO: 4870 - protein, 10 aa, Artificial Sequence
  Description of Artificial Sequence: Synthetic peptide
  Seed: ITDFGRAKLL (EGFR L858R)
IIDFGRAKLW

SEQ ID NO: 4871 - protein, 9 aa, Artificial Sequence
  Description of Artificial Sequence: Synthetic peptide
  Seed: ITDFGRAKL (EGFR L858R)
IIDFGRAKM

SEQ ID NO: 4872 - protein, 9 aa, Artificial Sequence
  Description of Artificial Sequence: Synthetic peptide
  Seed: ITDFGRAKL (EGFR L858R)
IIDFGRAKV

SEQ ID NO: 4873 - protein, 9 aa, Artificial Sequence
  Description of Artificial Sequence: Synthetic peptide
  Seed: ITDFGRAKL (EGFR L858R)
ILDFGRAKF

SEQ ID NO: 4874 - protein, 9 aa, Artificial Sequence
  Description of Artificial Sequence: Synthetic peptide
  Seed: ITDFGRAKL (EGFR L858R)
ILDFGRAKI

SEQ ID NO: 4875 - protein, 9 aa, Artificial Sequence
  Description of Artificial Sequence: Synthetic peptide
  Seed: ITDFGRAKL (EGFR L858R)
ILDFGRAKL

SEQ ID NO: 4876 - protein, 9 aa, Artificial Sequence
  Description of Artificial Sequence: Synthetic peptide
  Seed: ITDFGRAKL (EGFR L858R)
ILDFGRAKM

SEQ ID NO: 4877 - protein, 9 aa, Artificial Sequence
  Description of Artificial Sequence: Synthetic peptide
  Seed: ITDFGRAKL (EGFR L858R)
ILDFGRAKV

SEQ ID NO: 4878 - protein, 9 aa, Artificial Sequence
  Description of Artificial Sequence: Synthetic peptide
  Seed: ITDFGRAKL (EGFR L858R)
IMDFGRAKF

SEQ ID NO: 4879 - protein, 9 aa, Artificial Sequence
  Description of Artificial Sequence: Synthetic peptide
  Seed: ITDFGRAKL (EGFR L858R)
IMDFGRAKI

SEQ ID NO: 4880 - protein, 9 aa, Artificial Sequence
  Description of Artificial Sequence: Synthetic peptide
  Seed: ITDFGRAKL (EGFR L858R)
IMDFGRAKL

SEQ ID NO: 4881 - protein, 10 aa, Artificial Sequence
  Description of Artificial Sequence: Synthetic peptide
  Seed: ITDFGRAKLL (EGFR L858R)
IMDFGRAKLW

SEQ ID NO: 4882 - protein, 9 aa, Artificial Sequence
  Description of Artificial Sequence: Synthetic peptide
  Seed: ITDFGRAKL (EGFR L858R)
IMDFGRAKM

SEQ ID NO: 4883 - protein, 9 aa, Artificial Sequence
  Description of Artificial Sequence: Synthetic peptide
  Seed: ITDFGRAKL (EGFR L858R)
IMDFGRAKV

SEQ ID NO: 4884 - protein, 9 aa, Artificial Sequence
  Description of Artificial Sequence: Synthetic peptide
  Seed: ITDFGRAKL (EGFR L858R)
IQDFGRAKF

SEQ ID NO: 4885 - protein, 9 aa, Artificial Sequence
  Description of Artificial Sequence: Synthetic peptide
  Seed: ITDFGRAKL (EGFR L858R)
IQDFGRAKL

SEQ ID NO: 4886 - protein, 9 aa, Artificial Sequence
  Description of Artificial Sequence: Synthetic peptide
  Seed: ITDFGRAKL (EGFR L858R)
IQDFGRAKM

SEQ ID NO: 4887 - protein, 9 aa, Artificial Sequence
  Description of Artificial Sequence: Synthetic peptide
  Seed: ITDFGRAKL (EGFR L858R)
ISDFGRAKF

SEQ ID NO: 4888 - protein, 9 aa, Artificial Sequence
  Description of Artificial Sequence: Synthetic peptide
  Seed: ITDFGRAKL (EGFR L858R)
ISDFGRAKI

SEQ ID NO: 4889 - protein, 9 aa, Artificial Sequence
  Description of Artificial Sequence: Synthetic peptide
  Seed: ITDFGRAKL (EGFR L858R)
ISDFGRAKL

SEQ ID NO: 4890 - protein, 10 aa, Artificial Sequence
  Description of Artificial Sequence: Synthetic peptide
  Seed: ITDFGRAKLL (EGFR L858R)
ISDFGRAKLF

SEQ ID NO: 4891 - protein, 10 aa, Artificial Sequence
  Description of Artificial Sequence: Synthetic peptide
  Seed: ITDFGRAKLL (EGFR L858R)
ISDFGRAKLI

SEQ ID NO: 4892 - protein, 10 aa, Artificial Sequence
  Description of Artificial Sequence: Synthetic peptide
  Seed: ITDFGRAKLL (EGFR L858R)
ISDFGRAKLL

SEQ ID NO: 4893 - protein, 10 aa, Artificial Sequence
  Description of Artificial Sequence: Synthetic peptide
  Seed: ITDFGRAKLL (EGFR L858R)
ISDFGRAKLM

SEQ ID NO: 4894 - protein, 10 aa, Artificial Sequence
  Description of Artificial Sequence: Synthetic peptide
  Seed: ITDFGRAKLL (EGFR L858R)
ISDFGRAKLW

SEQ ID NO: 4895 - protein, 10 aa, Artificial Sequence
  Description of Artificial Sequence: Synthetic peptide
  Seed: ITDFGRAKLL (EGFR L858R)
ISDFGRAKLY

SEQ ID NO: 4896 - protein, 9 aa, Artificial Sequence
  Description of Artificial Sequence: Synthetic peptide
  Seed: ITDFGRAKL (EGFR L858R)
ISDFGRAKM

SEQ ID NO: 4897 - protein, 9 aa, Artificial Sequence
  Description of Artificial Sequence: Synthetic peptide
  Seed: ITDFGRAKL (EGFR L858R)
ISDFGRAKV

SEQ ID NO: 4898 - protein, 9 aa, Artificial Sequence
  Description of Artificial Sequence: Synthetic peptide
  Seed: ITDFGRAKL (EGFR L858R)
ITDFGRAKF

SEQ ID NO: 4899 - protein, 9 aa, Artificial Sequence
  Description of Artificial Sequence: Synthetic peptide
  Seed: ITDFGRAKL (EGFR L858R)
ITDFGRAKI

SEQ ID NO: 4900 - protein, 10 aa, Artificial Sequence
  Description of Artificial Sequence: Synthetic peptide
  Seed: ITDFGRAKLL (EGFR L858R)
ITDFGRAKLF

SEQ ID NO: 4901 - protein, 10 aa, Artificial Sequence
  Description of Artificial Sequence: Synthetic peptide
  Seed: ITDFGRAKLL (EGFR L858R)
ITDFGRAKLM

SEQ ID NO: 4902 - protein, 10 aa, Artificial Sequence
  Description of Artificial Sequence: Synthetic peptide
  Seed: ITDFGRAKLL (EGFR L858R)
ITDFGRAKLW

SEQ ID NO: 4903 - protein, 10 aa, Artificial Sequence
  Description of Artificial Sequence: Synthetic peptide
  Seed: ITDFGRAKLL (EGFR L858R)
ITDFGRAKLY

SEQ ID NO: 4904 - protein, 9 aa, Artificial Sequence
  Description of Artificial Sequence: Synthetic peptide
  Seed: ITDFGRAKL (EGFR L858R)
ITDFGRAKM

SEQ ID NO: 4905 - protein, 9 aa, Artificial Sequence
  Description of Artificial Sequence: Synthetic peptide
  Seed: ITDFGRAKL (EGFR L858R)
ITDFGRAKV

SEQ ID NO: 4906 - protein, 9 aa, Artificial Sequence
  Description of Artificial Sequence: Synthetic peptide
  Seed: ITDFGRAKL (EGFR L858R)
IVDFGRAKF

SEQ ID NO: 4907 - protein, 9 aa, Artificial Sequence
  Description of Artificial Sequence: Synthetic peptide
  Seed: ITDFGRAKL (EGFR L858R)
IVDFGRAKI

SEQ ID NO: 4908 - protein, 9 aa, Artificial Sequence
  Description of Artificial Sequence: Synthetic peptide
  Seed: ITDFGRAKL (EGFR L858R)
IVDFGRAKL

SEQ ID NO: 4909 - protein, 10 aa, Artificial Sequence
  Description of Artificial Sequence: Synthetic peptide
  Seed: ITDFGRAKLL (EGFR L858R)
IVDFGRAKLF

SEQ ID NO: 4910 - protein, 10 aa, Artificial Sequence
  Description of Artificial Sequence: Synthetic peptide
  Seed: ITDFGRAKLL (EGFR L858R)
IVDFGRAKLW

SEQ ID NO: 4911 - protein, 10 aa, Artificial Sequence
  Description of Artificial Sequence: Synthetic peptide
  Seed: ITDFGRAKLL (EGFR L858R)
IVDFGRAKLY

SEQ ID NO: 4912 - protein, 9 aa, Artificial Sequence
  Description of Artificial Sequence: Synthetic peptide
  Seed: ITDFGRAKL (EGFR L858R)
IVDFGRAKM

SEQ ID NO: 4913 - protein, 9 aa, Artificial Sequence
  Description of Artificial Sequence: Synthetic peptide
  Seed: ITDFGRAKL (EGFR L858R)
IVDFGRAKV

SEQ ID NO: 4914 - protein, 9 aa, Artificial Sequence
  Description of Artificial Sequence: Synthetic peptide
  Seed: KITDFGRAK (EGFR L858R)
KATDFGRAK

SEQ ID NO: 4915 - protein, 9 aa, Artificial Sequence
  Description of Artificial Sequence: Synthetic peptide
  Seed: KITDFGRAK (EGFR L858R)
KATDFGRAR

SEQ ID NO: 4916 - protein, 9 aa, Artificial Sequence
  Description of Artificial Sequence: Synthetic peptide
  Seed: KITDFGRAK (EGFR L858R)
KFTDFGRAK

SEQ ID NO: 4917 - protein, 9 aa, Artificial Sequence
  Description of Artificial Sequence: Synthetic peptide
  Seed: KITDFGRAK (EGFR L858R)
KFTDFGRAR

SEQ ID NO: 4918 - protein, 9 aa, Artificial Sequence
  Description of Artificial Sequence: Synthetic peptide
  Seed: KITDFGRAK (EGFR L858R)
KGTDFGRAK

SEQ ID NO: 4919 - protein, 9 aa, Artificial Sequence
  Description of Artificial Sequence: Synthetic peptide
  Seed: KITDFGRAK (EGFR L858R)
KGTDFGRAR

SEQ ID NO: 4920 - protein, 9 aa, Artificial Sequence
  Description of Artificial Sequence: Synthetic peptide
  Seed: KITDFGRAK (EGFR L858R)
KITDFGRAR

SEQ ID NO: 4921 - protein, 9 aa, Artificial Sequence
  Description of Artificial Sequence: Synthetic peptide
  Seed: KITDFGRAK (EGFR L858R)
KLTDFGRAK

SEQ ID NO: 4922 - protein, 9 aa, Artificial Sequence
  Description of Artificial Sequence: Synthetic peptide
  Seed: KITDFGRAK (EGFR L858R)
KLTDFGRAR

SEQ ID NO: 4923 - protein, 9 aa, Artificial Sequence
  Description of Artificial Sequence: Synthetic peptide
  Seed: KITDFGRAK (EGFR L858R)
KNTDFGRAR

SEQ ID NO: 4924 - protein, 9 aa, Artificial Sequence
  Description of Artificial Sequence: Synthetic peptide
  Seed: KITDFGRAK (EGFR L858R)
KQTDFGRAK

SEQ ID NO: 4925 - protein, 9 aa, Artificial Sequence
  Description of Artificial Sequence: Synthetic peptide
  Seed: KITDFGRAK (EGFR L858R)
KQTDFGRAR

SEQ ID NO: 4926 - protein, 9 aa, Artificial Sequence
  Description of Artificial Sequence: Synthetic peptide
  Seed: KITDFGRAK (EGFR L858R)
KSTDFGRAA

SEQ ID NO: 4927 - protein, 9 aa, Artificial Sequence
  Description of Artificial Sequence: Synthetic peptide
  Seed: KITDFGRAK (EGFR L858R)
KSTDFGRAK

SEQ ID NO: 4928 - protein, 9 aa, Artificial Sequence
  Description of Artificial Sequence: Synthetic peptide
  Seed: KITDFGRAK (EGFR L858R)
KSTDFGRAR

SEQ ID NO: 4929 - protein, 9 aa, Artificial Sequence
  Description of Artificial Sequence: Synthetic peptide
  Seed: KITDFGRAK (EGFR L858R)
KSTDFGRAV

SEQ ID NO: 4930 - protein, 9 aa, Artificial Sequence
  Description of Artificial Sequence: Synthetic peptide
  Seed: KITDFGRAK (EGFR L858R)
KTTDFGRAA

SEQ ID NO: 4931 - protein, 9 aa, Artificial Sequence
  Description of Artificial Sequence: Synthetic peptide
  Seed: KITDFGRAK (EGFR L858R)
KTTDFGRAI

SEQ ID NO: 4932 - protein, 9 aa, Artificial Sequence
  Description of Artificial Sequence: Synthetic peptide
  Seed: KITDFGRAK (EGFR L858R)
KTTDFGRAR

SEQ ID NO: 4933 - protein, 9 aa, Artificial Sequence
  Description of Artificial Sequence: Synthetic peptide
  Seed: KITDFGRAK (EGFR L858R)
KTTDFGRAV

SEQ ID NO: 4934 - protein, 9 aa, Artificial Sequence
  Description of Artificial Sequence: Synthetic peptide
  Seed: KITDFGRAK (EGFR L858R)
KVTDFGRAA

SEQ ID NO: 4935 - protein, 9 aa, Artificial Sequence
  Description of Artificial Sequence: Synthetic peptide
  Seed: KITDFGRAK (EGFR L858R)
KVTDFGRAK

SEQ ID NO: 4936 - protein, 9 aa, Artificial Sequence
  Description of Artificial Sequence: Synthetic peptide
  Seed: KITDFGRAK (EGFR L858R)
KWTDFGRAK

SEQ ID NO: 4937 - protein, 9 aa, Artificial Sequence
  Description of Artificial Sequence: Synthetic peptide
  Seed: KITDFGRAK (EGFR L858R)
KWTDFGRAR

SEQ ID NO: 4938 - protein, 9 aa, Artificial Sequence
  Description of Artificial Sequence: Synthetic peptide
  Seed: KITDFGRAK (EGFR L858R)
KYTDFGRAK

SEQ ID NO: 4939 - protein, 9 aa, Artificial Sequence
  Description of Artificial Sequence: Synthetic peptide
  Seed: KITDFGRAK (EGFR L858R)
KYTDFGRAR

SEQ ID NO: 4940 - protein, 10 aa, Artificial Sequence
  Description of Artificial Sequence: Synthetic peptide
  Seed: RAKLLGAEEK (EGFR L858R)
RAKLLGAEEA

SEQ ID NO: 4941 - protein, 10 aa, Artificial Sequence
  Description of Artificial Sequence: Synthetic peptide
  Seed: RAKLLGAEEK (EGFR L858R)
RAKLLGAEEV

SEQ ID NO: 4942 - protein, 10 aa, Artificial Sequence
  Description of Artificial Sequence: Synthetic peptide
  Seed: RAKLLGAEEK (EGFR L858R)
RFKLLGAEEA

SEQ ID NO: 4943 - protein, 10 aa, Artificial Sequence
  Description of Artificial Sequence: Synthetic peptide
  Seed: RAKLLGAEEK (EGFR L858R)
RFKLLGAEEK

SEQ ID NO: 4944 - protein, 10 aa, Artificial Sequence
  Description of Artificial Sequence: Synthetic peptide
  Seed: RAKLLGAEEK (EGFR L858R)
RGKLLGAEEK

SEQ ID NO: 4945 - protein, 10 aa, Artificial Sequence
  Description of Artificial Sequence: Synthetic peptide
  Seed: RAKLLGAEEK (EGFR L858R)
RIKLLGAEEA

SEQ ID NO: 4946 - protein, 10 aa, Artificial Sequence
  Description of Artificial Sequence: Synthetic peptide
  Seed: RAKLLGAEEK (EGFR L858R)
RIKLLGAEEK

SEQ ID NO: 4947 - protein, 10 aa, Artificial Sequence
  Description of Artificial Sequence: Synthetic peptide
  Seed: RAKLLGAEEK (EGFR L858R)
RIKLLGAEEV

SEQ ID NO: 4948 - protein, 10 aa, Artificial Sequence
  Description of Artificial Sequence: Synthetic peptide
  Seed: RAKLLGAEEK (EGFR L858R)
RLKLLGAEEK

SEQ ID NO: 4949 - protein, 10 aa, Artificial Sequence
  Description of Artificial Sequence: Synthetic peptide
  Seed: RAKLLGAEEK (EGFR L858R)
RMKLLGAEEA

SEQ ID NO: 4950 - protein, 10 aa, Artificial Sequence
  Description of Artificial Sequence: Synthetic peptide
  Seed: RAKLLGAEEK (EGFR L858R)
RMKLLGAEEK

SEQ ID NO: 4951 - protein, 10 aa, Artificial Sequence
  Description of Artificial Sequence: Synthetic peptide
  Seed: RAKLLGAEEK (EGFR L858R)
RQKLLGAEEK

SEQ ID NO: 4952 - protein, 10 aa, Artificial Sequence
  Description of Artificial Sequence: Synthetic peptide
  Seed: RAKLLGAEEK (EGFR L858R)
RSKLLGAEEA

SEQ ID NO: 4953 - protein, 10 aa, Artificial Sequence
  Description of Artificial Sequence: Synthetic peptide
  Seed: RAKLLGAEEK (EGFR L858R)
RSKLLGAEEI

SEQ ID NO: 4954 - protein, 10 aa, Artificial Sequence
  Description of Artificial Sequence: Synthetic peptide
  Seed: RAKLLGAEEK (EGFR L858R)
RSKLLGAEEK

SEQ ID NO: 4955 - protein, 10 aa, Artificial Sequence
  Description of Artificial Sequence: Synthetic peptide
  Seed: RAKLLGAEEK (EGFR L858R)
RSKLLGAEEL

SEQ ID NO: 4956 - protein, 10 aa, Artificial Sequence
  Description of Artificial Sequence: Synthetic peptide
  Seed: RAKLLGAEEK (EGFR L858R)
RSKLLGAEEM

SEQ ID NO: 4957 - protein, 10 aa, Artificial Sequence
  Description of Artificial Sequence: Synthetic peptide
  Seed: RAKLLGAEEK (EGFR L858R)
RSKLLGAEER

SEQ ID NO: 4958 - protein, 10 aa, Artificial Sequence
  Description of Artificial Sequence: Synthetic peptide
  Seed: RAKLLGAEEK (EGFR L858R)
RSKLLGAEES

SEQ ID NO: 4959 - protein, 10 aa, Artificial Sequence
  Description of Artificial Sequence: Synthetic peptide
  Seed: RAKLLGAEEK (EGFR L858R)
RSKLLGAEEV

SEQ ID NO: 4960 - protein, 10 aa, Artificial Sequence
  Description of Artificial Sequence: Synthetic peptide
  Seed: RAKLLGAEEK (EGFR L858R)
RTKLLGAEEA

SEQ ID NO: 4961 - protein, 10 aa, Artificial Sequence
  Description of Artificial Sequence: Synthetic peptide
  Seed: RAKLLGAEEK (EGFR L858R)
RTKLLGAEEG

SEQ ID NO: 4962 - protein, 10 aa, Artificial Sequence
  Description of Artificial Sequence: Synthetic peptide
  Seed: RAKLLGAEEK (EGFR L858R)
RTKLLGAEEI

SEQ ID NO: 4963 - protein, 10 aa, Artificial Sequence
  Description of Artificial Sequence: Synthetic peptide
  Seed: RAKLLGAEEK (EGFR L858R)
RTKLLGAEEK

SEQ ID NO: 4964 - protein, 10 aa, Artificial Sequence
  Description of Artificial Sequence: Synthetic peptide
  Seed: RAKLLGAEEK (EGFR L858R)
RTKLLGAEEL

SEQ ID NO: 4965 - protein, 10 aa, Artificial Sequence
  Description of Artificial Sequence: Synthetic peptide
  Seed: RAKLLGAEEK (EGFR L858R)
RTKLLGAEEM

SEQ ID NO: 4966 - protein, 10 aa, Artificial Sequence
  Description of Artificial Sequence: Synthetic peptide
  Seed: RAKLLGAEEK (EGFR L858R)
RTKLLGAEER

SEQ ID NO: 4967 - protein, 10 aa, Artificial Sequence
  Description of Artificial Sequence: Synthetic peptide
  Seed: RAKLLGAEEK (EGFR L858R)
RTKLLGAEES

SEQ ID NO: 4968 - protein, 10 aa, Artificial Sequence
  Description of Artificial Sequence: Synthetic peptide
  Seed: RAKLLGAEEK (EGFR L858R)
RTKLLGAEET

SEQ ID NO: 4969 - protein, 10 aa, Artificial Sequence
  Description of Artificial Sequence: Synthetic peptide
  Seed: RAKLLGAEEK (EGFR L858R)
RTKLLGAEEV

SEQ ID NO: 4970 - protein, 10 aa, Artificial Sequence
  Description of Artificial Sequence: Synthetic peptide
  Seed: RAKLLGAEEK (EGFR L858R)
RTKLLGAEEY

SEQ ID NO: 4971 - protein, 10 aa, Artificial Sequence
  Description of Artificial Sequence: Synthetic peptide
  Seed: RAKLLGAEEK (EGFR L858R)
RVKLLGAEEA

SEQ ID NO: 4972 - protein, 10 aa, Artificial Sequence
  Description of Artificial Sequence: Synthetic peptide
  Seed: RAKLLGAEEK (EGFR L858R)
RVKLLGAEEI

SEQ ID NO: 4973 - protein, 10 aa, Artificial Sequence
  Description of Artificial Sequence: Synthetic peptide
  Seed: RAKLLGAEEK (EGFR L858R)
RVKLLGAEEK

SEQ ID NO: 4974 - protein, 10 aa, Artificial Sequence
  Description of Artificial Sequence: Synthetic peptide
  Seed: RAKLLGAEEK (EGFR L858R)
RVKLLGAEEL

SEQ ID NO: 4975 - protein, 10 aa, Artificial Sequence
  Description of Artificial Sequence: Synthetic peptide
  Seed: RAKLLGAEEK (EGFR L858R)
RVKLLGAEEM

SEQ ID NO: 4976 - protein, 10 aa, Artificial Sequence
  Description of Artificial Sequence: Synthetic peptide
  Seed: RAKLLGAEEK (EGFR L858R)
RVKLLGAEEV

SEQ ID NO: 4977 - protein, 10 aa, Artificial Sequence
  Description of Artificial Sequence: Synthetic peptide
  Seed: RAKLLGAEEK (EGFR L858R)
RWKLLGAEEK

SEQ ID NO: 4978 - protein, 10 aa, Artificial Sequence
  Description of Artificial Sequence: Synthetic peptide
  Seed: RAKLLGAEEK (EGFR L858R)
RYKLLGAEEA

SEQ ID NO: 4979 - protein, 10 aa, Artificial Sequence
  Description of Artificial Sequence: Synthetic peptide
  Seed: RAKLLGAEEK (EGFR L858R)
RYKLLGAEEK

SEQ ID NO: 4980 - protein, 10 aa, Artificial Sequence
  Description of Artificial Sequence: Synthetic peptide
  Seed: RAKLLGAEEK (EGFR L858R)
RYKLLGAEEV

SEQ ID NO: 4981 - protein, 10 aa, Artificial Sequence
  Description of Artificial Sequence: Synthetic peptide
  Seed: VKITDFGRAK (EGFR L858R)
VAITDFGRAK

SEQ ID NO: 4982 - protein, 10 aa, Artificial Sequence
  Description of Artificial Sequence: Synthetic peptide
  Seed: VKITDFGRAK (EGFR L858R)
VCITDFGRAK

SEQ ID NO: 4983 - protein, 10 aa, Artificial Sequence
  Description of Artificial Sequence: Synthetic peptide
  Seed: VKITDFGRAK (EGFR L858R)
VDITDFGRAK

SEQ ID NO: 4984 - protein, 10 aa, Artificial Sequence
  Description of Artificial Sequence: Synthetic peptide
  Seed: VKITDFGRAK (EGFR L858R)
VEITDFGRAK

SEQ ID NO: 4985 - protein, 10 aa, Artificial Sequence
  Description of Artificial Sequence: Synthetic peptide
  Seed: VKITDFGRAK (EGFR L858R)
VFITDFGRAK

SEQ ID NO: 4986 - protein, 10 aa, Artificial Sequence
  Description of Artificial Sequence: Synthetic peptide
  Seed: VKITDFGRAK (EGFR L858R)
VGITDFGRAK

SEQ ID NO: 4987 - protein, 10 aa, Artificial Sequence
  Description of Artificial Sequence: Synthetic peptide
  Seed: VKITDFGRAK (EGFR L858R)
VHITDFGRAK

SEQ ID NO: 4988 - protein, 10 aa, Artificial Sequence
  Description of Artificial Sequence: Synthetic peptide
  Seed: VKITDFGRAK (EGFR L858R)
VIITDFGRAK

SEQ ID NO: 4989 - protein, 10 aa, Artificial Sequence
  Description of Artificial Sequence: Synthetic peptide
  Seed: VKITDFGRAK (EGFR L858R)
VIITDFGRAR

SEQ ID NO: 4990 - protein, 10 aa, Artificial Sequence
  Description of Artificial Sequence: Synthetic peptide
  Seed: VKITDFGRAK (EGFR L858R)
VLITDFGRAK

SEQ ID NO: 4991 - protein, 10 aa, Artificial Sequence
  Description of Artificial Sequence: Synthetic peptide
  Seed: VKITDFGRAK (EGFR L858R)
VLITDFGRAR

SEQ ID NO: 4992 - protein, 10 aa, Artificial Sequence
  Description of Artificial Sequence: Synthetic peptide
  Seed: VKITDFGRAK (EGFR L858R)
VMITDFGRAK

SEQ ID NO: 4993 - protein, 10 aa, Artificial Sequence
  Description of Artificial Sequence: Synthetic peptide
  Seed: VKITDFGRAK (EGFR L858R)
VMITDFGRAR

SEQ ID NO: 4994 - protein, 10 aa, Artificial Sequence
  Description of Artificial Sequence: Synthetic peptide
  Seed: VKITDFGRAK (EGFR L858R)
VNITDFGRAK

SEQ ID NO: 4995 - protein, 10 aa, Artificial Sequence
  Description of Artificial Sequence: Synthetic peptide
  Seed: VKITDFGRAK (EGFR L858R)
VPITDFGRAK

SEQ ID NO: 4996 - protein, 10 aa, Artificial Sequence
  Description of Artificial Sequence: Synthetic peptide
  Seed: VKITDFGRAK (EGFR L858R)
VQITDFGRAK

SEQ ID NO: 4997 - protein, 10 aa, Artificial Sequence
  Description of Artificial Sequence: Synthetic peptide
  Seed: VKITDFGRAK (EGFR L858R)
VRITDFGRAK

SEQ ID NO: 4998 - protein, 10 aa, Artificial Sequence
  Description of Artificial Sequence: Synthetic peptide
  Seed: VKITDFGRAK (EGFR L858R)
VSITDFGRAK

SEQ ID NO: 4999 - protein, 10 aa, Artificial Sequence
  Description of Artificial Sequence: Synthetic peptide
  Seed: VKITDFGRAK (EGFR L858R)
VTITDFGRAK

SEQ ID NO: 5000 - protein, 10 aa, Artificial Sequence
  Description of Artificial Sequence: Synthetic peptide
  Seed: VKITDFGRAK (EGFR L858R)
VTITDFGRAR

SEQ ID NO: 5001 - protein, 10 aa, Artificial Sequence
  Description of Artificial Sequence: Synthetic peptide
  Seed: VKITDFGRAK (EGFR L858R)
VTITDFGRAY

SEQ ID NO: 5002 - protein, 10 aa, Artificial Sequence
  Description of Artificial Sequence: Synthetic peptide
  Seed: VKITDFGRAK (EGFR L858R)
VVITDFGRAK

SEQ ID NO: 5003 - protein, 10 aa, Artificial Sequence
  Description of Artificial Sequence: Synthetic peptide
  Seed: VKITDFGRAK (EGFR L858R)
VVITDFGRAR

SEQ ID NO: 5004 - protein, 10 aa, Artificial Sequence
  Description of Artificial Sequence: Synthetic peptide
  Seed: VKITDFGRAK (EGFR L858R)
VVITDFGRAY

SEQ ID NO: 5005 - protein, 10 aa, Artificial Sequence
  Description of Artificial Sequence: Synthetic peptide
  Seed: VKITDFGRAK (EGFR L858R)
VWITDFGRAK

SEQ ID NO: 5006 - protein, 10 aa, Artificial Sequence
  Description of Artificial Sequence: Synthetic peptide
  Seed: VKITDFGRAK (EGFR L858R)
VYITDFGRAK

SEQ ID NO: 5007 - protein, 9 aa, Artificial Sequence
  Description of Artificial Sequence: Synthetic peptide
  Seed: FGRAKLLGA (EGFR L858R)
FARAKLLGT

SEQ ID NO: 5008 - protein, 9 aa, Artificial Sequence
  Description of Artificial Sequence: Synthetic peptide
  Seed: FGRAKLLGA (EGFR L858R)
FCRAKLLGF

SEQ ID NO: 5009 - protein, 9 aa, Artificial Sequence
  Description of Artificial Sequence: Synthetic peptide
  Seed: FGRAKLLGA (EGFR L858R)
FCRAKLLGI

SEQ ID NO: 5010 - protein, 9 aa, Artificial Sequence
  Description of Artificial Sequence: Synthetic peptide
  Seed: FGRAKLLGA (EGFR L858R)
FCRAKLLGV

SEQ ID NO: 5011 - protein, 9 aa, Artificial Sequence
  Description of Artificial Sequence: Synthetic peptide
  Seed: FGRAKLLGA (EGFR L858R)
FDRAKLLGF

SEQ ID NO: 5012 - protein, 9 aa, Artificial Sequence
  Description of Artificial Sequence: Synthetic peptide
  Seed: FGRAKLLGA (EGFR L858R)
FDRAKLLGI

SEQ ID NO: 5013 - protein, 9 aa, Artificial Sequence
  Description of Artificial Sequence: Synthetic peptide
  Seed: FGRAKLLGA (EGFR L858R)
FDRAKLLGL

SEQ ID NO: 5014 - protein, 9 aa, Artificial Sequence
  Description of Artificial Sequence: Synthetic peptide
  Seed: FGRAKLLGA (EGFR L858R)
FDRAKLLGM

SEQ ID NO: 5015 - protein, 9 aa, Artificial Sequence
  Description of Artificial Sequence: Synthetic peptide
  Seed: FGRAKLLGA (EGFR L858R)
FDRAKLLGV

SEQ ID NO: 5016 - protein, 9 aa, Artificial Sequence
  Description of Artificial Sequence: Synthetic peptide
  Seed: FGRAKLLGA (EGFR L858R)
FERAKLLGF

SEQ ID NO: 5017 - protein, 9 aa, Artificial Sequence
  Description of Artificial Sequence: Synthetic peptide
  Seed: FGRAKLLGA (EGFR L858R)
FERAKLLGI

SEQ ID NO: 5018 - protein, 9 aa, Artificial Sequence
  Description of Artificial Sequence: Synthetic peptide
  Seed: FGRAKLLGA (EGFR L858R)
FERAKLLGV

SEQ ID NO: 5019 - protein, 9 aa, Artificial Sequence
  Description of Artificial Sequence: Synthetic peptide
  Seed: FGRAKLLGA (EGFR L858R)
FFRAKLLGC

SEQ ID NO: 5020 - protein, 9 aa, Artificial Sequence
  Description of Artificial Sequence: Synthetic peptide
  Seed: FGRAKLLGA (EGFR L858R)
FGRAKLLGC

SEQ ID NO: 5021 - protein, 9 aa, Artificial Sequence
  Description of Artificial Sequence: Synthetic peptide
  Seed: FGRAKLLGA (EGFR L858R)
FHRAKLLGI

SEQ ID NO: 5022 - protein, 9 aa, Artificial Sequence
  Description of Artificial Sequence: Synthetic peptide
  Seed: FGRAKLLGA (EGFR L858R)
FHRAKLLGL

SEQ ID NO: 5023 - protein, 9 aa, Artificial Sequence
  Description of Artificial Sequence: Synthetic peptide
  Seed: FGRAKLLGA (EGFR L858R)
FHRAKLLGM

SEQ ID NO: 5024 - protein, 9 aa, Artificial Sequence
  Description of Artificial Sequence: Synthetic peptide
  Seed: FGRAKLLGA (EGFR L858R)
FHRAKLLGV

SEQ ID NO: 5025 - protein, 9 aa, Artificial Sequence
  Description of Artificial Sequence: Synthetic peptide
  Seed: FGRAKLLGA (EGFR L858R)
FIRAKLLGT

SEQ ID NO: 5026 - protein, 9 aa, Artificial Sequence
  Description of Artificial Sequence: Synthetic peptide
  Seed: FGRAKLLGA (EGFR L858R)
FNRAKLLGC

SEQ ID NO: 5027 - protein, 9 aa, Artificial Sequence
  Description of Artificial Sequence: Synthetic peptide
  Seed: FGRAKLLGA (EGFR L858R)
FPRAKLLGD

SEQ ID NO: 5028 - protein, 9 aa, Artificial Sequence
  Description of Artificial Sequence: Synthetic peptide
  Seed: FGRAKLLGA (EGFR L858R)
FPRAKLLGE

SEQ ID NO: 5029 - protein, 9 aa, Artificial Sequence
  Description of Artificial Sequence: Synthetic peptide
  Seed: FGRAKLLGA (EGFR L858R)
FPRAKLLGH

SEQ ID NO: 5030 - protein, 9 aa, Artificial Sequence
  Description of Artificial Sequence: Synthetic peptide
  Seed: FGRAKLLGA (EGFR L858R)
FPRAKLLGK

SEQ ID NO: 5031 - protein, 9 aa, Artificial Sequence
  Description of Artificial Sequence: Synthetic peptide
  Seed: FGRAKLLGA (EGFR L858R)
FPRAKLLGN

SEQ ID NO: 5032 - protein, 9 aa, Artificial Sequence
  Description of Artificial Sequence: Synthetic peptide
  Seed: FGRAKLLGA (EGFR L858R)
FPRAKLLGP

SEQ ID NO: 5033 - protein, 9 aa, Artificial Sequence
  Description of Artificial Sequence: Synthetic peptide
  Seed: FGRAKLLGA (EGFR L858R)
FPRAKLLGQ

SEQ ID NO: 5034 - protein, 9 aa, Artificial Sequence
  Description of Artificial Sequence: Synthetic peptide
  Seed: FGRAKLLGA (EGFR L858R)
FPRAKLLGR

SEQ ID NO: 5035 - protein, 9 aa, Artificial Sequence
  Description of Artificial Sequence: Synthetic peptide
  Seed: FGRAKLLGA (EGFR L858R)
FPRAKLLGS

SEQ ID NO: 5036 - protein, 9 aa, Artificial Sequence
  Description of Artificial Sequence: Synthetic peptide
  Seed: FGRAKLLGA (EGFR L858R)
FPRAKLLGY

SEQ ID NO: 5037 - protein, 9 aa, Artificial Sequence
  Description of Artificial Sequence: Synthetic peptide
  Seed: FGRAKLLGA (EGFR L858R)
FQRAKLLGC

SEQ ID NO: 5038 - protein, 9 aa, Artificial Sequence
  Description of Artificial Sequence: Synthetic peptide
  Seed: FGRAKLLGA (EGFR L858R)
FSRAKLLGC

SEQ ID NO: 5039 - protein, 9 aa, Artificial Sequence
  Description of Artificial Sequence: Synthetic peptide
  Seed: FGRAKLLGA (EGFR L858R)
FTRAKLLGC

SEQ ID NO: 5040 - protein, 9 aa, Artificial Sequence
  Description of Artificial Sequence: Synthetic peptide
  Seed: FGRAKLLGA (EGFR L858R)
FVRAKLLGC

SEQ ID NO: 5041 - protein, 9 aa, Artificial Sequence
  Description of Artificial Sequence: Synthetic peptide
  Seed: FGRAKLLGA (EGFR L858R)
FYRAKLLGF

SEQ ID NO: 5042 - protein, 9 aa, Artificial Sequence
  Description of Artificial Sequence: Synthetic peptide
  Seed: FGRAKLLGA (EGFR L858R)
FYRAKLLGI

SEQ ID NO: 5043 - protein, 11 aa, Artificial Sequence
  Description of Artificial Sequence: Synthetic peptide
  Seed: HVKITDFGRAK (EGFR L858R)
HAKITDFGRAK

SEQ ID NO: 5044 - protein, 11 aa, Artificial Sequence
  Description of Artificial Sequence: Synthetic peptide
  Seed: HVKITDFGRAK (EGFR L858R)
HAKITDFGRAR

SEQ ID NO: 5045 - protein, 11 aa, Artificial Sequence
  Description of Artificial Sequence: Synthetic peptide
  Seed: HVKITDFGRAK (EGFR L858R)
HFKITDFGRAR

SEQ ID NO: 5046 - protein, 11 aa, Artificial Sequence
  Description of Artificial Sequence: Synthetic peptide
  Seed: HVKITDFGRAK (EGFR L858R)
HGKITDFGRAR

SEQ ID NO: 5047 - protein, 11 aa, Artificial Sequence
  Description of Artificial Sequence: Synthetic peptide
  Seed: HVKITDFGRAK (EGFR L858R)
HIKITDFGRAK

SEQ ID NO: 5048 - protein, 11 aa, Artificial Sequence
  Description of Artificial Sequence: Synthetic peptide
  Seed: HVKITDFGRAK (EGFR L858R)
HIKITDFGRAR

SEQ ID NO: 5049 - protein, 11 aa, Artificial Sequence
  Description of Artificial Sequence: Synthetic peptide
  Seed: HVKITDFGRAK (EGFR L858R)
HLKITDFGRAK

SEQ ID NO: 5050 - protein, 11 aa, Artificial Sequence
  Description of Artificial Sequence: Synthetic peptide
  Seed: HVKITDFGRAK (EGFR L858R)
HLKITDFGRAR

SEQ ID NO: 5051 - protein, 11 aa, Artificial Sequence
  Description of Artificial Sequence: Synthetic peptide
  Seed: HVKITDFGRAK (EGFR L858R)
HMKITDFGRAR

SEQ ID NO: 5052 - protein, 11 aa, Artificial Sequence
  Description of Artificial Sequence: Synthetic peptide
  Seed: HVKITDFGRAK (EGFR L858R)
HNKITDFGRAR

SEQ ID NO: 5053 - protein, 11 aa, Artificial Sequence
  Description of Artificial Sequence: Synthetic peptide
  Seed: HVKITDFGRAK (EGFR L858R)
HQKITDFGRAR

SEQ ID NO: 5054 - protein, 11 aa, Artificial Sequence
  Description of Artificial Sequence: Synthetic peptide
  Seed: HVKITDFGRAK (EGFR L858R)
HSKITDFGRAR

SEQ ID NO: 5055 - protein, 11 aa, Artificial Sequence
  Description of Artificial Sequence: Synthetic peptide
  Seed: HVKITDFGRAK (EGFR L858R)
HTKITDFGRAR

SEQ ID NO: 5056 - protein, 11 aa, Artificial Sequence
  Description of Artificial Sequence: Synthetic peptide
  Seed: HVKITDFGRAK (EGFR L858R)
HVKITDFGRAR

SEQ ID NO: 5057 - protein, 11 aa, Artificial Sequence
  Description of Artificial Sequence: Synthetic peptide
  Seed: HVKITDFGRAK (EGFR L858R)
HWKITDFGRAR

SEQ ID NO: 5058 - protein, 11 aa, Artificial Sequence
  Description of Artificial Sequence: Synthetic peptide
  Seed: HVKITDFGRAK (EGFR L858R)
HYKITDFGRAR

SEQ ID NO: 5059 - protein, 8 aa, Artificial Sequence
  Description of Artificial Sequence: Synthetic peptide
  Seed: ITDFGRAK (EGFR L858R)
IADFGRAF

SEQ ID NO: 5060 - protein, 8 aa, Artificial Sequence
  Description of Artificial Sequence: Synthetic peptide
  Seed: ITDFGRAK (EGFR L858R)
IADFGRAK

SEQ ID NO: 5061 - protein, 9 aa, Artificial Sequence
  Description of Artificial Sequence: Synthetic peptide
  Seed: ITDFGRAKL (EGFR L858R)
IADFGRAKA

SEQ ID NO: 5062 - protein, 9 aa, Artificial Sequence
  Description of Artificial Sequence: Synthetic peptide
  Seed: ITDFGRAKL (EGFR L858R)
IADFGRAKC

SEQ ID NO: 5063 - protein, 9 aa, Artificial Sequence
  Description of Artificial Sequence: Synthetic peptide
  Seed: ITDFGRAKL (EGFR L858R)
IADFGRAKH

SEQ ID NO: 5064 - protein, 9 aa, Artificial Sequence
  Description of Artificial Sequence: Synthetic peptide
  Seed: ITDFGRAKL (EGFR L858R)
IADFGRAKK

SEQ ID NO: 5065 - protein, 10 aa, Artificial Sequence
  Description of Artificial Sequence: Synthetic peptide
  Seed: ITDFGRAKLL (EGFR L858R)
IADFGRAKLC

SEQ ID NO: 5066 - protein, 10 aa, Artificial Sequence
  Description of Artificial Sequence: Synthetic peptide
  Seed: ITDFGRAKLL (EGFR L858R)
IADFGRAKLI

SEQ ID NO: 5067 - protein, 10 aa, Artificial Sequence
  Description of Artificial Sequence: Synthetic peptide
  Seed: ITDFGRAKLL (EGFR L858R)
IADFGRAKLK

SEQ ID NO: 5068 - protein, 10 aa, Artificial Sequence
  Description of Artificial Sequence: Synthetic peptide
  Seed: ITDFGRAKLL (EGFR L858R)
IADFGRAKLR

SEQ ID NO: 5069 - protein, 10 aa, Artificial Sequence
  Description of Artificial Sequence: Synthetic peptide
  Seed: ITDFGRAKLL (EGFR L858R)
IADFGRAKLV

SEQ ID NO: 5070 - protein, 9 aa, Artificial Sequence
  Description of Artificial Sequence: Synthetic peptide
  Seed: ITDFGRAKL (EGFR L858R)
IADFGRAKR

SEQ ID NO: 5071 - protein, 9 aa, Artificial Sequence
  Description of Artificial Sequence: Synthetic peptide
  Seed: ITDFGRAKL (EGFR L858R)
IADFGRAKT

SEQ ID NO: 5072 - protein, 9 aa, Artificial Sequence
  Description of Artificial Sequence: Synthetic peptide
  Seed: ITDFGRAKL (EGFR L858R)
IADFGRAKW

SEQ ID NO: 5073 - protein, 8 aa, Artificial Sequence
  Description of Artificial Sequence: Synthetic peptide
  Seed: ITDFGRAK (EGFR L858R)
IADFGRAL

SEQ ID NO: 5074 - protein, 8 aa, Artificial Sequence
  Description of Artificial Sequence: Synthetic peptide
  Seed: ITDFGRAK (EGFR L858R)
IADFGRAY

SEQ ID NO: 5075 - protein, 9 aa, Artificial Sequence
  Description of Artificial Sequence: Synthetic peptide
  Seed: ITDFGRAKL (EGFR L858R)
ICDFGRAKF

SEQ ID NO: 5076 - protein, 9 aa, Artificial Sequence
  Description of Artificial Sequence: Synthetic peptide
  Seed: ITDFGRAKL (EGFR L858R)
ICDFGRAKI

SEQ ID NO: 5077 - protein, 9 aa, Artificial Sequence
  Description of Artificial Sequence: Synthetic peptide
  Seed: ITDFGRAKL (EGFR L858R)
ICDFGRAKK

SEQ ID NO: 5078 - protein, 10 aa, Artificial Sequence
  Description of Artificial Sequence: Synthetic peptide
  Seed: ITDFGRAKLL (EGFR L858R)
ICDFGRAKLF

SEQ ID NO: 5079 - protein, 10 aa, Artificial Sequence
  Description of Artificial Sequence: Synthetic peptide
  Seed: ITDFGRAKLL (EGFR L858R)
ICDFGRAKLI

SEQ ID NO: 5080 - protein, 10 aa, Artificial Sequence
  Description of Artificial Sequence: Synthetic peptide
  Seed: ITDFGRAKLL (EGFR L858R)
ICDFGRAKLL

SEQ ID NO: 5081 - protein, 10 aa, Artificial Sequence
  Description of Artificial Sequence: Synthetic peptide
  Seed: ITDFGRAKLL (EGFR L858R)
ICDFGRAKLM

SEQ ID NO: 5082 - protein, 10 aa, Artificial Sequence
  Description of Artificial Sequence: Synthetic peptide
  Seed: ITDFGRAKLL (EGFR L858R)
ICDFGRAKLV

SEQ ID NO: 5083 - protein, 10 aa, Artificial Sequence
  Description of Artificial Sequence: Synthetic peptide
  Seed: ITDFGRAKLL (EGFR L858R)
ICDFGRAKLW

SEQ ID NO: 5084 - protein, 10 aa, Artificial Sequence
  Description of Artificial Sequence: Synthetic peptide
  Seed: ITDFGRAKLL (EGFR L858R)
ICDFGRAKLY

SEQ ID NO: 5085 - protein, 9 aa, Artificial Sequence
  Description of Artificial Sequence: Synthetic peptide
  Seed: ITDFGRAKL (EGFR L858R)
ICDFGRAKV

SEQ ID NO: 5086 - protein, 9 aa, Artificial Sequence
  Description of Artificial Sequence: Synthetic peptide
  Seed: ITDFGRAKL (EGFR L858R)
ICDFGRAKW

SEQ ID NO: 5087 - protein, 9 aa, Artificial Sequence
  Description of Artificial Sequence: Synthetic peptide
  Seed: ITDFGRAKL (EGFR L858R)
ICDFGRAKY

SEQ ID NO: 5088 - protein, 8 aa, Artificial Sequence
  Description of Artificial Sequence: Synthetic peptide
  Seed: ITDFGRAK (EGFR L858R)
ICDFGRAY

SEQ ID NO: 5089 - protein, 9 aa, Artificial Sequence
  Description of Artificial Sequence: Synthetic peptide
  Seed: ITDFGRAKL (EGFR L858R)
IDDFGRAKF

SEQ ID NO: 5090 - protein, 9 aa, Artificial Sequence
  Description of Artificial Sequence: Synthetic peptide
  Seed: ITDFGRAKL (EGFR L858R)
IDDFGRAKI

SEQ ID NO: 5091 - protein, 9 aa, Artificial Sequence
  Description of Artificial Sequence: Synthetic peptide
  Seed: ITDFGRAKL (EGFR L858R)
IDDFGRAKK

SEQ ID NO: 5092 - protein, 9 aa, Artificial Sequence
  Description of Artificial Sequence: Synthetic peptide
  Seed: ITDFGRAKL (EGFR L858R)
IDDFGRAKL

SEQ ID NO: 5093 - protein, 10 aa, Artificial Sequence
  Description of Artificial Sequence: Synthetic peptide
  Seed: ITDFGRAKLL (EGFR L858R)
IDDFGRAKLK

SEQ ID NO: 5094 - protein, 10 aa, Artificial Sequence
  Description of Artificial Sequence: Synthetic peptide
  Seed: ITDFGRAKLL (EGFR L858R)
IDDFGRAKLW

SEQ ID NO: 5095 - protein, 10 aa, Artificial Sequence
  Description of Artificial Sequence: Synthetic peptide
  Seed: ITDFGRAKLL (EGFR L858R)
IDDFGRAKLY

SEQ ID NO: 5096 - protein, 9 aa, Artificial Sequence
  Description of Artificial Sequence: Synthetic peptide
  Seed: ITDFGRAKL (EGFR L858R)
IDDFGRAKM

SEQ ID NO: 5097 - protein, 9 aa, Artificial Sequence
  Description of Artificial Sequence: Synthetic peptide
  Seed: ITDFGRAKL (EGFR L858R)
IDDFGRAKR

SEQ ID NO: 5098 - protein, 9 aa, Artificial Sequence
  Description of Artificial Sequence: Synthetic peptide
  Seed: ITDFGRAKL (EGFR L858R)
IDDFGRAKV

SEQ ID NO: 5099 - protein, 9 aa, Artificial Sequence
  Description of Artificial Sequence: Synthetic peptide
  Seed: ITDFGRAKL (EGFR L858R)
IDDFGRAKW

SEQ ID NO: 5100 - protein, 9 aa, Artificial Sequence
  Description of Artificial Sequence: Synthetic peptide
  Seed: ITDFGRAKL (EGFR L858R)
IDDFGRAKY

SEQ ID NO: 5101 - protein, 8 aa, Artificial Sequence
  Description of Artificial Sequence: Synthetic peptide
  Seed: ITDFGRAK (EGFR L858R)
IDDFGRAY

SEQ ID NO: 5102 - protein, 9 aa, Artificial Sequence
  Description of Artificial Sequence: Synthetic peptide
  Seed: ITDFGRAKL (EGFR L858R)
IEDFGRAKA

SEQ ID NO: 5103 - protein, 9 aa, Artificial Sequence
  Description of Artificial Sequence: Synthetic peptide
  Seed: ITDFGRAKL (EGFR L858R)
IEDFGRAKC

SEQ ID NO: 5104 - protein, 9 aa, Artificial Sequence
  Description of Artificial Sequence: Synthetic peptide
  Seed: ITDFGRAKL (EGFR L858R)
IEDFGRAKF

SEQ ID NO: 5105 - protein, 9 aa, Artificial Sequence
  Description of Artificial Sequence: Synthetic peptide
  Seed: ITDFGRAKL (EGFR L858R)
IEDFGRAKI

SEQ ID NO: 5106 - protein, 9 aa, Artificial Sequence
  Description of Artificial Sequence: Synthetic peptide
  Seed: ITDFGRAKL (EGFR L858R)
IEDFGRAKK

SEQ ID NO: 5107 - protein, 9 aa, Artificial Sequence
  Description of Artificial Sequence: Synthetic peptide
  Seed: ITDFGRAKL (EGFR L858R)
IEDFGRAKL

SEQ ID NO: 5108 - protein, 10 aa, Artificial Sequence
  Description of Artificial Sequence: Synthetic peptide
  Seed: ITDFGRAKLL (EGFR L858R)
IEDFGRAKLW

SEQ ID NO: 5109 - protein, 10 aa, Artificial Sequence
  Description of Artificial Sequence: Synthetic peptide
  Seed: ITDFGRAKLL (EGFR L858R)
IEDFGRAKLY

SEQ ID NO: 5110 - protein, 9 aa, Artificial Sequence
  Description of Artificial Sequence: Synthetic peptide
  Seed: ITDFGRAKL (EGFR L858R)
IEDFGRAKM

SEQ ID NO: 5111 - protein, 9 aa, Artificial Sequence
  Description of Artificial Sequence: Synthetic peptide
  Seed: ITDFGRAKL (EGFR L858R)
IEDFGRAKT

SEQ ID NO: 5112 - protein, 9 aa, Artificial Sequence
  Description of Artificial Sequence: Synthetic peptide
  Seed: ITDFGRAKL (EGFR L858R)
IEDFGRAKV

SEQ ID NO: 5113 - protein, 9 aa, Artificial Sequence
  Description of Artificial Sequence: Synthetic peptide
  Seed: ITDFGRAKL (EGFR L858R)
IEDFGRAKW

SEQ ID NO: 5114 - protein, 9 aa, Artificial Sequence
  Description of Artificial Sequence: Synthetic peptide
  Seed: ITDFGRAKL (EGFR L858R)
IEDFGRAKY

SEQ ID NO: 5115 - protein, 8 aa, Artificial Sequence
  Description of Artificial Sequence: Synthetic peptide
  Seed: ITDFGRAK (EGFR L858R)
IEDFGRAY

SEQ ID NO: 5116 - protein, 9 aa, Artificial Sequence
  Description of Artificial Sequence: Synthetic peptide
  Seed: ITDFGRAKL (EGFR L858R)
IFDFGRAKA

SEQ ID NO: 5117 - protein, 9 aa, Artificial Sequence
  Description of Artificial Sequence: Synthetic peptide
  Seed: ITDFGRAKL (EGFR L858R)
IFDFGRAKC

SEQ ID NO: 5118 - protein, 9 aa, Artificial Sequence
  Description of Artificial Sequence: Synthetic peptide
  Seed: ITDFGRAKL (EGFR L858R)
IFDFGRAKF

SEQ ID NO: 5119 - protein, 9 aa, Artificial Sequence
  Description of Artificial Sequence: Synthetic peptide
  Seed: ITDFGRAKL (EGFR L858R)
IFDFGRAKI

SEQ ID NO: 5120 - protein, 9 aa, Artificial Sequence
  Description of Artificial Sequence: Synthetic peptide
  Seed: ITDFGRAKL (EGFR L858R)
IFDFGRAKK

SEQ ID NO: 5121 - protein, 9 aa, Artificial Sequence
  Description of Artificial Sequence: Synthetic peptide
  Seed: ITDFGRAKL (EGFR L858R)
IFDFGRAKL

SEQ ID NO: 5122 - protein, 10 aa, Artificial Sequence
  Description of Artificial Sequence: Synthetic peptide
  Seed: ITDFGRAKLL (EGFR L858R)
IFDFGRAKLC

SEQ ID NO: 5123 - protein, 10 aa, Artificial Sequence
  Description of Artificial Sequence: Synthetic peptide
  Seed: ITDFGRAKLL (EGFR L858R)
IFDFGRAKLF

SEQ ID NO: 5124 - protein, 10 aa, Artificial Sequence
  Description of Artificial Sequence: Synthetic peptide
  Seed: ITDFGRAKLL (EGFR L858R)
IFDFGRAKLI

SEQ ID NO: 5125 - protein, 10 aa, Artificial Sequence
  Description of Artificial Sequence: Synthetic peptide
  Seed: ITDFGRAKLL (EGFR L858R)
IFDFGRAKLK

SEQ ID NO: 5126 - protein, 10 aa, Artificial Sequence
  Description of Artificial Sequence: Synthetic peptide
  Seed: ITDFGRAKLL (EGFR L858R)
IFDFGRAKLL

SEQ ID NO: 5127 - protein, 10 aa, Artificial Sequence
  Description of Artificial Sequence: Synthetic peptide
  Seed: ITDFGRAKLL (EGFR L858R)
IFDFGRAKLM

SEQ ID NO: 5128 - protein, 10 aa, Artificial Sequence
  Description of Artificial Sequence: Synthetic peptide
  Seed: ITDFGRAKLL (EGFR L858R)
IFDFGRAKLV

SEQ ID NO: 5129 - protein, 10 aa, Artificial Sequence
  Description of Artificial Sequence: Synthetic peptide
  Seed: ITDFGRAKLL (EGFR L858R)
IFDFGRAKLW

SEQ ID NO: 5130 - protein, 10 aa, Artificial Sequence
  Description of Artificial Sequence: Synthetic peptide
  Seed: ITDFGRAKLL (EGFR L858R)
IFDFGRAKLY

SEQ ID NO: 5131 - protein, 9 aa, Artificial Sequence
  Description of Artificial Sequence: Synthetic peptide
  Seed: ITDFGRAKL (EGFR L858R)
IFDFGRAKM

SEQ ID NO: 5132 - protein, 9 aa, Artificial Sequence
  Description of Artificial Sequence: Synthetic peptide
  Seed: ITDFGRAKL (EGFR L858R)
IFDFGRAKT

SEQ ID NO: 5133 - protein, 9 aa, Artificial Sequence
  Description of Artificial Sequence: Synthetic peptide
  Seed: ITDFGRAKL (EGFR L858R)
IFDFGRAKV

SEQ ID NO: 5134 - protein, 9 aa, Artificial Sequence
  Description of Artificial Sequence: Synthetic peptide
  Seed: ITDFGRAKL (EGFR L858R)
IFDFGRAKW

SEQ ID NO: 5135 - protein, 9 aa, Artificial Sequence
  Description of Artificial Sequence: Synthetic peptide
  Seed: ITDFGRAKL (EGFR L858R)
IFDFGRAKY

SEQ ID NO: 5136 - protein, 8 aa, Artificial Sequence
  Description of Artificial Sequence: Synthetic peptide
  Seed: ITDFGRAK (EGFR L858R)
IFDFGRAY

SEQ ID NO: 5137 - protein, 8 aa, Artificial Sequence
  Description of Artificial Sequence: Synthetic peptide
  Seed: ITDFGRAK (EGFR L858R)
IGDFGRAK

SEQ ID NO: 5138 - protein, 9 aa, Artificial Sequence
  Description of Artificial Sequence: Synthetic peptide
  Seed: ITDFGRAKL (EGFR L858R)
IGDFGRAKA

SEQ ID NO: 5139 - protein, 9 aa, Artificial Sequence
  Description of Artificial Sequence: Synthetic peptide
  Seed: ITDFGRAKL (EGFR L858R)
IGDFGRAKC

SEQ ID NO: 5140 - protein, 9 aa, Artificial Sequence
  Description of Artificial Sequence: Synthetic peptide
  Seed: ITDFGRAKL (EGFR L858R)
IGDFGRAKI

SEQ ID NO: 5141 - protein, 9 aa, Artificial Sequence
  Description of Artificial Sequence: Synthetic peptide
  Seed: ITDFGRAKL (EGFR L858R)
IGDFGRAKK

SEQ ID NO: 5142 - protein, 10 aa, Artificial Sequence
  Description of Artificial Sequence: Synthetic peptide
  Seed: ITDFGRAKLL (EGFR L858R)
IGDFGRAKLF

SEQ ID NO: 5143 - protein, 10 aa, Artificial Sequence
  Description of Artificial Sequence: Synthetic peptide
  Seed: ITDFGRAKLL (EGFR L858R)
IGDFGRAKLI

SEQ ID NO: 5144 - protein, 10 aa, Artificial Sequence
  Description of Artificial Sequence: Synthetic peptide
  Seed: ITDFGRAKLL (EGFR L858R)
IGDFGRAKLK

SEQ ID NO: 5145 - protein, 10 aa, Artificial Sequence
  Description of Artificial Sequence: Synthetic peptide
  Seed: ITDFGRAKLL (EGFR L858R)
IGDFGRAKLL

SEQ ID NO: 5146 - protein, 10 aa, Artificial Sequence
  Description of Artificial Sequence: Synthetic peptide
  Seed: ITDFGRAKLL (EGFR L858R)
IGDFGRAKLM

SEQ ID NO: 5147 - protein, 10 aa, Artificial Sequence
  Description of Artificial Sequence: Synthetic peptide
  Seed: ITDFGRAKLL (EGFR L858R)
IGDFGRAKLV

SEQ ID NO: 5148 - protein, 10 aa, Artificial Sequence
  Description of Artificial Sequence: Synthetic peptide
  Seed: ITDFGRAKLL (EGFR L858R)
IGDFGRAKLW

SEQ ID NO: 5149 - protein, 10 aa, Artificial Sequence
  Description of Artificial Sequence: Synthetic peptide
  Seed: ITDFGRAKLL (EGFR L858R)
IGDFGRAKLY

SEQ ID NO: 5150 - protein, 9 aa, Artificial Sequence
  Description of Artificial Sequence: Synthetic peptide
  Seed: ITDFGRAKL (EGFR L858R)
IGDFGRAKR

SEQ ID NO: 5151 - protein, 9 aa, Artificial Sequence
  Description of Artificial Sequence: Synthetic peptide
  Seed: ITDFGRAKL (EGFR L858R)
IGDFGRAKV

SEQ ID NO: 5152 - protein, 9 aa, Artificial Sequence
  Description of Artificial Sequence: Synthetic peptide
  Seed: ITDFGRAKL (EGFR L858R)
IGDFGRAKW

SEQ ID NO: 5153 - protein, 9 aa, Artificial Sequence
  Description of Artificial Sequence: Synthetic peptide
  Seed: ITDFGRAKL (EGFR L858R)
IGDFGRAKY

SEQ ID NO: 5154 - protein, 8 aa, Artificial Sequence
  Description of Artificial Sequence: Synthetic peptide
  Seed: ITDFGRAK (EGFR L858R)
IGDFGRAY

SEQ ID NO: 5155 - protein, 9 aa, Artificial Sequence
  Description of Artificial Sequence: Synthetic peptide
  Seed: ITDFGRAKL (EGFR L858R)
IHDFGRAKF

SEQ ID NO: 5156 - protein, 9 aa, Artificial Sequence
  Description of Artificial Sequence: Synthetic peptide
  Seed: ITDFGRAKL (EGFR L858R)
IHDFGRAKI

SEQ ID NO: 5157 - protein, 9 aa, Artificial Sequence
  Description of Artificial Sequence: Synthetic peptide
  Seed: ITDFGRAKL (EGFR L858R)
IHDFGRAKL

SEQ ID NO: 5158 - protein, 10 aa, Artificial Sequence
  Description of Artificial Sequence: Synthetic peptide
  Seed: ITDFGRAKLL (EGFR L858R)
IHDFGRAKLF

SEQ ID NO: 5159 - protein, 10 aa, Artificial Sequence
  Description of Artificial Sequence: Synthetic peptide
  Seed: ITDFGRAKLL (EGFR L858R)
IHDFGRAKLL

SEQ ID NO: 5160 - protein, 10 aa, Artificial Sequence
  Description of Artificial Sequence: Synthetic peptide
  Seed: ITDFGRAKLL (EGFR L858R)
IHDFGRAKLM

SEQ ID NO: 5161 - protein, 9 aa, Artificial Sequence
  Description of Artificial Sequence: Synthetic peptide
  Seed: ITDFGRAKL (EGFR L858R)
IHDFGRAKM

SEQ ID NO: 5162 - protein, 9 aa, Artificial Sequence
  Description of Artificial Sequence: Synthetic peptide
  Seed: ITDFGRAKL (EGFR L858R)
IHDFGRAKV

SEQ ID NO: 5163 - protein, 9 aa, Artificial Sequence
  Description of Artificial Sequence: Synthetic peptide
  Seed: ITDFGRAKL (EGFR L858R)
IHDFGRAKW

SEQ ID NO: 5164 - protein, 9 aa, Artificial Sequence
  Description of Artificial Sequence: Synthetic peptide
  Seed: ITDFGRAKL (EGFR L858R)
IHDFGRAKY

SEQ ID NO: 5165 - protein, 8 aa, Artificial Sequence
  Description of Artificial Sequence: Synthetic peptide
  Seed: ITDFGRAK (EGFR L858R)
IIDFGRAF

SEQ ID NO: 5166 - protein, 8 aa, Artificial Sequence
  Description of Artificial Sequence: Synthetic peptide
  Seed: ITDFGRAK (EGFR L858R)
IIDFGRAK

SEQ ID NO: 5167 - protein, 9 aa, Artificial Sequence
  Description of Artificial Sequence: Synthetic peptide
  Seed: ITDFGRAKL (EGFR L858R)
IIDFGRAKA

SEQ ID NO: 5168 - protein, 9 aa, Artificial Sequence
  Description of Artificial Sequence: Synthetic peptide
  Seed: ITDFGRAKL (EGFR L858R)
IIDFGRAKC

SEQ ID NO: 5169 - protein, 9 aa, Artificial Sequence
  Description of Artificial Sequence: Synthetic peptide
  Seed: ITDFGRAKL (EGFR L858R)
IIDFGRAKH

SEQ ID NO: 5170 - protein, 9 aa, Artificial Sequence
  Description of Artificial Sequence: Synthetic peptide
  Seed: ITDFGRAKL (EGFR L858R)
IIDFGRAKK

SEQ ID NO: 5171 - protein, 10 aa, Artificial Sequence
  Description of Artificial Sequence: Synthetic peptide
  Seed: ITDFGRAKLL (EGFR L858R)
IIDFGRAKLF

SEQ ID NO: 5172 - protein, 10 aa, Artificial Sequence
  Description of Artificial Sequence: Synthetic peptide
  Seed: ITDFGRAKLL (EGFR L858R)
IIDFGRAKLI

SEQ ID NO: 5173 - protein, 10 aa, Artificial Sequence
  Description of Artificial Sequence: Synthetic peptide
  Seed: ITDFGRAKLL (EGFR L858R)
IIDFGRAKLK

SEQ ID NO: 5174 - protein, 10 aa, Artificial Sequence
  Description of Artificial Sequence: Synthetic peptide
  Seed: ITDFGRAKLL (EGFR L858R)
IIDFGRAKLL

SEQ ID NO: 5175 - protein, 10 aa, Artificial Sequence
  Description of Artificial Sequence: Synthetic peptide
  Seed: ITDFGRAKLL (EGFR L858R)
IIDFGRAKLM

SEQ ID NO: 5176 - protein, 10 aa, Artificial Sequence
  Description of Artificial Sequence: Synthetic peptide
  Seed: ITDFGRAKLL (EGFR L858R)
IIDFGRAKLR

SEQ ID NO: 5177 - protein, 10 aa, Artificial Sequence
  Description of Artificial Sequence: Synthetic peptide
  Seed: ITDFGRAKLL (EGFR L858R)
IIDFGRAKLV

SEQ ID NO: 5178 - protein, 10 aa, Artificial Sequence
  Description of Artificial Sequence: Synthetic peptide
  Seed: ITDFGRAKLL (EGFR L858R)
IIDFGRAKLY

SEQ ID NO: 5179 - protein, 9 aa, Artificial Sequence
  Description of Artificial Sequence: Synthetic peptide
  Seed: ITDFGRAKL (EGFR L858R)
IIDFGRAKR

SEQ ID NO: 5180 - protein, 9 aa, Artificial Sequence
  Description of Artificial Sequence: Synthetic peptide
  Seed: ITDFGRAKL (EGFR L858R)
IIDFGRAKW

SEQ ID NO: 5181 - protein, 9 aa, Artificial Sequence
  Description of Artificial Sequence: Synthetic peptide
  Seed: ITDFGRAKL (EGFR L858R)
IIDFGRAKY

SEQ ID NO: 5182 - protein, 8 aa, Artificial Sequence
  Description of Artificial Sequence: Synthetic peptide
  Seed: ITDFGRAK (EGFR L858R)
IIDFGRAR

SEQ ID NO: 5183 - protein, 8 aa, Artificial Sequence
  Description of Artificial Sequence: Synthetic peptide
  Seed: ITDFGRAK (EGFR L858R)
IIDFGRAY

SEQ ID NO: 5184 - protein, 9 aa, Artificial Sequence
  Description of Artificial Sequence: Synthetic peptide
  Seed: ITDFGRAKL (EGFR L858R)
IKDFGRAKF

SEQ ID NO: 5185 - protein, 9 aa, Artificial Sequence
  Description of Artificial Sequence: Synthetic peptide
  Seed: ITDFGRAKL (EGFR L858R)
IKDFGRAKL

SEQ ID NO: 5186 - protein, 10 aa, Artificial Sequence
  Description of Artificial Sequence: Synthetic peptide
  Seed: ITDFGRAKLL (EGFR L858R)
IKDFGRAKLY

SEQ ID NO: 5187 - protein, 9 aa, Artificial Sequence
  Description of Artificial Sequence: Synthetic peptide
  Seed: ITDFGRAKL (EGFR L858R)
IKDFGRAKM

SEQ ID NO: 5188 - protein, 9 aa, Artificial Sequence
  Description of Artificial Sequence: Synthetic peptide
  Seed: ITDFGRAKL (EGFR L858R)
IKDFGRAKW

SEQ ID NO: 5189 - protein, 9 aa, Artificial Sequence
  Description of Artificial Sequence: Synthetic peptide
  Seed: ITDFGRAKL (EGFR L858R)
IKDFGRAKY

SEQ ID NO: 5190 - protein, 8 aa, Artificial Sequence
  Description of Artificial Sequence: Synthetic peptide
  Seed: ITDFGRAK (EGFR L858R)
ILDFGRAK

SEQ ID NO: 5191 - protein, 9 aa, Artificial Sequence
  Description of Artificial Sequence: Synthetic peptide
  Seed: ITDFGRAKL (EGFR L858R)
ILDFGRAKA

SEQ ID NO: 5192 - protein, 9 aa, Artificial Sequence
  Description of Artificial Sequence: Synthetic peptide
  Seed: ITDFGRAKL (EGFR L858R)
ILDFGRAKC

SEQ ID NO: 5193 - protein, 9 aa, Artificial Sequence
  Description of Artificial Sequence: Synthetic peptide
  Seed: ITDFGRAKL (EGFR L858R)
ILDFGRAKH

SEQ ID NO: 5194 - protein, 9 aa, Artificial Sequence
  Description of Artificial Sequence: Synthetic peptide
  Seed: ITDFGRAKL (EGFR L858R)
ILDFGRAKK

SEQ ID NO: 5195 - protein, 10 aa, Artificial Sequence
  Description of Artificial Sequence: Synthetic peptide
  Seed: ITDFGRAKLL (EGFR L858R)
ILDFGRAKLF

SEQ ID NO: 5196 - protein, 10 aa, Artificial Sequence
  Description of Artificial Sequence: Synthetic peptide
  Seed: ITDFGRAKLL (EGFR L858R)
ILDFGRAKLI

SEQ ID NO: 5197 - protein, 10 aa, Artificial Sequence
  Description of Artificial Sequence: Synthetic peptide
  Seed: ITDFGRAKLL (EGFR L858R)
ILDFGRAKLK

SEQ ID NO: 5198 - protein, 10 aa, Artificial Sequence
  Description of Artificial Sequence: Synthetic peptide
  Seed: ITDFGRAKLL (EGFR L858R)
ILDFGRAKLL

SEQ ID NO: 5199 - protein, 10 aa, Artificial Sequence
  Description of Artificial Sequence: Synthetic peptide
  Seed: ITDFGRAKLL (EGFR L858R)
ILDFGRAKLM

SEQ ID NO: 5200 - protein, 10 aa, Artificial Sequence
  Description of Artificial Sequence: Synthetic peptide
  Seed: ITDFGRAKLL (EGFR L858R)
ILDFGRAKLR

SEQ ID NO: 5201 - protein, 10 aa, Artificial Sequence
  Description of Artificial Sequence: Synthetic peptide
  Seed: ITDFGRAKLL (EGFR L858R)
ILDFGRAKLV

SEQ ID NO: 5202 - protein, 10 aa, Artificial Sequence
  Description of Artificial Sequence: Synthetic peptide
  Seed: ITDFGRAKLL (EGFR L858R)
ILDFGRAKLW

SEQ ID NO: 5203 - protein, 10 aa, Artificial Sequence
  Description of Artificial Sequence: Synthetic peptide
  Seed: ITDFGRAKLL (EGFR L858R)
ILDFGRAKLY

SEQ ID NO: 5204 - protein, 9 aa, Artificial Sequence
  Description of Artificial Sequence: Synthetic peptide
  Seed: ITDFGRAKL (EGFR L858R)
ILDFGRAKR

SEQ ID NO: 5205 - protein, 9 aa, Artificial Sequence
  Description of Artificial Sequence: Synthetic peptide
  Seed: ITDFGRAKL (EGFR L858R)
ILDFGRAKW

SEQ ID NO: 5206 - protein, 9 aa, Artificial Sequence
  Description of Artificial Sequence: Synthetic peptide
  Seed: ITDFGRAKL (EGFR L858R)
ILDFGRAKY

SEQ ID NO: 5207 - protein, 8 aa, Artificial Sequence
  Description of Artificial Sequence: Synthetic peptide
  Seed: ITDFGRAK (EGFR L858R)
ILDFGRAY

SEQ ID NO: 5208 - protein, 8 aa, Artificial Sequence
  Description of Artificial Sequence: Synthetic peptide
  Seed: ITDFGRAK (EGFR L858R)
IMDFGRAK

SEQ ID NO: 5209 - protein, 9 aa, Artificial Sequence
  Description of Artificial Sequence: Synthetic peptide
  Seed: ITDFGRAKL (EGFR L858R)
IMDFGRAKA

SEQ ID NO: 5210 - protein, 9 aa, Artificial Sequence
  Description of Artificial Sequence: Synthetic peptide
  Seed: ITDFGRAKL (EGFR L858R)
IMDFGRAKC

SEQ ID NO: 5211 - protein, 9 aa, Artificial Sequence
  Description of Artificial Sequence: Synthetic peptide
  Seed: ITDFGRAKL (EGFR L858R)
IMDFGRAKH

SEQ ID NO: 5212 - protein, 9 aa, Artificial Sequence
  Description of Artificial Sequence: Synthetic peptide
  Seed: ITDFGRAKL (EGFR L858R)
IMDFGRAKK

SEQ ID NO: 5213 - protein, 10 aa, Artificial Sequence
  Description of Artificial Sequence: Synthetic peptide
  Seed: ITDFGRAKLL (EGFR L858R)
IMDFGRAKLF

SEQ ID NO: 5214 - protein, 10 aa, Artificial Sequence
  Description of Artificial Sequence: Synthetic peptide
  Seed: ITDFGRAKLL (EGFR L858R)
IMDFGRAKLH

SEQ ID NO: 5215 - protein, 10 aa, Artificial Sequence
  Description of Artificial Sequence: Synthetic peptide
  Seed: ITDFGRAKLL (EGFR L858R)
IMDFGRAKLI

SEQ ID NO: 5216 - protein, 10 aa, Artificial Sequence
  Description of Artificial Sequence: Synthetic peptide
  Seed: ITDFGRAKLL (EGFR L858R)
IMDFGRAKLK

SEQ ID NO: 5217 - protein, 10 aa, Artificial Sequence
  Description of Artificial Sequence: Synthetic peptide
  Seed: ITDFGRAKLL (EGFR L858R)
IMDFGRAKLL

SEQ ID NO: 5218 - protein, 10 aa, Artificial Sequence
  Description of Artificial Sequence: Synthetic peptide
  Seed: ITDFGRAKLL (EGFR L858R)
IMDFGRAKLM

SEQ ID NO: 5219 - protein, 10 aa, Artificial Sequence
  Description of Artificial Sequence: Synthetic peptide
  Seed: ITDFGRAKLL (EGFR L858R)
IMDFGRAKLR

SEQ ID NO: 5220 - protein, 10 aa, Artificial Sequence
  Description of Artificial Sequence: Synthetic peptide
  Seed: ITDFGRAKLL (EGFR L858R)
IMDFGRAKLV

SEQ ID NO: 5221 - protein, 10 aa, Artificial Sequence
  Description of Artificial Sequence: Synthetic peptide
  Seed: ITDFGRAKLL (EGFR L858R)
IMDFGRAKLY

SEQ ID NO: 5222 - protein, 9 aa, Artificial Sequence
  Description of Artificial Sequence: Synthetic peptide
  Seed: ITDFGRAKL (EGFR L858R)
IMDFGRAKR

SEQ ID NO: 5223 - protein, 9 aa, Artificial Sequence
  Description of Artificial Sequence: Synthetic peptide
  Seed: ITDFGRAKL (EGFR L858R)
IMDFGRAKW

SEQ ID NO: 5224 - protein, 9 aa, Artificial Sequence
  Description of Artificial Sequence: Synthetic peptide
  Seed: ITDFGRAKL (EGFR L858R)
IMDFGRAKY

SEQ ID NO: 5225 - protein, 8 aa, Artificial Sequence
  Description of Artificial Sequence: Synthetic peptide
  Seed: ITDFGRAK (EGFR L858R)
IMDFGRAY

SEQ ID NO: 5226 - protein, 9 aa, Artificial Sequence
  Description of Artificial Sequence: Synthetic peptide
  Seed: ITDFGRAKL (EGFR L858R)
INDFGRAKF

SEQ ID NO: 5227 - protein, 9 aa, Artificial Sequence
  Description of Artificial Sequence: Synthetic peptide
  Seed: ITDFGRAKL (EGFR L858R)
INDFGRAKI

SEQ ID NO: 5228 - protein, 9 aa, Artificial Sequence
  Description of Artificial Sequence: Synthetic peptide
  Seed: ITDFGRAKL (EGFR L858R)
INDFGRAKK

SEQ ID NO: 5229 - protein, 9 aa, Artificial Sequence
  Description of Artificial Sequence: Synthetic peptide
  Seed: ITDFGRAKL (EGFR L858R)
INDFGRAKL

SEQ ID NO: 5230 - protein, 10 aa, Artificial Sequence
  Description of Artificial Sequence: Synthetic peptide
  Seed: ITDFGRAKLL (EGFR L858R)
INDFGRAKLF

SEQ ID NO: 5231 - protein, 10 aa, Artificial Sequence
  Description of Artificial Sequence: Synthetic peptide
  Seed: ITDFGRAKLL (EGFR L858R)
INDFGRAKLK

SEQ ID NO: 5232 - protein, 10 aa, Artificial Sequence
  Description of Artificial Sequence: Synthetic peptide
  Seed: ITDFGRAKLL (EGFR L858R)
INDFGRAKLL

SEQ ID NO: 5233 - protein, 10 aa, Artificial Sequence
  Description of Artificial Sequence: Synthetic peptide
  Seed: ITDFGRAKLL (EGFR L858R)
INDFGRAKLM

SEQ ID NO: 5234 - protein, 10 aa, Artificial Sequence
  Description of Artificial Sequence: Synthetic peptide
  Seed: ITDFGRAKLL (EGFR L858R)
INDFGRAKLW

SEQ ID NO: 5235 - protein, 10 aa, Artificial Sequence
  Description of Artificial Sequence: Synthetic peptide
  Seed: ITDFGRAKLL (EGFR L858R)
INDFGRAKLY

SEQ ID NO: 5236 - protein, 9 aa, Artificial Sequence
  Description of Artificial Sequence: Synthetic peptide
  Seed: ITDFGRAKL (EGFR L858R)
INDFGRAKM

SEQ ID NO: 5237 - protein, 9 aa, Artificial Sequence
  Description of Artificial Sequence: Synthetic peptide
  Seed: ITDFGRAKL (EGFR L858R)
INDFGRAKR

SEQ ID NO: 5238 - protein, 9 aa, Artificial Sequence
  Description of Artificial Sequence: Synthetic peptide
  Seed: ITDFGRAKL (EGFR L858R)
INDFGRAKV

SEQ ID NO: 5239 - protein, 9 aa, Artificial Sequence
  Description of Artificial Sequence: Synthetic peptide
  Seed: ITDFGRAKL (EGFR L858R)
INDFGRAKW

SEQ ID NO: 5240 - protein, 9 aa, Artificial Sequence
  Description of Artificial Sequence: Synthetic peptide
  Seed: ITDFGRAKL (EGFR L858R)
INDFGRAKY

SEQ ID NO: 5241 - protein, 8 aa, Artificial Sequence
  Description of Artificial Sequence: Synthetic peptide
  Seed: ITDFGRAK (EGFR L858R)
INDFGRAY

SEQ ID NO: 5242 - protein, 9 aa, Artificial Sequence
  Description of Artificial Sequence: Synthetic peptide
  Seed: ITDFGRAKL (EGFR L858R)
IPDFGRAKF

SEQ ID NO: 5243 - protein, 9 aa, Artificial Sequence
  Description of Artificial Sequence: Synthetic peptide
  Seed: ITDFGRAKL (EGFR L858R)
IPDFGRAKI

SEQ ID NO: 5244 - protein, 9 aa, Artificial Sequence
  Description of Artificial Sequence: Synthetic peptide
  Seed: ITDFGRAKL (EGFR L858R)
IPDFGRAKL

SEQ ID NO: 5245 - protein, 10 aa, Artificial Sequence
  Description of Artificial Sequence: Synthetic peptide
  Seed: ITDFGRAKLL (EGFR L858R)
IPDFGRAKLF

SEQ ID NO: 5246 - protein, 10 aa, Artificial Sequence
  Description of Artificial Sequence: Synthetic peptide
  Seed: ITDFGRAKLL (EGFR L858R)
IPDFGRAKLL

SEQ ID NO: 5247 - protein, 10 aa, Artificial Sequence
  Description of Artificial Sequence: Synthetic peptide
  Seed: ITDFGRAKLL (EGFR L858R)
IPDFGRAKLM

SEQ ID NO: 5248 - protein, 10 aa, Artificial Sequence
  Description of Artificial Sequence: Synthetic peptide
  Seed: ITDFGRAKLL (EGFR L858R)
IPDFGRAKLW

SEQ ID NO: 5249 - protein, 10 aa, Artificial Sequence
  Description of Artificial Sequence: Synthetic peptide
  Seed: ITDFGRAKLL (EGFR L858R)
IPDFGRAKLY

SEQ ID NO: 5250 - protein, 9 aa, Artificial Sequence
  Description of Artificial Sequence: Synthetic peptide
  Seed: ITDFGRAKL (EGFR L858R)
IPDFGRAKM

SEQ ID NO: 5251 - protein, 9 aa, Artificial Sequence
  Description of Artificial Sequence: Synthetic peptide
  Seed: ITDFGRAKL (EGFR L858R)
IPDFGRAKV

SEQ ID NO: 5252 - protein, 9 aa, Artificial Sequence
  Description of Artificial Sequence: Synthetic peptide
  Seed: ITDFGRAKL (EGFR L858R)
IPDFGRAKW

SEQ ID NO: 5253 - protein, 9 aa, Artificial Sequence
  Description of Artificial Sequence: Synthetic peptide
  Seed: ITDFGRAKL (EGFR L858R)
IPDFGRAKY

SEQ ID NO: 5254 - protein, 9 aa, Artificial Sequence
  Description of Artificial Sequence: Synthetic peptide
  Seed: ITDFGRAKL (EGFR L858R)
IQDFGRAKC

SEQ ID NO: 5255 - protein, 9 aa, Artificial Sequence
  Description of Artificial Sequence: Synthetic peptide
  Seed: ITDFGRAKL (EGFR L858R)
IQDFGRAKI

SEQ ID NO: 5256 - protein, 9 aa, Artificial Sequence
  Description of Artificial Sequence: Synthetic peptide
  Seed: ITDFGRAKL (EGFR L858R)
IQDFGRAKK

SEQ ID NO: 5257 - protein, 10 aa, Artificial Sequence
  Description of Artificial Sequence: Synthetic peptide
  Seed: ITDFGRAKLL (EGFR L858R)
IQDFGRAKLF

SEQ ID NO: 5258 - protein, 10 aa, Artificial Sequence
  Description of Artificial Sequence: Synthetic peptide
  Seed: ITDFGRAKLL (EGFR L858R)
IQDFGRAKLI

SEQ ID NO: 5259 - protein, 10 aa, Artificial Sequence
  Description of Artificial Sequence: Synthetic peptide
  Seed: ITDFGRAKLL (EGFR L858R)
IQDFGRAKLK

SEQ ID NO: 5260 - protein, 10 aa, Artificial Sequence
  Description of Artificial Sequence: Synthetic peptide
  Seed: ITDFGRAKLL (EGFR L858R)
IQDFGRAKLL

SEQ ID NO: 5261 - protein, 10 aa, Artificial Sequence
  Description of Artificial Sequence: Synthetic peptide
  Seed: ITDFGRAKLL (EGFR L858R)
IQDFGRAKLM

SEQ ID NO: 5262 - protein, 10 aa, Artificial Sequence
  Description of Artificial Sequence: Synthetic peptide
  Seed: ITDFGRAKLL (EGFR L858R)
IQDFGRAKLW

SEQ ID NO: 5263 - protein, 10 aa, Artificial Sequence
  Description of Artificial Sequence: Synthetic peptide
  Seed: ITDFGRAKLL (EGFR L858R)
IQDFGRAKLY

SEQ ID NO: 5264 - protein, 9 aa, Artificial Sequence
  Description of Artificial Sequence: Synthetic peptide
  Seed: ITDFGRAKL (EGFR L858R)
IQDFGRAKR

SEQ ID NO: 5265 - protein, 9 aa, Artificial Sequence
  Description of Artificial Sequence: Synthetic peptide
  Seed: ITDFGRAKL (EGFR L858R)
IQDFGRAKV

SEQ ID NO: 5266 - protein, 9 aa, Artificial Sequence
  Description of Artificial Sequence: Synthetic peptide
  Seed: ITDFGRAKL (EGFR L858R)
IQDFGRAKW

SEQ ID NO: 5267 - protein, 9 aa, Artificial Sequence
  Description of Artificial Sequence: Synthetic peptide
  Seed: ITDFGRAKL (EGFR L858R)
IQDFGRAKY

SEQ ID NO: 5268 - protein, 8 aa, Artificial Sequence
  Description of Artificial Sequence: Synthetic peptide
  Seed: ITDFGRAK (EGFR L858R)
IQDFGRAY

SEQ ID NO: 5269 - protein, 9 aa, Artificial Sequence
  Description of Artificial Sequence: Synthetic peptide
  Seed: ITDFGRAKL (EGFR L858R)
IRDFGRAKC

SEQ ID NO: 5270 - protein, 9 aa, Artificial Sequence
  Description of Artificial Sequence: Synthetic peptide
  Seed: ITDFGRAKL (EGFR L858R)
IRDFGRAKF

SEQ ID NO: 5271 - protein, 9 aa, Artificial Sequence
  Description of Artificial Sequence: Synthetic peptide
  Seed: ITDFGRAKL (EGFR L858R)
IRDFGRAKI

SEQ ID NO: 5272 - protein, 9 aa, Artificial Sequence
  Description of Artificial Sequence: Synthetic peptide
  Seed: ITDFGRAKL (EGFR L858R)
IRDFGRAKL

SEQ ID NO: 5273 - protein, 9 aa, Artificial Sequence
  Description of Artificial Sequence: Synthetic peptide
  Seed: ITDFGRAKL (EGFR L858R)
IRDFGRAKM

SEQ ID NO: 5274 - protein, 9 aa, Artificial Sequence
  Description of Artificial Sequence: Synthetic peptide
  Seed: ITDFGRAKL (EGFR L858R)
IRDFGRAKV

SEQ ID NO: 5275 - protein, 9 aa, Artificial Sequence
  Description of Artificial Sequence: Synthetic peptide
  Seed: ITDFGRAKL (EGFR L858R)
IRDFGRAKW

SEQ ID NO: 5276 - protein, 9 aa, Artificial Sequence
  Description of Artificial Sequence: Synthetic peptide
  Seed: ITDFGRAKL (EGFR L858R)
IRDFGRAKY

SEQ ID NO: 5277 - protein, 8 aa, Artificial Sequence
  Description of Artificial Sequence: Synthetic peptide
  Seed: ITDFGRAK (EGFR L858R)
ISDFGRAF

SEQ ID NO: 5278 - protein, 8 aa, Artificial Sequence
  Description of Artificial Sequence: Synthetic peptide
  Seed: ITDFGRAK (EGFR L858R)
ISDFGRAK

SEQ ID NO: 5279 - protein, 9 aa, Artificial Sequence
  Description of Artificial Sequence: Synthetic peptide
  Seed: ITDFGRAKL (EGFR L858R)
ISDFGRAKA

SEQ ID NO: 5280 - protein, 9 aa, Artificial Sequence
  Description of Artificial Sequence: Synthetic peptide
  Seed: ITDFGRAKL (EGFR L858R)
ISDFGRAKC

SEQ ID NO: 5281 - protein, 9 aa, Artificial Sequence
  Description of Artificial Sequence: Synthetic peptide
  Seed: ITDFGRAKL (EGFR L858R)
ISDFGRAKH

SEQ ID NO: 5282 - protein, 9 aa, Artificial Sequence
  Description of Artificial Sequence: Synthetic peptide
  Seed: ITDFGRAKL (EGFR L858R)
ISDFGRAKK

SEQ ID NO: 5283 - protein, 10 aa, Artificial Sequence
  Description of Artificial Sequence: Synthetic peptide
  Seed: ITDFGRAKLL (EGFR L858R)
ISDFGRAKLH

SEQ ID NO: 5284 - protein, 10 aa, Artificial Sequence
  Description of Artificial Sequence: Synthetic peptide
  Seed: ITDFGRAKLL (EGFR L858R)
ISDFGRAKLK

SEQ ID NO: 5285 - protein, 10 aa, Artificial Sequence
  Description of Artificial Sequence: Synthetic peptide
  Seed: ITDFGRAKLL (EGFR L858R)
ISDFGRAKLR

SEQ ID NO: 5286 - protein, 10 aa, Artificial Sequence
  Description of Artificial Sequence: Synthetic peptide
  Seed: ITDFGRAKLL (EGFR L858R)
ISDFGRAKLV

SEQ ID NO: 5287 - protein, 9 aa, Artificial Sequence
  Description of Artificial Sequence: Synthetic peptide
  Seed: ITDFGRAKL (EGFR L858R)
ISDFGRAKQ

SEQ ID NO: 5288 - protein, 9 aa, Artificial Sequence
  Description of Artificial Sequence: Synthetic peptide
  Seed: ITDFGRAKL (EGFR L858R)
ISDFGRAKR

SEQ ID NO: 5289 - protein, 9 aa, Artificial Sequence
  Description of Artificial Sequence: Synthetic peptide
  Seed: ITDFGRAKL (EGFR L858R)
ISDFGRAKT

SEQ ID NO: 5290 - protein, 8 aa, Artificial Sequence
  Description of Artificial Sequence: Synthetic peptide
  Seed: ITDFGRAK (EGFR L858R)
ISDFGRAL

SEQ ID NO: 5291 - protein, 8 aa, Artificial Sequence
  Description of Artificial Sequence: Synthetic peptide
  Seed: ITDFGRAK (EGFR L858R)
ISDFGRAM

SEQ ID NO: 5292 - protein, 8 aa, Artificial Sequence
  Description of Artificial Sequence: Synthetic peptide
  Seed: ITDFGRAK (EGFR L858R)
ISDFGRAR

SEQ ID NO: 5293 - protein, 8 aa, Artificial Sequence
  Description of Artificial Sequence: Synthetic peptide
  Seed: ITDFGRAK (EGFR L858R)
ISDFGRAY

SEQ ID NO: 5294 - protein, 8 aa, Artificial Sequence
  Description of Artificial Sequence: Synthetic peptide
  Seed: ITDFGRAK (EGFR L858R)
ITDFGRAF

SEQ ID NO: 5295 - protein, 8 aa, Artificial Sequence
  Description of Artificial Sequence: Synthetic peptide
  Seed: ITDFGRAK (EGFR L858R)
ITDFGRAH

SEQ ID NO: 5296 - protein, 9 aa, Artificial Sequence
  Description of Artificial Sequence: Synthetic peptide
  Seed: ITDFGRAKL (EGFR L858R)
ITDFGRAKA

SEQ ID NO: 5297 - protein, 9 aa, Artificial Sequence
  Description of Artificial Sequence: Synthetic peptide
  Seed: ITDFGRAKL (EGFR L858R)
ITDFGRAKC

SEQ ID NO: 5298 - protein, 9 aa, Artificial Sequence
  Description of Artificial Sequence: Synthetic peptide
  Seed: ITDFGRAKL (EGFR L858R)
ITDFGRAKH

SEQ ID NO: 5299 - protein, 9 aa, Artificial Sequence
  Description of Artificial Sequence: Synthetic peptide
  Seed: ITDFGRAKL (EGFR L858R)
ITDFGRAKK

SEQ ID NO: 5300 - protein, 10 aa, Artificial Sequence
  Description of Artificial Sequence: Synthetic peptide
  Seed: ITDFGRAKLL (EGFR L858R)
ITDFGRAKLH

SEQ ID NO: 5301 - protein, 10 aa, Artificial Sequence
  Description of Artificial Sequence: Synthetic peptide
  Seed: ITDFGRAKLL (EGFR L858R)
ITDFGRAKLI

SEQ ID NO: 5302 - protein, 10 aa, Artificial Sequence
  Description of Artificial Sequence: Synthetic peptide
  Seed: ITDFGRAKLL (EGFR L858R)
ITDFGRAKLK

SEQ ID NO: 5303 - protein, 10 aa, Artificial Sequence
  Description of Artificial Sequence: Synthetic peptide
  Seed: ITDFGRAKLL (EGFR L858R)
ITDFGRAKLQ

SEQ ID NO: 5304 - protein, 10 aa, Artificial Sequence
  Description of Artificial Sequence: Synthetic peptide
  Seed: ITDFGRAKLL (EGFR L858R)
ITDFGRAKLR

SEQ ID NO: 5305 - protein, 10 aa, Artificial Sequence
  Description of Artificial Sequence: Synthetic peptide
  Seed: ITDFGRAKLL (EGFR L858R)
ITDFGRAKLV

SEQ ID NO: 5306 - protein, 9 aa, Artificial Sequence
  Description of Artificial Sequence: Synthetic peptide
  Seed: ITDFGRAKL (EGFR L858R)
ITDFGRAKQ

SEQ ID NO: 5307 - protein, 9 aa, Artificial Sequence
  Description of Artificial Sequence: Synthetic peptide
  Seed: ITDFGRAKL (EGFR L858R)
ITDFGRAKR

SEQ ID NO: 5308 - protein, 8 aa, Artificial Sequence
  Description of Artificial Sequence: Synthetic peptide
  Seed: ITDFGRAK (EGFR L858R)
ITDFGRAL

SEQ ID NO: 5309 - protein, 8 aa, Artificial Sequence
  Description of Artificial Sequence: Synthetic peptide
  Seed: ITDFGRAK (EGFR L858R)
ITDFGRAM

SEQ ID NO: 5310 - protein, 8 aa, Artificial Sequence
  Description of Artificial Sequence: Synthetic peptide
  Seed: ITDFGRAK (EGFR L858R)
ITDFGRAR

SEQ ID NO: 5311 - protein, 8 aa, Artificial Sequence
  Description of Artificial Sequence: Synthetic peptide
  Seed: ITDFGRAK (EGFR L858R)
ITDFGRAW

SEQ ID NO: 5312 - protein, 8 aa, Artificial Sequence
  Description of Artificial Sequence: Synthetic peptide
  Seed: ITDFGRAK (EGFR L858R)
ITDFGRAY

SEQ ID NO: 5313 - protein, 8 aa, Artificial Sequence
  Description of Artificial Sequence: Synthetic peptide
  Seed: ITDFGRAK (EGFR L858R)
IVDFGRAF

SEQ ID NO: 5314 - protein, 8 aa, Artificial Sequence
  Description of Artificial Sequence: Synthetic peptide
  Seed: ITDFGRAK (EGFR L858R)
IVDFGRAK

SEQ ID NO: 5315 - protein, 9 aa, Artificial Sequence
  Description of Artificial Sequence: Synthetic peptide
  Seed: ITDFGRAKL (EGFR L858R)
IVDFGRAKA

SEQ ID NO: 5316 - protein, 9 aa, Artificial Sequence
  Description of Artificial Sequence: Synthetic peptide
  Seed: ITDFGRAKL (EGFR L858R)
IVDFGRAKC

SEQ ID NO: 5317 - protein, 9 aa, Artificial Sequence
  Description of Artificial Sequence: Synthetic peptide
  Seed: ITDFGRAKL (EGFR L858R)
IVDFGRAKH

SEQ ID NO: 5318 - protein, 9 aa, Artificial Sequence
  Description of Artificial Sequence: Synthetic peptide
  Seed: ITDFGRAKL (EGFR L858R)
IVDFGRAKK

SEQ ID NO: 5319 - protein, 10 aa, Artificial Sequence
  Description of Artificial Sequence: Synthetic peptide
  Seed: ITDFGRAKLL (EGFR L858R)
IVDFGRAKLH

SEQ ID NO: 5320 - protein, 10 aa, Artificial Sequence
  Description of Artificial Sequence: Synthetic peptide
  Seed: ITDFGRAKLL (EGFR L858R)
IVDFGRAKLI

SEQ ID NO: 5321 - protein, 10 aa, Artificial Sequence
  Description of Artificial Sequence: Synthetic peptide
  Seed: ITDFGRAKLL (EGFR L858R)
IVDFGRAKLK

SEQ ID NO: 5322 - protein, 10 aa, Artificial Sequence
  Description of Artificial Sequence: Synthetic peptide
  Seed: ITDFGRAKLL (EGFR L858R)
IVDFGRAKLL

SEQ ID NO: 5323 - protein, 10 aa, Artificial Sequence
  Description of Artificial Sequence: Synthetic peptide
  Seed: ITDFGRAKLL (EGFR L858R)
IVDFGRAKLM

SEQ ID NO: 5324 - protein, 10 aa, Artificial Sequence
  Description of Artificial Sequence: Synthetic peptide
  Seed: ITDFGRAKLL (EGFR L858R)
IVDFGRAKLR

SEQ ID NO: 5325 - protein, 10 aa, Artificial Sequence
  Description of Artificial Sequence: Synthetic peptide
  Seed: ITDFGRAKLL (EGFR L858R)
IVDFGRAKLV

SEQ ID NO: 5326 - protein, 9 aa, Artificial Sequence
  Description of Artificial Sequence: Synthetic peptide
  Seed: ITDFGRAKL (EGFR L858R)
IVDFGRAKR

SEQ ID NO: 5327 - protein, 9 aa, Artificial Sequence
  Description of Artificial Sequence: Synthetic peptide
  Seed: ITDFGRAKL (EGFR L858R)
IVDFGRAKW

SEQ ID NO: 5328 - protein, 9 aa, Artificial Sequence
  Description of Artificial Sequence: Synthetic peptide
  Seed: ITDFGRAKL (EGFR L858R)
IVDFGRAKY

SEQ ID NO: 5329 - protein, 8 aa, Artificial Sequence
  Description of Artificial Sequence: Synthetic peptide
  Seed: ITDFGRAK (EGFR L858R)
IVDFGRAR

SEQ ID NO: 5330 - protein, 8 aa, Artificial Sequence
  Description of Artificial Sequence: Synthetic peptide
  Seed: ITDFGRAK (EGFR L858R)
IVDFGRAY

SEQ ID NO: 5331 - protein, 9 aa, Artificial Sequence
  Description of Artificial Sequence: Synthetic peptide
  Seed: ITDFGRAKL (EGFR L858R)
IWDFGRAKA

SEQ ID NO: 5332 - protein, 9 aa, Artificial Sequence
  Description of Artificial Sequence: Synthetic peptide
  Seed: ITDFGRAKL (EGFR L858R)
IWDFGRAKC

SEQ ID NO: 5333 - protein, 9 aa, Artificial Sequence
  Description of Artificial Sequence: Synthetic peptide
  Seed: ITDFGRAKL (EGFR L858R)
IWDFGRAKF

SEQ ID NO: 5334 - protein, 9 aa, Artificial Sequence
  Description of Artificial Sequence: Synthetic peptide
  Seed: ITDFGRAKL (EGFR L858R)
IWDFGRAKI

SEQ ID NO: 5335 - protein, 9 aa, Artificial Sequence
  Description of Artificial Sequence: Synthetic peptide
  Seed: ITDFGRAKL (EGFR L858R)
IWDFGRAKL

SEQ ID NO: 5336 - protein, 10 aa, Artificial Sequence
  Description of Artificial Sequence: Synthetic peptide
  Seed: ITDFGRAKLL (EGFR L858R)
IWDFGRAKLF

SEQ ID NO: 5337 - protein, 10 aa, Artificial Sequence
  Description of Artificial Sequence: Synthetic peptide
  Seed: ITDFGRAKLL (EGFR L858R)
IWDFGRAKLI

SEQ ID NO: 5338 - protein, 10 aa, Artificial Sequence
  Description of Artificial Sequence: Synthetic peptide
  Seed: ITDFGRAKLL (EGFR L858R)
IWDFGRAKLL

SEQ ID NO: 5339 - protein, 10 aa, Artificial Sequence
  Description of Artificial Sequence: Synthetic peptide
  Seed: ITDFGRAKLL (EGFR L858R)
IWDFGRAKLM

SEQ ID NO: 5340 - protein, 10 aa, Artificial Sequence
  Description of Artificial Sequence: Synthetic peptide
  Seed: ITDFGRAKLL (EGFR L858R)
IWDFGRAKLV

SEQ ID NO: 5341 - protein, 10 aa, Artificial Sequence
  Description of Artificial Sequence: Synthetic peptide
  Seed: ITDFGRAKLL (EGFR L858R)
IWDFGRAKLW

SEQ ID NO: 5342 - protein, 10 aa, Artificial Sequence
  Description of Artificial Sequence: Synthetic peptide
  Seed: ITDFGRAKLL (EGFR L858R)
IWDFGRAKLY

SEQ ID NO: 5343 - protein, 9 aa, Artificial Sequence
  Description of Artificial Sequence: Synthetic peptide
  Seed: ITDFGRAKL (EGFR L858R)
IWDFGRAKM

SEQ ID NO: 5344 - protein, 9 aa, Artificial Sequence
  Description of Artificial Sequence: Synthetic peptide
  Seed: ITDFGRAKL (EGFR L858R)
IWDFGRAKT

SEQ ID NO: 5345 - protein, 9 aa, Artificial Sequence
  Description of Artificial Sequence: Synthetic peptide
  Seed: ITDFGRAKL (EGFR L858R)
IWDFGRAKV

SEQ ID NO: 5346 - protein, 9 aa, Artificial Sequence
  Description of Artificial Sequence: Synthetic peptide
  Seed: ITDFGRAKL (EGFR L858R)
IWDFGRAKW

SEQ ID NO: 5347 - protein, 9 aa, Artificial Sequence
  Description of Artificial Sequence: Synthetic peptide
  Seed: ITDFGRAKL (EGFR L858R)
IWDFGRAKY

SEQ ID NO: 5348 - protein, 9 aa, Artificial Sequence
  Description of Artificial Sequence: Synthetic peptide
  Seed: ITDFGRAKL (EGFR L858R)
IYDFGRAKA

SEQ ID NO: 5349 - protein, 9 aa, Artificial Sequence
  Description of Artificial Sequence: Synthetic peptide
  Seed: ITDFGRAKL (EGFR L858R)
IYDFGRAKC

SEQ ID NO: 5350 - protein, 9 aa, Artificial Sequence
  Description of Artificial Sequence: Synthetic peptide
  Seed: ITDFGRAKL (EGFR L858R)
IYDFGRAKF

SEQ ID NO: 5351 - protein, 9 aa, Artificial Sequence
  Description of Artificial Sequence: Synthetic peptide
  Seed: ITDFGRAKL (EGFR L858R)
IYDFGRAKI

SEQ ID NO: 5352 - protein, 9 aa, Artificial Sequence
  Description of Artificial Sequence: Synthetic peptide
  Seed: ITDFGRAKL (EGFR L858R)
IYDFGRAKK

SEQ ID NO: 5353 - protein, 9 aa, Artificial Sequence
  Description of Artificial Sequence: Synthetic peptide
  Seed: ITDFGRAKL (EGFR L858R)
IYDFGRAKL

SEQ ID NO: 5354 - protein, 10 aa, Artificial Sequence
  Description of Artificial Sequence: Synthetic peptide
  Seed: ITDFGRAKLL (EGFR L858R)
IYDFGRAKLC

SEQ ID NO: 5355 - protein, 10 aa, Artificial Sequence
  Description of Artificial Sequence: Synthetic peptide
  Seed: ITDFGRAKLL (EGFR L858R)
IYDFGRAKLF

SEQ ID NO: 5356 - protein, 10 aa, Artificial Sequence
  Description of Artificial Sequence: Synthetic peptide
  Seed: ITDFGRAKLL (EGFR L858R)
IYDFGRAKLI

SEQ ID NO: 5357 - protein, 10 aa, Artificial Sequence
  Description of Artificial Sequence: Synthetic peptide
  Seed: ITDFGRAKLL (EGFR L858R)
IYDFGRAKLL

SEQ ID NO: 5358 - protein, 10 aa, Artificial Sequence
  Description of Artificial Sequence: Synthetic peptide
  Seed: ITDFGRAKLL (EGFR L858R)
IYDFGRAKLM

SEQ ID NO: 5359 - protein, 10 aa, Artificial Sequence
  Description of Artificial Sequence: Synthetic peptide
  Seed: ITDFGRAKLL (EGFR L858R)
IYDFGRAKLV

SEQ ID NO: 5360 - protein, 10 aa, Artificial Sequence
  Description of Artificial Sequence: Synthetic peptide
  Seed: ITDFGRAKLL (EGFR L858R)
IYDFGRAKLW

SEQ ID NO: 5361 - protein, 10 aa, Artificial Sequence
  Description of Artificial Sequence: Synthetic peptide
  Seed: ITDFGRAKLL (EGFR L858R)
IYDFGRAKLY

SEQ ID NO: 5362 - protein, 9 aa, Artificial Sequence
  Description of Artificial Sequence: Synthetic peptide
  Seed: ITDFGRAKL (EGFR L858R)
IYDFGRAKM

SEQ ID NO: 5363 - protein, 9 aa, Artificial Sequence
  Description of Artificial Sequence: Synthetic peptide
  Seed: ITDFGRAKL (EGFR L858R)
IYDFGRAKT

SEQ ID NO: 5364 - protein, 9 aa, Artificial Sequence
  Description of Artificial Sequence: Synthetic peptide
  Seed: ITDFGRAKL (EGFR L858R)
IYDFGRAKV

SEQ ID NO: 5365 - protein, 9 aa, Artificial Sequence
  Description of Artificial Sequence: Synthetic peptide
  Seed: ITDFGRAKL (EGFR L858R)
IYDFGRAKW

SEQ ID NO: 5366 - protein, 9 aa, Artificial Sequence
  Description of Artificial Sequence: Synthetic peptide
  Seed: ITDFGRAKL (EGFR L858R)
IYDFGRAKY

SEQ ID NO: 5367 - protein, 9 aa, Artificial Sequence
  Description of Artificial Sequence: Synthetic peptide
  Seed: KITDFGRAK (EGFR L858R)
KATDFGRAA

SEQ ID NO: 5368 - protein, 9 aa, Artificial Sequence
  Description of Artificial Sequence: Synthetic peptide
  Seed: KITDFGRAK (EGFR L858R)
KATDFGRAC

SEQ ID NO: 5369 - protein, 9 aa, Artificial Sequence
  Description of Artificial Sequence: Synthetic peptide
  Seed: KITDFGRAK (EGFR L858R)
KATDFGRAF

SEQ ID NO: 5370 - protein, 9 aa, Artificial Sequence
  Description of Artificial Sequence: Synthetic peptide
  Seed: KITDFGRAK (EGFR L858R)
KATDFGRAH

SEQ ID NO: 5371 - protein, 9 aa, Artificial Sequence
  Description of Artificial Sequence: Synthetic peptide
  Seed: KITDFGRAK (EGFR L858R)
KATDFGRAI

SEQ ID NO: 5372 - protein, 10 aa, Artificial Sequence
  Description of Artificial Sequence: Synthetic peptide
  Seed: KITDFGRAKL (EGFR L858R)
KATDFGRAKF

SEQ ID NO: 5373 - protein, 10 aa, Artificial Sequence
  Description of Artificial Sequence: Synthetic peptide
  Seed: KITDFGRAKL (EGFR L858R)
KATDFGRAKH

SEQ ID NO: 5374 - protein, 10 aa, Artificial Sequence
  Description of Artificial Sequence: Synthetic peptide
  Seed: KITDFGRAKL (EGFR L858R)
KATDFGRAKI

SEQ ID NO: 5375 - protein, 10 aa, Artificial Sequence
  Description of Artificial Sequence: Synthetic peptide
  Seed: KITDFGRAKL (EGFR L858R)
KATDFGRAKK

SEQ ID NO: 5376 - protein, 10 aa, Artificial Sequence
  Description of Artificial Sequence: Synthetic peptide
  Seed: KITDFGRAKL (EGFR L858R)
KATDFGRAKL

SEQ ID NO: 5377 - protein, 10 aa, Artificial Sequence
  Description of Artificial Sequence: Synthetic peptide
  Seed: KITDFGRAKL (EGFR L858R)
KATDFGRAKM

SEQ ID NO: 5378 - protein, 10 aa, Artificial Sequence
  Description of Artificial Sequence: Synthetic peptide
  Seed: KITDFGRAKL (EGFR L858R)
KATDFGRAKR

SEQ ID NO: 5379 - protein, 10 aa, Artificial Sequence
  Description of Artificial Sequence: Synthetic peptide
  Seed: KITDFGRAKL (EGFR L858R)
KATDFGRAKV

SEQ ID NO: 5380 - protein, 10 aa, Artificial Sequence
  Description of Artificial Sequence: Synthetic peptide
  Seed: KITDFGRAKL (EGFR L858R)
KATDFGRAKW

SEQ ID NO: 5381 - protein, 10 aa, Artificial Sequence
  Description of Artificial Sequence: Synthetic peptide
  Seed: KITDFGRAKL (EGFR L858R)
KATDFGRAKY

SEQ ID NO: 5382 - protein, 9 aa, Artificial Sequence
  Description of Artificial Sequence: Synthetic peptide
  Seed: KITDFGRAK (EGFR L858R)
KATDFGRAL

SEQ ID NO: 5383 - protein, 9 aa, Artificial Sequence
  Description of Artificial Sequence: Synthetic peptide
  Seed: KITDFGRAK (EGFR L858R)
KATDFGRAM

SEQ ID NO: 5384 - protein, 9 aa, Artificial Sequence
  Description of Artificial Sequence: Synthetic peptide
  Seed: KITDFGRAK (EGFR L858R)
KATDFGRAT

SEQ ID NO: 5385 - protein, 9 aa, Artificial Sequence
  Description of Artificial Sequence: Synthetic peptide
  Seed: KITDFGRAK (EGFR L858R)
KATDFGRAV

SEQ ID NO: 5386 - protein, 9 aa, Artificial Sequence
  Description of Artificial Sequence: Synthetic peptide
  Seed: KITDFGRAK (EGFR L858R)
KATDFGRAW

SEQ ID NO: 5387 - protein, 9 aa, Artificial Sequence
  Description of Artificial Sequence: Synthetic peptide
  Seed: KITDFGRAK (EGFR L858R)
KATDFGRAY

SEQ ID NO: 5388 - protein, 9 aa, Artificial Sequence
  Description of Artificial Sequence: Synthetic peptide
  Seed: KITDFGRAK (EGFR L858R)
KCTDFGRAF

SEQ ID NO: 5389 - protein, 9 aa, Artificial Sequence
  Description of Artificial Sequence: Synthetic peptide
  Seed: KITDFGRAK (EGFR L858R)
KCTDFGRAI

SEQ ID NO: 5390 - protein, 10 aa, Artificial Sequence
  Description of Artificial Sequence: Synthetic peptide
  Seed: KITDFGRAKL (EGFR L858R)
KCTDFGRAKW

SEQ ID NO: 5391 - protein, 10 aa, Artificial Sequence
  Description of Artificial Sequence: Synthetic peptide
  Seed: KITDFGRAKL (EGFR L858R)
KCTDFGRAKY

SEQ ID NO: 5392 - protein, 9 aa, Artificial Sequence
  Description of Artificial Sequence: Synthetic peptide
  Seed: KITDFGRAK (EGFR L858R)
KCTDFGRAL

SEQ ID NO: 5393 - protein, 9 aa, Artificial Sequence
  Description of Artificial Sequence: Synthetic peptide
  Seed: KITDFGRAK (EGFR L858R)
KCTDFGRAM

SEQ ID NO: 5394 - protein, 9 aa, Artificial Sequence
  Description of Artificial Sequence: Synthetic peptide
  Seed: KITDFGRAK (EGFR L858R)
KCTDFGRAV

SEQ ID NO: 5395 - protein, 9 aa, Artificial Sequence
  Description of Artificial Sequence: Synthetic peptide
  Seed: KITDFGRAK (EGFR L858R)
KCTDFGRAW

SEQ ID NO: 5396 - protein, 9 aa, Artificial Sequence
  Description of Artificial Sequence: Synthetic peptide
  Seed: KITDFGRAK (EGFR L858R)
KCTDFGRAY

SEQ ID NO: 5397 - protein, 9 aa, Artificial Sequence
  Description of Artificial Sequence: Synthetic peptide
  Seed: KITDFGRAK (EGFR L858R)
KDTDFGRAF

SEQ ID NO: 5398 - protein, 9 aa, Artificial Sequence
  Description of Artificial Sequence: Synthetic peptide
  Seed: KITDFGRAK (EGFR L858R)
KDTDFGRAK

SEQ ID NO: 5399 - protein, 9 aa, Artificial Sequence
  Description of Artificial Sequence: Synthetic peptide
  Seed: KITDFGRAK (EGFR L858R)
KDTDFGRAR

SEQ ID NO: 5400 - protein, 9 aa, Artificial Sequence
  Description of Artificial Sequence: Synthetic peptide
  Seed: KITDFGRAK (EGFR L858R)
KDTDFGRAY

SEQ ID NO: 5401 - protein, 10 aa, Artificial Sequence
  Description of Artificial Sequence: Synthetic peptide
  Seed: KITDFGRAKL (EGFR L858R)
KETDFGRAKF

SEQ ID NO: 5402 - protein, 10 aa, Artificial Sequence
  Description of Artificial Sequence: Synthetic peptide
  Seed: KITDFGRAKL (EGFR L858R)
KETDFGRAKI

SEQ ID NO: 5403 - protein, 10 aa, Artificial Sequence
  Description of Artificial Sequence: Synthetic peptide
  Seed: KITDFGRAKL (EGFR L858R)
KETDFGRAKL

SEQ ID NO: 5404 - protein, 10 aa, Artificial Sequence
  Description of Artificial Sequence: Synthetic peptide
  Seed: KITDFGRAKL (EGFR L858R)
KETDFGRAKR

SEQ ID NO: 5405 - protein, 10 aa, Artificial Sequence
  Description of Artificial Sequence: Synthetic peptide
  Seed: KITDFGRAKL (EGFR L858R)
KETDFGRAKV

SEQ ID NO: 5406 - protein, 10 aa, Artificial Sequence
  Description of Artificial Sequence: Synthetic peptide
  Seed: KITDFGRAKL (EGFR L858R)
KETDFGRAKW

SEQ ID NO: 5407 - protein, 10 aa, Artificial Sequence
  Description of Artificial Sequence: Synthetic peptide
  Seed: KITDFGRAKL (EGFR L858R)
KETDFGRAKY

SEQ ID NO: 5408 - protein, 9 aa, Artificial Sequence
  Description of Artificial Sequence: Synthetic peptide
  Seed: KITDFGRAK (EGFR L858R)
KETDFGRAY

SEQ ID NO: 5409 - protein, 9 aa, Artificial Sequence
  Description of Artificial Sequence: Synthetic peptide
  Seed: KITDFGRAK (EGFR L858R)
KFTDFGRAF

SEQ ID NO: 5410 - protein, 9 aa, Artificial Sequence
  Description of Artificial Sequence: Synthetic peptide
  Seed: KITDFGRAK (EGFR L858R)
KFTDFGRAI

SEQ ID NO: 5411 - protein, 10 aa, Artificial Sequence
  Description of Artificial Sequence: Synthetic peptide
  Seed: KITDFGRAKL (EGFR L858R)
KFTDFGRAKK

SEQ ID NO: 5412 - protein, 10 aa, Artificial Sequence
  Description of Artificial Sequence: Synthetic peptide
  Seed: KITDFGRAKL (EGFR L858R)
KFTDFGRAKR

SEQ ID NO: 5413 - protein, 10 aa, Artificial Sequence
  Description of Artificial Sequence: Synthetic peptide
  Seed: KITDFGRAKL (EGFR L858R)
KFTDFGRAKW

SEQ ID NO: 5414 - protein, 9 aa, Artificial Sequence
  Description of Artificial Sequence: Synthetic peptide
  Seed: KITDFGRAK (EGFR L858R)
KFTDFGRAL

SEQ ID NO: 5415 - protein, 9 aa, Artificial Sequence
  Description of Artificial Sequence: Synthetic peptide
  Seed: KITDFGRAK (EGFR L858R)
KFTDFGRAM

SEQ ID NO: 5416 - protein, 9 aa, Artificial Sequence
  Description of Artificial Sequence: Synthetic peptide
  Seed: KITDFGRAK (EGFR L858R)
KFTDFGRAV

SEQ ID NO: 5417 - protein, 9 aa, Artificial Sequence
  Description of Artificial Sequence: Synthetic peptide
  Seed: KITDFGRAK (EGFR L858R)
KFTDFGRAW

SEQ ID NO: 5418 - protein, 9 aa, Artificial Sequence
  Description of Artificial Sequence: Synthetic peptide
  Seed: KITDFGRAK (EGFR L858R)
KFTDFGRAY

SEQ ID NO: 5419 - protein, 9 aa, Artificial Sequence
  Description of Artificial Sequence: Synthetic peptide
  Seed: KITDFGRAK (EGFR L858R)
KGTDFGRAF

SEQ ID NO: 5420 - protein, 9 aa, Artificial Sequence
  Description of Artificial Sequence: Synthetic peptide
  Seed: KITDFGRAK (EGFR L858R)
KGTDFGRAI

SEQ ID NO: 5421 - protein, 10 aa, Artificial Sequence
  Description of Artificial Sequence: Synthetic peptide
  Seed: KITDFGRAKL (EGFR L858R)
KGTDFGRAKF

SEQ ID NO: 5422 - protein, 10 aa, Artificial Sequence
  Description of Artificial Sequence: Synthetic peptide
  Seed: KITDFGRAKL (EGFR L858R)
KGTDFGRAKK

SEQ ID NO: 5423 - protein, 10 aa, Artificial Sequence
  Description of Artificial Sequence: Synthetic peptide
  Seed: KITDFGRAKL (EGFR L858R)
KGTDFGRAKR

SEQ ID NO: 5424 - protein, 10 aa, Artificial Sequence
  Description of Artificial Sequence: Synthetic peptide
  Seed: KITDFGRAKL (EGFR L858R)
KGTDFGRAKW

SEQ ID NO: 5425 - protein, 10 aa, Artificial Sequence
  Description of Artificial Sequence: Synthetic peptide
  Seed: KITDFGRAKL (EGFR L858R)
KGTDFGRAKY

SEQ ID NO: 5426 - protein, 9 aa, Artificial Sequence
  Description of Artificial Sequence: Synthetic peptide
  Seed: KITDFGRAK (EGFR L858R)
KGTDFGRAL

SEQ ID NO: 5427 - protein, 9 aa, Artificial Sequence
  Description of Artificial Sequence: Synthetic peptide
  Seed: KITDFGRAK (EGFR L858R)
KGTDFGRAM

SEQ ID NO: 5428 - protein, 9 aa, Artificial Sequence
  Description of Artificial Sequence: Synthetic peptide
  Seed: KITDFGRAK (EGFR L858R)
KGTDFGRAV

SEQ ID NO: 5429 - protein, 9 aa, Artificial Sequence
  Description of Artificial Sequence: Synthetic peptide
  Seed: KITDFGRAK (EGFR L858R)
KGTDFGRAW

SEQ ID NO: 5430 - protein, 9 aa, Artificial Sequence
  Description of Artificial Sequence: Synthetic peptide
  Seed: KITDFGRAK (EGFR L858R)
KGTDFGRAY

SEQ ID NO: 5431 - protein, 9 aa, Artificial Sequence
  Description of Artificial Sequence: Synthetic peptide
  Seed: KITDFGRAK (EGFR L858R)
KITDFGRAF

SEQ ID NO: 5432 - protein, 9 aa, Artificial Sequence
  Description of Artificial Sequence: Synthetic peptide
  Seed: KITDFGRAK (EGFR L858R)
KITDFGRAI

SEQ ID NO: 5433 - protein, 10 aa, Artificial Sequence
  Description of Artificial Sequence: Synthetic peptide
  Seed: KITDFGRAKL (EGFR L858R)
KITDFGRAKA

SEQ ID NO: 5434 - protein, 10 aa, Artificial Sequence
  Description of Artificial Sequence: Synthetic peptide
  Seed: KITDFGRAKL (EGFR L858R)
KITDFGRAKF

SEQ ID NO: 5435 - protein, 10 aa, Artificial Sequence
  Description of Artificial Sequence: Synthetic peptide
  Seed: KITDFGRAKL (EGFR L858R)
KITDFGRAKI

SEQ ID NO: 5436 - protein, 10 aa, Artificial Sequence
  Description of Artificial Sequence: Synthetic peptide
  Seed: KITDFGRAKL (EGFR L858R)
KITDFGRAKK

SEQ ID NO: 5437 - protein, 10 aa, Artificial Sequence
  Description of Artificial Sequence: Synthetic peptide
  Seed: KITDFGRAKL (EGFR L858R)
KITDFGRAKM

SEQ ID NO: 5438 - protein, 10 aa, Artificial Sequence
  Description of Artificial Sequence: Synthetic peptide
  Seed: KITDFGRAKL (EGFR L858R)
KITDFGRAKR

SEQ ID NO: 5439 - protein, 10 aa, Artificial Sequence
  Description of Artificial Sequence: Synthetic peptide
  Seed: KITDFGRAKL (EGFR L858R)
KITDFGRAKV

SEQ ID NO: 5440 - protein, 10 aa, Artificial Sequence
  Description of Artificial Sequence: Synthetic peptide
  Seed: KITDFGRAKL (EGFR L858R)
KITDFGRAKW

SEQ ID NO: 5441 - protein, 10 aa, Artificial Sequence
  Description of Artificial Sequence: Synthetic peptide
  Seed: KITDFGRAKL (EGFR L858R)
KITDFGRAKY

SEQ ID NO: 5442 - protein, 9 aa, Artificial Sequence
  Description of Artificial Sequence: Synthetic peptide
  Seed: KITDFGRAK (EGFR L858R)
KITDFGRAL

SEQ ID NO: 5443 - protein, 9 aa, Artificial Sequence
  Description of Artificial Sequence: Synthetic peptide
  Seed: KITDFGRAK (EGFR L858R)
KITDFGRAM

SEQ ID NO: 5444 - protein, 9 aa, Artificial Sequence
  Description of Artificial Sequence: Synthetic peptide
  Seed: KITDFGRAK (EGFR L858R)
KITDFGRAV

SEQ ID NO: 5445 - protein, 9 aa, Artificial Sequence
  Description of Artificial Sequence: Synthetic peptide
  Seed: KITDFGRAK (EGFR L858R)
KITDFGRAW

SEQ ID NO: 5446 - protein, 9 aa, Artificial Sequence
  Description of Artificial Sequence: Synthetic peptide
  Seed: KITDFGRAK (EGFR L858R)
KITDFGRAY

SEQ ID NO: 5447 - protein, 10 aa, Artificial Sequence
  Description of Artificial Sequence: Synthetic peptide
  Seed: KITDFGRAKL (EGFR L858R)
KKTDFGRAKW

SEQ ID NO: 5448 - protein, 9 aa, Artificial Sequence
  Description of Artificial Sequence: Synthetic peptide
  Seed: KITDFGRAK (EGFR L858R)
KLTDFGRAF

SEQ ID NO: 5449 - protein, 9 aa, Artificial Sequence
  Description of Artificial Sequence: Synthetic peptide
  Seed: KITDFGRAK (EGFR L858R)
KLTDFGRAH

SEQ ID NO: 5450 - protein, 9 aa, Artificial Sequence
  Description of Artificial Sequence: Synthetic peptide
  Seed: KITDFGRAK (EGFR L858R)
KLTDFGRAI

SEQ ID NO: 5451 - protein, 10 aa, Artificial Sequence
  Description of Artificial Sequence: Synthetic peptide
  Seed: KITDFGRAKL (EGFR L858R)
KLTDFGRAKA

SEQ ID NO: 5452 - protein, 10 aa, Artificial Sequence
  Description of Artificial Sequence: Synthetic peptide
  Seed: KITDFGRAKL (EGFR L858R)
KLTDFGRAKF

SEQ ID NO: 5453 - protein, 10 aa, Artificial Sequence
  Description of Artificial Sequence: Synthetic peptide
  Seed: KITDFGRAKL (EGFR L858R)
KLTDFGRAKI

SEQ ID NO: 5454 - protein, 10 aa, Artificial Sequence
  Description of Artificial Sequence: Synthetic peptide
  Seed: KITDFGRAKL (EGFR L858R)
KLTDFGRAKK

SEQ ID NO: 5455 - protein, 10 aa, Artificial Sequence
  Description of Artificial Sequence: Synthetic peptide
  Seed: KITDFGRAKL (EGFR L858R)
KLTDFGRAKL

SEQ ID NO: 5456 - protein, 10 aa, Artificial Sequence
  Description of Artificial Sequence: Synthetic peptide
  Seed: KITDFGRAKL (EGFR L858R)
KLTDFGRAKM

SEQ ID NO: 5457 - protein, 10 aa, Artificial Sequence
  Description of Artificial Sequence: Synthetic peptide
  Seed: KITDFGRAKL (EGFR L858R)
KLTDFGRAKR

SEQ ID NO: 5458 - protein, 10 aa, Artificial Sequence
  Description of Artificial Sequence: Synthetic peptide
  Seed: KITDFGRAKL (EGFR L858R)
KLTDFGRAKW

SEQ ID NO: 5459 - protein, 10 aa, Artificial Sequence
  Description of Artificial Sequence: Synthetic peptide
  Seed: KITDFGRAKL (EGFR L858R)
KLTDFGRAKY

SEQ ID NO: 5460 - protein, 9 aa, Artificial Sequence
  Description of Artificial Sequence: Synthetic peptide
  Seed: KITDFGRAK (EGFR L858R)
KLTDFGRAL

SEQ ID NO: 5461 - protein, 9 aa, Artificial Sequence
  Description of Artificial Sequence: Synthetic peptide
  Seed: KITDFGRAK (EGFR L858R)
KLTDFGRAM

SEQ ID NO: 5462 - protein, 9 aa, Artificial Sequence
  Description of Artificial Sequence: Synthetic peptide
  Seed: KITDFGRAK (EGFR L858R)
KLTDFGRAV

SEQ ID NO: 5463 - protein, 9 aa, Artificial Sequence
  Description of Artificial Sequence: Synthetic peptide
  Seed: KITDFGRAK (EGFR L858R)
KLTDFGRAW

SEQ ID NO: 5464 - protein, 9 aa, Artificial Sequence
  Description of Artificial Sequence: Synthetic peptide
  Seed: KITDFGRAK (EGFR L858R)
KLTDFGRAY

SEQ ID NO: 5465 - protein, 9 aa, Artificial Sequence
  Description of Artificial Sequence: Synthetic peptide
  Seed: KITDFGRAK (EGFR L858R)
KMTDFGRAF

SEQ ID NO: 5466 - protein, 9 aa, Artificial Sequence
  Description of Artificial Sequence: Synthetic peptide
  Seed: KITDFGRAK (EGFR L858R)
KMTDFGRAH

SEQ ID NO: 5467 - protein, 9 aa, Artificial Sequence
  Description of Artificial Sequence: Synthetic peptide
  Seed: KITDFGRAK (EGFR L858R)
KMTDFGRAI

SEQ ID NO: 5468 - protein, 10 aa, Artificial Sequence
  Description of Artificial Sequence: Synthetic peptide
  Seed: KITDFGRAKL (EGFR L858R)
KMTDFGRAKA

SEQ ID NO: 5469 - protein, 10 aa, Artificial Sequence
  Description of Artificial Sequence: Synthetic peptide
  Seed: KITDFGRAKL (EGFR L858R)
KMTDFGRAKF

SEQ ID NO: 5470 - protein, 10 aa, Artificial Sequence
  Description of Artificial Sequence: Synthetic peptide
  Seed: KITDFGRAKL (EGFR L858R)
KMTDFGRAKI

SEQ ID NO: 5471 - protein, 10 aa, Artificial Sequence
  Description of Artificial Sequence: Synthetic peptide
  Seed: KITDFGRAKL (EGFR L858R)
KMTDFGRAKK

SEQ ID NO: 5472 - protein, 10 aa, Artificial Sequence
  Description of Artificial Sequence: Synthetic peptide
  Seed: KITDFGRAKL (EGFR L858R)
KMTDFGRAKL

SEQ ID NO: 5473 - protein, 10 aa, Artificial Sequence
  Description of Artificial Sequence: Synthetic peptide
  Seed: KITDFGRAKL (EGFR L858R)
KMTDFGRAKM

SEQ ID NO: 5474 - protein, 10 aa, Artificial Sequence
  Description of Artificial Sequence: Synthetic peptide
  Seed: KITDFGRAKL (EGFR L858R)
KMTDFGRAKR

SEQ ID NO: 5475 - protein, 10 aa, Artificial Sequence
  Description of Artificial Sequence: Synthetic peptide
  Seed: KITDFGRAKL (EGFR L858R)
KMTDFGRAKV

SEQ ID NO: 5476 - protein, 10 aa, Artificial Sequence
  Description of Artificial Sequence: Synthetic peptide
  Seed: KITDFGRAKL (EGFR L858R)
KMTDFGRAKW

SEQ ID NO: 5477 - protein, 10 aa, Artificial Sequence
  Description of Artificial Sequence: Synthetic peptide
  Seed: KITDFGRAKL (EGFR L858R)
KMTDFGRAKY

SEQ ID NO: 5478 - protein, 9 aa, Artificial Sequence
  Description of Artificial Sequence: Synthetic peptide
  Seed: KITDFGRAK (EGFR L858R)
KMTDFGRAL

SEQ ID NO: 5479 - protein, 9 aa, Artificial Sequence
  Description of Artificial Sequence: Synthetic peptide
  Seed: KITDFGRAK (EGFR L858R)
KMTDFGRAM

SEQ ID NO: 5480 - protein, 9 aa, Artificial Sequence
  Description of Artificial Sequence: Synthetic peptide
  Seed: KITDFGRAK (EGFR L858R)
KMTDFGRAV

SEQ ID NO: 5481 - protein, 9 aa, Artificial Sequence
  Description of Artificial Sequence: Synthetic peptide
  Seed: KITDFGRAK (EGFR L858R)
KMTDFGRAW

SEQ ID NO: 5482 - protein, 9 aa, Artificial Sequence
  Description of Artificial Sequence: Synthetic peptide
  Seed: KITDFGRAK (EGFR L858R)
KMTDFGRAY

SEQ ID NO: 5483 - protein, 9 aa, Artificial Sequence
  Description of Artificial Sequence: Synthetic peptide
  Seed: KITDFGRAK (EGFR L858R)
KNTDFGRAF

SEQ ID NO: 5484 - protein, 9 aa, Artificial Sequence
  Description of Artificial Sequence: Synthetic peptide
  Seed: KITDFGRAK (EGFR L858R)
KNTDFGRAI

SEQ ID NO: 5485 - protein, 9 aa, Artificial Sequence
  Description of Artificial Sequence: Synthetic peptide
  Seed: KITDFGRAK (EGFR L858R)
KNTDFGRAK

SEQ ID NO: 5486 - protein, 10 aa, Artificial Sequence
  Description of Artificial Sequence: Synthetic peptide
  Seed: KITDFGRAKL (EGFR L858R)
KNTDFGRAKK

SEQ ID NO: 5487 - protein, 10 aa, Artificial Sequence
  Description of Artificial Sequence: Synthetic peptide
  Seed: KITDFGRAKL (EGFR L858R)
KNTDFGRAKR

SEQ ID NO: 5488 - protein, 10 aa, Artificial Sequence
  Description of Artificial Sequence: Synthetic peptide
  Seed: KITDFGRAKL (EGFR L858R)
KNTDFGRAKW

SEQ ID NO: 5489 - protein, 10 aa, Artificial Sequence
  Description of Artificial Sequence: Synthetic peptide
  Seed: KITDFGRAKL (EGFR L858R)
KNTDFGRAKY

SEQ ID NO: 5490 - protein, 9 aa, Artificial Sequence
  Description of Artificial Sequence: Synthetic peptide
  Seed: KITDFGRAK (EGFR L858R)
KNTDFGRAL

SEQ ID NO: 5491 - protein, 9 aa, Artificial Sequence
  Description of Artificial Sequence: Synthetic peptide
  Seed: KITDFGRAK (EGFR L858R)
KNTDFGRAM

SEQ ID NO: 5492 - protein, 9 aa, Artificial Sequence
  Description of Artificial Sequence: Synthetic peptide
  Seed: KITDFGRAK (EGFR L858R)
KNTDFGRAV

SEQ ID NO: 5493 - protein, 9 aa, Artificial Sequence
  Description of Artificial Sequence: Synthetic peptide
  Seed: KITDFGRAK (EGFR L858R)
KNTDFGRAY

SEQ ID NO: 5494 - protein, 9 aa, Artificial Sequence
  Description of Artificial Sequence: Synthetic peptide
  Seed: KITDFGRAK (EGFR L858R)
KPTDFGRAF

SEQ ID NO: 5495 - protein, 9 aa, Artificial Sequence
  Description of Artificial Sequence: Synthetic peptide
  Seed: KITDFGRAK (EGFR L858R)
KPTDFGRAK

SEQ ID NO: 5496 - protein, 9 aa, Artificial Sequence
  Description of Artificial Sequence: Synthetic peptide
  Seed: KITDFGRAK (EGFR L858R)
KPTDFGRAL

SEQ ID NO: 5497 - protein, 9 aa, Artificial Sequence
  Description of Artificial Sequence: Synthetic peptide
  Seed: KITDFGRAK (EGFR L858R)
KPTDFGRAM

SEQ ID NO: 5498 - protein, 9 aa, Artificial Sequence
  Description of Artificial Sequence: Synthetic peptide
  Seed: KITDFGRAK (EGFR L858R)
KPTDFGRAR

SEQ ID NO: 5499 - protein, 9 aa, Artificial Sequence
  Description of Artificial Sequence: Synthetic peptide
  Seed: KITDFGRAK (EGFR L858R)
KPTDFGRAY

SEQ ID NO: 5500 - protein, 9 aa, Artificial Sequence
  Description of Artificial Sequence: Synthetic peptide
  Seed: KITDFGRAK (EGFR L858R)
KQTDFGRAF

SEQ ID NO: 5501 - protein, 9 aa, Artificial Sequence
  Description of Artificial Sequence: Synthetic peptide
  Seed: KITDFGRAK (EGFR L858R)
KQTDFGRAI

SEQ ID NO: 5502 - protein, 10 aa, Artificial Sequence
  Description of Artificial Sequence: Synthetic peptide
  Seed: KITDFGRAKL (EGFR L858R)
KQTDFGRAKA

SEQ ID NO: 5503 - protein, 10 aa, Artificial Sequence
  Description of Artificial Sequence: Synthetic peptide
  Seed: KITDFGRAKL (EGFR L858R)
KQTDFGRAKC

SEQ ID NO: 5504 - protein, 10 aa, Artificial Sequence
  Description of Artificial Sequence: Synthetic peptide
  Seed: KITDFGRAKL (EGFR L858R)
KQTDFGRAKF

SEQ ID NO: 5505 - protein, 10 aa, Artificial Sequence
  Description of Artificial Sequence: Synthetic peptide
  Seed: KITDFGRAKL (EGFR L858R)
KQTDFGRAKI

SEQ ID NO: 5506 - protein, 10 aa, Artificial Sequence
  Description of Artificial Sequence: Synthetic peptide
  Seed: KITDFGRAKL (EGFR L858R)
KQTDFGRAKK

SEQ ID NO: 5507 - protein, 10 aa, Artificial Sequence
  Description of Artificial Sequence: Synthetic peptide
  Seed: KITDFGRAKL (EGFR L858R)
KQTDFGRAKL

SEQ ID NO: 5508 - protein, 10 aa, Artificial Sequence
  Description of Artificial Sequence: Synthetic peptide
  Seed: KITDFGRAKL (EGFR L858R)
KQTDFGRAKM

SEQ ID NO: 5509 - protein, 10 aa, Artificial Sequence
  Description of Artificial Sequence: Synthetic peptide
  Seed: KITDFGRAKL (EGFR L858R)
KQTDFGRAKR

SEQ ID NO: 5510 - protein, 10 aa, Artificial Sequence
  Description of Artificial Sequence: Synthetic peptide
  Seed: KITDFGRAKL (EGFR L858R)
KQTDFGRAKV

SEQ ID NO: 5511 - protein, 10 aa, Artificial Sequence
  Description of Artificial Sequence: Synthetic peptide
  Seed: KITDFGRAKL (EGFR L858R)
KQTDFGRAKW

SEQ ID NO: 5512 - protein, 10 aa, Artificial Sequence
  Description of Artificial Sequence: Synthetic peptide
  Seed: KITDFGRAKL (EGFR L858R)
KQTDFGRAKY

SEQ ID NO: 5513 - protein, 9 aa, Artificial Sequence
  Description of Artificial Sequence: Synthetic peptide
  Seed: KITDFGRAK (EGFR L858R)
KQTDFGRAL

SEQ ID NO: 5514 - protein, 9 aa, Artificial Sequence
  Description of Artificial Sequence: Synthetic peptide
  Seed: KITDFGRAK (EGFR L858R)
KQTDFGRAM

SEQ ID NO: 5515 - protein, 9 aa, Artificial Sequence
  Description of Artificial Sequence: Synthetic peptide
  Seed: KITDFGRAK (EGFR L858R)
KQTDFGRAV

SEQ ID NO: 5516 - protein, 9 aa, Artificial Sequence
  Description of Artificial Sequence: Synthetic peptide
  Seed: KITDFGRAK (EGFR L858R)
KQTDFGRAW

SEQ ID NO: 5517 - protein, 9 aa, Artificial Sequence
  Description of Artificial Sequence: Synthetic peptide
  Seed: KITDFGRAK (EGFR L858R)
KQTDFGRAY

SEQ ID NO: 5518 - protein, 9 aa, Artificial Sequence
  Description of Artificial Sequence: Synthetic peptide
  Seed: KITDFGRAK (EGFR L858R)
KSTDFGRAC

SEQ ID NO: 5519 - protein, 9 aa, Artificial Sequence
  Description of Artificial Sequence: Synthetic peptide
  Seed: KITDFGRAK (EGFR L858R)
KSTDFGRAF

SEQ ID NO: 5520 - protein, 9 aa, Artificial Sequence
  Description of Artificial Sequence: Synthetic peptide
  Seed: KITDFGRAK (EGFR L858R)
KSTDFGRAH

SEQ ID NO: 5521 - protein, 9 aa, Artificial Sequence
  Description of Artificial Sequence: Synthetic peptide
  Seed: KITDFGRAK (EGFR L858R)
KSTDFGRAI

SEQ ID NO: 5522 - protein, 10 aa, Artificial Sequence
  Description of Artificial Sequence: Synthetic peptide
  Seed: KITDFGRAKL (EGFR L858R)
KSTDFGRAKF

SEQ ID NO: 5523 - protein, 10 aa, Artificial Sequence
  Description of Artificial Sequence: Synthetic peptide
  Seed: KITDFGRAKL (EGFR L858R)
KSTDFGRAKI

SEQ ID NO: 5524 - protein, 10 aa, Artificial Sequence
  Description of Artificial Sequence: Synthetic peptide
  Seed: KITDFGRAKL (EGFR L858R)
KSTDFGRAKK

SEQ ID NO: 5525 - protein, 10 aa, Artificial Sequence
  Description of Artificial Sequence: Synthetic peptide
  Seed: KITDFGRAKL (EGFR L858R)
KSTDFGRAKL

SEQ ID NO: 5526 - protein, 10 aa, Artificial Sequence
  Description of Artificial Sequence: Synthetic peptide
  Seed: KITDFGRAKL (EGFR L858R)
KSTDFGRAKM

SEQ ID NO: 5527 - protein, 10 aa, Artificial Sequence
  Description of Artificial Sequence: Synthetic peptide
  Seed: KITDFGRAKL (EGFR L858R)
KSTDFGRAKR

SEQ ID NO: 5528 - protein, 10 aa, Artificial Sequence
  Description of Artificial Sequence: Synthetic peptide
  Seed: KITDFGRAKL (EGFR L858R)
KSTDFGRAKV

SEQ ID NO: 5529 - protein, 10 aa, Artificial Sequence
  Description of Artificial Sequence: Synthetic peptide
  Seed: KITDFGRAKL (EGFR L858R)
KSTDFGRAKW

SEQ ID NO: 5530 - protein, 10 aa, Artificial Sequence
  Description of Artificial Sequence: Synthetic peptide
  Seed: KITDFGRAKL (EGFR L858R)
KSTDFGRAKY

SEQ ID NO: 5531 - protein, 9 aa, Artificial Sequence
  Description of Artificial Sequence: Synthetic peptide
  Seed: KITDFGRAK (EGFR L858R)
KSTDFGRAL

SEQ ID NO: 5532 - protein, 9 aa, Artificial Sequence
  Description of Artificial Sequence: Synthetic peptide
  Seed: KITDFGRAK (EGFR L858R)
KSTDFGRAM

SEQ ID NO: 5533 - protein, 9 aa, Artificial Sequence
  Description of Artificial Sequence: Synthetic peptide
  Seed: KITDFGRAK (EGFR L858R)
KSTDFGRAW

SEQ ID NO: 5534 - protein, 9 aa, Artificial Sequence
  Description of Artificial Sequence: Synthetic peptide
  Seed: KITDFGRAK (EGFR L858R)
KSTDFGRAY

SEQ ID NO: 5535 - protein, 9 aa, Artificial Sequence
  Description of Artificial Sequence: Synthetic peptide
  Seed: KITDFGRAK (EGFR L858R)
KTTDFGRAC

SEQ ID NO: 5536 - protein, 9 aa, Artificial Sequence
  Description of Artificial Sequence: Synthetic peptide
  Seed: KITDFGRAK (EGFR L858R)
KTTDFGRAF

SEQ ID NO: 5537 - protein, 9 aa, Artificial Sequence
  Description of Artificial Sequence: Synthetic peptide
  Seed: KITDFGRAK (EGFR L858R)
KTTDFGRAH

SEQ ID NO: 5538 - protein, 10 aa, Artificial Sequence
  Description of Artificial Sequence: Synthetic peptide
  Seed: KITDFGRAKL (EGFR L858R)
KTTDFGRAKF

SEQ ID NO: 5539 - protein, 10 aa, Artificial Sequence
  Description of Artificial Sequence: Synthetic peptide
  Seed: KITDFGRAKL (EGFR L858R)
KTTDFGRAKI

SEQ ID NO: 5540 - protein, 10 aa, Artificial Sequence
  Description of Artificial Sequence: Synthetic peptide
  Seed: KITDFGRAKL (EGFR L858R)
KTTDFGRAKK

SEQ ID NO: 5541 - protein, 10 aa, Artificial Sequence
  Description of Artificial Sequence: Synthetic peptide
  Seed: KITDFGRAKL (EGFR L858R)
KTTDFGRAKL

SEQ ID NO: 5542 - protein, 10 aa, Artificial Sequence
  Description of Artificial Sequence: Synthetic peptide
  Seed: KITDFGRAKL (EGFR L858R)
KTTDFGRAKM

SEQ ID NO: 5543 - protein, 10 aa, Artificial Sequence
  Description of Artificial Sequence: Synthetic peptide
  Seed: KITDFGRAKL (EGFR L858R)
KTTDFGRAKR

SEQ ID NO: 5544 - protein, 10 aa, Artificial Sequence
  Description of Artificial Sequence: Synthetic peptide
  Seed: KITDFGRAKL (EGFR L858R)
KTTDFGRAKV

SEQ ID NO: 5545 - protein, 10 aa, Artificial Sequence
  Description of Artificial Sequence: Synthetic peptide
  Seed: KITDFGRAKL (EGFR L858R)
KTTDFGRAKW

SEQ ID NO: 5546 - protein, 10 aa, Artificial Sequence
  Description of Artificial Sequence: Synthetic peptide
  Seed: KITDFGRAKL (EGFR L858R)
KTTDFGRAKY

SEQ ID NO: 5547 - protein, 9 aa, Artificial Sequence
  Description of Artificial Sequence: Synthetic peptide
  Seed: KITDFGRAK (EGFR L858R)
KTTDFGRAL

SEQ ID NO: 5548 - protein, 9 aa, Artificial Sequence
  Description of Artificial Sequence: Synthetic peptide
  Seed: KITDFGRAK (EGFR L858R)
KTTDFGRAM

SEQ ID NO: 5549 - protein, 9 aa, Artificial Sequence
  Description of Artificial Sequence: Synthetic peptide
  Seed: KITDFGRAK (EGFR L858R)
KTTDFGRAW

SEQ ID NO: 5550 - protein, 9 aa, Artificial Sequence
  Description of Artificial Sequence: Synthetic peptide
  Seed: KITDFGRAK (EGFR L858R)
KTTDFGRAY

SEQ ID NO: 5551 - protein, 9 aa, Artificial Sequence
  Description of Artificial Sequence: Synthetic peptide
  Seed: KITDFGRAK (EGFR L858R)
KVTDFGRAF

SEQ ID NO: 5552 - protein, 9 aa, Artificial Sequence
  Description of Artificial Sequence: Synthetic peptide
  Seed: KITDFGRAK (EGFR L858R)
KVTDFGRAH

SEQ ID NO: 5553 - protein, 9 aa, Artificial Sequence
  Description of Artificial Sequence: Synthetic peptide
  Seed: KITDFGRAK (EGFR L858R)
KVTDFGRAI

SEQ ID NO: 5554 - protein, 10 aa, Artificial Sequence
  Description of Artificial Sequence: Synthetic peptide
  Seed: KITDFGRAKL (EGFR L858R)
KVTDFGRAKA

SEQ ID NO: 5555 - protein, 10 aa, Artificial Sequence
  Description of Artificial Sequence: Synthetic peptide
  Seed: KITDFGRAKL (EGFR L858R)
KVTDFGRAKF

SEQ ID NO: 5556 - protein, 10 aa, Artificial Sequence
  Description of Artificial Sequence: Synthetic peptide
  Seed: KITDFGRAKL (EGFR L858R)
KVTDFGRAKI

SEQ ID NO: 5557 - protein, 10 aa, Artificial Sequence
  Description of Artificial Sequence: Synthetic peptide
  Seed: KITDFGRAKL (EGFR L858R)
KVTDFGRAKK

SEQ ID NO: 5558 - protein, 10 aa, Artificial Sequence
  Description of Artificial Sequence: Synthetic peptide
  Seed: KITDFGRAKL (EGFR L858R)
KVTDFGRAKL

SEQ ID NO: 5559 - protein, 10 aa, Artificial Sequence
  Description of Artificial Sequence: Synthetic peptide
  Seed: KITDFGRAKL (EGFR L858R)
KVTDFGRAKM

SEQ ID NO: 5560 - protein, 10 aa, Artificial Sequence
  Description of Artificial Sequence: Synthetic peptide
  Seed: KITDFGRAKL (EGFR L858R)
KVTDFGRAKR

SEQ ID NO: 5561 - protein, 10 aa, Artificial Sequence
  Description of Artificial Sequence: Synthetic peptide
  Seed: KITDFGRAKL (EGFR L858R)
KVTDFGRAKV

SEQ ID NO: 5562 - protein, 10 aa, Artificial Sequence
  Description of Artificial Sequence: Synthetic peptide
  Seed: KITDFGRAKL (EGFR L858R)
KVTDFGRAKW

SEQ ID NO: 5563 - protein, 10 aa, Artificial Sequence
  Description of Artificial Sequence: Synthetic peptide
  Seed: KITDFGRAKL (EGFR L858R)
KVTDFGRAKY

SEQ ID NO: 5564 - protein, 9 aa, Artificial Sequence
  Description of Artificial Sequence: Synthetic peptide
  Seed: KITDFGRAK (EGFR L858R)
KVTDFGRAL

SEQ ID NO: 5565 - protein, 9 aa, Artificial Sequence
  Description of Artificial Sequence: Synthetic peptide
  Seed: KITDFGRAK (EGFR L858R)
KVTDFGRAM

SEQ ID NO: 5566 - protein, 9 aa, Artificial Sequence
  Description of Artificial Sequence: Synthetic peptide
  Seed: KITDFGRAK (EGFR L858R)
KVTDFGRAV

SEQ ID NO: 5567 - protein, 9 aa, Artificial Sequence
  Description of Artificial Sequence: Synthetic peptide
  Seed: KITDFGRAK (EGFR L858R)
KVTDFGRAW

SEQ ID NO: 5568 - protein, 9 aa, Artificial Sequence
  Description of Artificial Sequence: Synthetic peptide
  Seed: KITDFGRAK (EGFR L858R)
KVTDFGRAY

SEQ ID NO: 5569 - protein, 9 aa, Artificial Sequence
  Description of Artificial Sequence: Synthetic peptide
  Seed: KITDFGRAK (EGFR L858R)
KWTDFGRAF

SEQ ID NO: 5570 - protein, 10 aa, Artificial Sequence
  Description of Artificial Sequence: Synthetic peptide
  Seed: KITDFGRAKL (EGFR L858R)
KWTDFGRAKK

SEQ ID NO: 5571 - protein, 10 aa, Artificial Sequence
  Description of Artificial Sequence: Synthetic peptide
  Seed: KITDFGRAKL (EGFR L858R)
KWTDFGRAKR

SEQ ID NO: 5572 - protein, 10 aa, Artificial Sequence
  Description of Artificial Sequence: Synthetic peptide
  Seed: KITDFGRAKL (EGFR L858R)
KWTDFGRAKW

SEQ ID NO: 5573 - protein, 9 aa, Artificial Sequence
  Description of Artificial Sequence: Synthetic peptide
  Seed: KITDFGRAK (EGFR L858R)
KWTDFGRAL

SEQ ID NO: 5574 - protein, 9 aa, Artificial Sequence
  Description of Artificial Sequence: Synthetic peptide
  Seed: KITDFGRAK (EGFR L858R)
KWTDFGRAM

SEQ ID NO: 5575 - protein, 9 aa, Artificial Sequence
  Description of Artificial Sequence: Synthetic peptide
  Seed: KITDFGRAK (EGFR L858R)
KWTDFGRAY

SEQ ID NO: 5576 - protein, 9 aa, Artificial Sequence
  Description of Artificial Sequence: Synthetic peptide
  Seed: KITDFGRAK (EGFR L858R)
KYTDFGRAF

SEQ ID NO: 5577 - protein, 10 aa, Artificial Sequence
  Description of Artificial Sequence: Synthetic peptide
  Seed: KITDFGRAKL (EGFR L858R)
KYTDFGRAKK

SEQ ID NO: 5578 - protein, 10 aa, Artificial Sequence
  Description of Artificial Sequence: Synthetic peptide
  Seed: KITDFGRAKL (EGFR L858R)
KYTDFGRAKR

SEQ ID NO: 5579 - protein, 10 aa, Artificial Sequence
  Description of Artificial Sequence: Synthetic peptide
  Seed: KITDFGRAKL (EGFR L858R)
KYTDFGRAKW

SEQ ID NO: 5580 - protein, 9 aa, Artificial Sequence
  Description of Artificial Sequence: Synthetic peptide
  Seed: KITDFGRAK (EGFR L858R)
KYTDFGRAL

SEQ ID NO: 5581 - protein, 9 aa, Artificial Sequence
  Description of Artificial Sequence: Synthetic peptide
  Seed: KITDFGRAK (EGFR L858R)
KYTDFGRAM

SEQ ID NO: 5582 - protein, 9 aa, Artificial Sequence
  Description of Artificial Sequence: Synthetic peptide
  Seed: KITDFGRAK (EGFR L858R)
KYTDFGRAY

SEQ ID NO: 5583 - protein, 10 aa, Artificial Sequence
  Description of Artificial Sequence: Synthetic peptide
  Seed: RAKLLGAEEK (EGFR L858R)
RAKLLGAEER

SEQ ID NO: 5584 - protein, 10 aa, Artificial Sequence
  Description of Artificial Sequence: Synthetic peptide
  Seed: RAKLLGAEEK (EGFR L858R)
RIKLLGAEER

SEQ ID NO: 5585 - protein, 10 aa, Artificial Sequence
  Description of Artificial Sequence: Synthetic peptide
  Seed: RAKLLGAEEK (EGFR L858R)
RLKLLGAEER

SEQ ID NO: 5586 - protein, 10 aa, Artificial Sequence
  Description of Artificial Sequence: Synthetic peptide
  Seed: RAKLLGAEEK (EGFR L858R)
RMKLLGAEER

SEQ ID NO: 5587 - protein, 10 aa, Artificial Sequence
  Description of Artificial Sequence: Synthetic peptide
  Seed: RAKLLGAEEK (EGFR L858R)
RQKLLGAEER

SEQ ID NO: 5588 - protein, 10 aa, Artificial Sequence
  Description of Artificial Sequence: Synthetic peptide
  Seed: RAKLLGAEEK (EGFR L858R)
RVKLLGAEER

SEQ ID NO: 5589 - protein, 8 aa, Artificial Sequence
  Description of Artificial Sequence: Synthetic peptide
  Seed: TDFGRAKL (EGFR L858R)
TAFGRAKL

SEQ ID NO: 5590 - protein, 9 aa, Artificial Sequence
  Description of Artificial Sequence: Synthetic peptide
  Seed: TDFGRAKLL (EGFR L858R)
TAFGRAKLC

SEQ ID NO: 5591 - protein, 9 aa, Artificial Sequence
  Description of Artificial Sequence: Synthetic peptide
  Seed: TDFGRAKLL (EGFR L858R)
TAFGRAKLF

SEQ ID NO: 5592 - protein, 9 aa, Artificial Sequence
  Description of Artificial Sequence: Synthetic peptide
  Seed: TDFGRAKLL (EGFR L858R)
TAFGRAKLI

SEQ ID NO: 5593 - protein, 9 aa, Artificial Sequence
  Description of Artificial Sequence: Synthetic peptide
  Seed: TDFGRAKLL (EGFR L858R)
TAFGRAKLL

SEQ ID NO: 5594 - protein, 9 aa, Artificial Sequence
  Description of Artificial Sequence: Synthetic peptide
  Seed: TDFGRAKLL (EGFR L858R)
TAFGRAKLM

SEQ ID NO: 5595 - protein, 9 aa, Artificial Sequence
  Description of Artificial Sequence: Synthetic peptide
  Seed: TDFGRAKLL (EGFR L858R)
TAFGRAKLV

SEQ ID NO: 5596 - protein, 9 aa, Artificial Sequence
  Description of Artificial Sequence: Synthetic peptide
  Seed: TDFGRAKLL (EGFR L858R)
TCFGRAKLL

SEQ ID NO: 5597 - protein, 9 aa, Artificial Sequence
  Description of Artificial Sequence: Synthetic peptide
  Seed: TDFGRAKLL (EGFR L858R)
TCFGRAKLM

SEQ ID NO: 5598 - protein, 8 aa, Artificial Sequence
  Description of Artificial Sequence: Synthetic peptide
  Seed: TDFGRAKL (EGFR L858R)
TDFGRAKF

SEQ ID NO: 5599 - protein, 8 aa, Artificial Sequence
  Description of Artificial Sequence: Synthetic peptide
  Seed: TDFGRAKL (EGFR L858R)
TDFGRAKI

SEQ ID NO: 5600 - protein, 9 aa, Artificial Sequence
  Description of Artificial Sequence: Synthetic peptide
  Seed: TDFGRAKLL (EGFR L858R)
TDFGRAKLA

SEQ ID NO: 5601 - protein, 9 aa, Artificial Sequence
  Description of Artificial Sequence: Synthetic peptide
  Seed: TDFGRAKLL (EGFR L858R)
TDFGRAKLC

SEQ ID NO: 5602 - protein, 9 aa, Artificial Sequence
  Description of Artificial Sequence: Synthetic peptide
  Seed: TDFGRAKLL (EGFR L858R)
TDFGRAKLF

SEQ ID NO: 5603 - protein, 9 aa, Artificial Sequence
  Description of Artificial Sequence: Synthetic peptide
  Seed: TDFGRAKLL (EGFR L858R)
TDFGRAKLI

SEQ ID NO: 5604 - protein, 9 aa, Artificial Sequence
  Description of Artificial Sequence: Synthetic peptide
  Seed: TDFGRAKLL (EGFR L858R)
TDFGRAKLM

SEQ ID NO: 5605 - protein, 9 aa, Artificial Sequence
  Description of Artificial Sequence: Synthetic peptide
  Seed: TDFGRAKLL (EGFR L858R)
TDFGRAKLP

SEQ ID NO: 5606 - protein, 9 aa, Artificial Sequence
  Description of Artificial Sequence: Synthetic peptide
  Seed: TDFGRAKLL (EGFR L858R)
TDFGRAKLT

SEQ ID NO: 5607 - protein, 9 aa, Artificial Sequence
  Description of Artificial Sequence: Synthetic peptide
  Seed: TDFGRAKLL (EGFR L858R)
TDFGRAKLV

SEQ ID NO: 5608 - protein, 9 aa, Artificial Sequence
  Description of Artificial Sequence: Synthetic peptide
  Seed: TDFGRAKLL (EGFR L858R)
TDFGRAKLW

SEQ ID NO: 5609 - protein, 9 aa, Artificial Sequence
  Description of Artificial Sequence: Synthetic peptide
  Seed: TDFGRAKLL (EGFR L858R)
TDFGRAKLY

SEQ ID NO: 5610 - protein, 8 aa, Artificial Sequence
  Description of Artificial Sequence: Synthetic peptide
  Seed: TDFGRAKL (EGFR L858R)
TDFGRAKM

SEQ ID NO: 5611 - protein, 8 aa, Artificial Sequence
  Description of Artificial Sequence: Synthetic peptide
  Seed: TDFGRAKL (EGFR L858R)
TDFGRAKV

SEQ ID NO: 5612 - protein, 8 aa, Artificial Sequence
  Description of Artificial Sequence: Synthetic peptide
  Seed: TDFGRAKL (EGFR L858R)
TDFGRAKY

SEQ ID NO: 5613 - protein, 8 aa, Artificial Sequence
  Description of Artificial Sequence: Synthetic peptide
  Seed: TDFGRAKL (EGFR L858R)
TEFGRAKA

SEQ ID NO: 5614 - protein, 8 aa, Artificial Sequence
  Description of Artificial Sequence: Synthetic peptide
  Seed: TDFGRAKL (EGFR L858R)
TEFGRAKC

SEQ ID NO: 5615 - protein, 8 aa, Artificial Sequence
  Description of Artificial Sequence: Synthetic peptide
  Seed: TDFGRAKL (EGFR L858R)
TEFGRAKF

SEQ ID NO: 5616 - protein, 8 aa, Artificial Sequence
  Description of Artificial Sequence: Synthetic peptide
  Seed: TDFGRAKL (EGFR L858R)
TEFGRAKI

SEQ ID NO: 5617 - protein, 8 aa, Artificial Sequence
  Description of Artificial Sequence: Synthetic peptide
  Seed: TDFGRAKL (EGFR L858R)
TEFGRAKL

SEQ ID NO: 5618 - protein, 9 aa, Artificial Sequence
  Description of Artificial Sequence: Synthetic peptide
  Seed: TDFGRAKLL (EGFR L858R)
TEFGRAKLA

SEQ ID NO: 5619 - protein, 9 aa, Artificial Sequence
  Description of Artificial Sequence: Synthetic peptide
  Seed: TDFGRAKLL (EGFR L858R)
TEFGRAKLC

SEQ ID NO: 5620 - protein, 9 aa, Artificial Sequence
  Description of Artificial Sequence: Synthetic peptide
  Seed: TDFGRAKLL (EGFR L858R)
TEFGRAKLD

SEQ ID NO: 5621 - protein, 9 aa, Artificial Sequence
  Description of Artificial Sequence: Synthetic peptide
  Seed: TDFGRAKLL (EGFR L858R)
TEFGRAKLE

SEQ ID NO: 5622 - protein, 9 aa, Artificial Sequence
  Description of Artificial Sequence: Synthetic peptide
  Seed: TDFGRAKLL (EGFR L858R)
TEFGRAKLF

SEQ ID NO: 5623 - protein, 9 aa, Artificial Sequence
  Description of Artificial Sequence: Synthetic peptide
  Seed: TDFGRAKLL (EGFR L858R)
TEFGRAKLG

SEQ ID NO: 5624 - protein, 9 aa, Artificial Sequence
  Description of Artificial Sequence: Synthetic peptide
  Seed: TDFGRAKLL (EGFR L858R)
TEFGRAKLK

SEQ ID NO: 5625 - protein, 9 aa, Artificial Sequence
  Description of Artificial Sequence: Synthetic peptide
  Seed: TDFGRAKLL (EGFR L858R)
TEFGRAKLL

SEQ ID NO: 5626 - protein, 9 aa, Artificial Sequence
  Description of Artificial Sequence: Synthetic peptide
  Seed: TDFGRAKLL (EGFR L858R)
TEFGRAKLM

SEQ ID NO: 5627 - protein, 9 aa, Artificial Sequence
  Description of Artificial Sequence: Synthetic peptide
  Seed: TDFGRAKLL (EGFR L858R)
TEFGRAKLP

SEQ ID NO: 5628 - protein, 9 aa, Artificial Sequence
  Description of Artificial Sequence: Synthetic peptide
  Seed: TDFGRAKLL (EGFR L858R)
TEFGRAKLQ

SEQ ID NO: 5629 - protein, 9 aa, Artificial Sequence
  Description of Artificial Sequence: Synthetic peptide
  Seed: TDFGRAKLL (EGFR L858R)
TEFGRAKLR

SEQ ID NO: 5630 - protein, 9 aa, Artificial Sequence
  Description of Artificial Sequence: Synthetic peptide
  Seed: TDFGRAKLL (EGFR L858R)
TEFGRAKLS

SEQ ID NO: 5631 - protein, 9 aa, Artificial Sequence
  Description of Artificial Sequence: Synthetic peptide
  Seed: TDFGRAKLL (EGFR L858R)
TEFGRAKLT

SEQ ID NO: 5632 - protein, 9 aa, Artificial Sequence
  Description of Artificial Sequence: Synthetic peptide
  Seed: TDFGRAKLL (EGFR L858R)
TEFGRAKLW

SEQ ID NO: 5633 - protein, 9 aa, Artificial Sequence
  Description of Artificial Sequence: Synthetic peptide
  Seed: TDFGRAKLL (EGFR L858R)
TEFGRAKLY

SEQ ID NO: 5634 - protein, 8 aa, Artificial Sequence
  Description of Artificial Sequence: Synthetic peptide
  Seed: TDFGRAKL (EGFR L858R)
TEFGRAKM

SEQ ID NO: 5635 - protein, 8 aa, Artificial Sequence
  Description of Artificial Sequence: Synthetic peptide
  Seed: TDFGRAKL (EGFR L858R)
TEFGRAKT

SEQ ID NO: 5636 - protein, 8 aa, Artificial Sequence
  Description of Artificial Sequence: Synthetic peptide
  Seed: TDFGRAKL (EGFR L858R)
TEFGRAKV

SEQ ID NO: 5637 - protein, 8 aa, Artificial Sequence
  Description of Artificial Sequence: Synthetic peptide
  Seed: TDFGRAKL (EGFR L858R)
TEFGRAKY

SEQ ID NO: 5638 - protein, 8 aa, Artificial Sequence
  Description of Artificial Sequence: Synthetic peptide
  Seed: TDFGRAKL (EGFR L858R)
TFFGRAKL

SEQ ID NO: 5639 - protein, 9 aa, Artificial Sequence
  Description of Artificial Sequence: Synthetic peptide
  Seed: TDFGRAKLL (EGFR L858R)
TFFGRAKLF

SEQ ID NO: 5640 - protein, 9 aa, Artificial Sequence
  Description of Artificial Sequence: Synthetic peptide
  Seed: TDFGRAKLL (EGFR L858R)
TFFGRAKLI

SEQ ID NO: 5641 - protein, 9 aa, Artificial Sequence
  Description of Artificial Sequence: Synthetic peptide
  Seed: TDFGRAKLL (EGFR L858R)
TFFGRAKLL

SEQ ID NO: 5642 - protein, 9 aa, Artificial Sequence
  Description of Artificial Sequence: Synthetic peptide
  Seed: TDFGRAKLL (EGFR L858R)
TFFGRAKLM

SEQ ID NO: 5643 - protein, 9 aa, Artificial Sequence
  Description of Artificial Sequence: Synthetic peptide
  Seed: TDFGRAKLL (EGFR L858R)
TFFGRAKLV

SEQ ID NO: 5644 - protein, 9 aa, Artificial Sequence
  Description of Artificial Sequence: Synthetic peptide
  Seed: TDFGRAKLL (EGFR L858R)
TGFGRAKLF

SEQ ID NO: 5645 - protein, 9 aa, Artificial Sequence
  Description of Artificial Sequence: Synthetic peptide
  Seed: TDFGRAKLL (EGFR L858R)
TGFGRAKLI

SEQ ID NO: 5646 - protein, 9 aa, Artificial Sequence
  Description of Artificial Sequence: Synthetic peptide
  Seed: TDFGRAKLL (EGFR L858R)
TGFGRAKLL

SEQ ID NO: 5647 - protein, 9 aa, Artificial Sequence
  Description of Artificial Sequence: Synthetic peptide
  Seed: TDFGRAKLL (EGFR L858R)
TGFGRAKLM

SEQ ID NO: 5648 - protein, 9 aa, Artificial Sequence
  Description of Artificial Sequence: Synthetic peptide
  Seed: TDFGRAKLL (EGFR L858R)
TGFGRAKLV

SEQ ID NO: 5649 - protein, 8 aa, Artificial Sequence
  Description of Artificial Sequence: Synthetic peptide
  Seed: TDFGRAKL (EGFR L858R)
THFGRAKF

SEQ ID NO: 5650 - protein, 8 aa, Artificial Sequence
  Description of Artificial Sequence: Synthetic peptide
  Seed: TDFGRAKL (EGFR L858R)
THFGRAKI

SEQ ID NO: 5651 - protein, 8 aa, Artificial Sequence
  Description of Artificial Sequence: Synthetic peptide
  Seed: TDFGRAKL (EGFR L858R)
THFGRAKL

SEQ ID NO: 5652 - protein, 9 aa, Artificial Sequence
  Description of Artificial Sequence: Synthetic peptide
  Seed: TDFGRAKLL (EGFR L858R)
THFGRAKLA

SEQ ID NO: 5653 - protein, 9 aa, Artificial Sequence
  Description of Artificial Sequence: Synthetic peptide
  Seed: TDFGRAKLL (EGFR L858R)
THFGRAKLC

SEQ ID NO: 5654 - protein, 9 aa, Artificial Sequence
  Description of Artificial Sequence: Synthetic peptide
  Seed: TDFGRAKLL (EGFR L858R)
THFGRAKLF

SEQ ID NO: 5655 - protein, 9 aa, Artificial Sequence
  Description of Artificial Sequence: Synthetic peptide
  Seed: TDFGRAKLL (EGFR L858R)
THFGRAKLI

SEQ ID NO: 5656 - protein, 9 aa, Artificial Sequence
  Description of Artificial Sequence: Synthetic peptide
  Seed: TDFGRAKLL (EGFR L858R)
THFGRAKLL

SEQ ID NO: 5657 - protein, 9 aa, Artificial Sequence
  Description of Artificial Sequence: Synthetic peptide
  Seed: TDFGRAKLL (EGFR L858R)
THFGRAKLM

SEQ ID NO: 5658 - protein, 9 aa, Artificial Sequence
  Description of Artificial Sequence: Synthetic peptide
  Seed: TDFGRAKLL (EGFR L858R)
THFGRAKLT

SEQ ID NO: 5659 - protein, 9 aa, Artificial Sequence
  Description of Artificial Sequence: Synthetic peptide
  Seed: TDFGRAKLL (EGFR L858R)
THFGRAKLV

SEQ ID NO: 5660 - protein, 8 aa, Artificial Sequence
  Description of Artificial Sequence: Synthetic peptide
  Seed: TDFGRAKL (EGFR L858R)
THFGRAKM

SEQ ID NO: 5661 - protein, 8 aa, Artificial Sequence
  Description of Artificial Sequence: Synthetic peptide
  Seed: TDFGRAKL (EGFR L858R)
THFGRAKV

SEQ ID NO: 5662 - protein, 9 aa, Artificial Sequence
  Description of Artificial Sequence: Synthetic peptide
  Seed: TDFGRAKLL (EGFR L858R)
TIFGRAKLF

SEQ ID NO: 5663 - protein, 9 aa, Artificial Sequence
  Description of Artificial Sequence: Synthetic peptide
  Seed: TDFGRAKLL (EGFR L858R)
TIFGRAKLI

SEQ ID NO: 5664 - protein, 9 aa, Artificial Sequence
  Description of Artificial Sequence: Synthetic peptide
  Seed: TDFGRAKLL (EGFR L858R)
TIFGRAKLL

SEQ ID NO: 5665 - protein, 9 aa, Artificial Sequence
  Description of Artificial Sequence: Synthetic peptide
  Seed: TDFGRAKLL (EGFR L858R)
TIFGRAKLM

SEQ ID NO: 5666 - protein, 9 aa, Artificial Sequence
  Description of Artificial Sequence: Synthetic peptide
  Seed: TDFGRAKLL (EGFR L858R)
TIFGRAKLV

SEQ ID NO: 5667 - protein, 8 aa, Artificial Sequence
  Description of Artificial Sequence: Synthetic peptide
  Seed: TDFGRAKL (EGFR L858R)
TKFGRAKL

SEQ ID NO: 5668 - protein, 9 aa, Artificial Sequence
  Description of Artificial Sequence: Synthetic peptide
  Seed: TDFGRAKLL (EGFR L858R)
TKFGRAKLI

SEQ ID NO: 5669 - protein, 9 aa, Artificial Sequence
  Description of Artificial Sequence: Synthetic peptide
  Seed: TDFGRAKLL (EGFR L858R)
TKFGRAKLL

SEQ ID NO: 5670 - protein, 9 aa, Artificial Sequence
  Description of Artificial Sequence: Synthetic peptide
  Seed: TDFGRAKLL (EGFR L858R)
TKFGRAKLM

SEQ ID NO: 5671 - protein, 9 aa, Artificial Sequence
  Description of Artificial Sequence: Synthetic peptide
  Seed: TDFGRAKLL (EGFR L858R)
TKFGRAKLV

SEQ ID NO: 5672 - protein, 9 aa, Artificial Sequence
  Description of Artificial Sequence: Synthetic peptide
  Seed: TDFGRAKLL (EGFR L858R)
TLFGRAKLF

SEQ ID NO: 5673 - protein, 9 aa, Artificial Sequence
  Description of Artificial Sequence: Synthetic peptide
  Seed: TDFGRAKLL (EGFR L858R)
TLFGRAKLI

SEQ ID NO: 5674 - protein, 9 aa, Artificial Sequence
  Description of Artificial Sequence: Synthetic peptide
  Seed: TDFGRAKLL (EGFR L858R)
TLFGRAKLL

SEQ ID NO: 5675 - protein, 9 aa, Artificial Sequence
  Description of Artificial Sequence: Synthetic peptide
  Seed: TDFGRAKLL (EGFR L858R)
TLFGRAKLM

SEQ ID NO: 5676 - protein, 9 aa, Artificial Sequence
  Description of Artificial Sequence: Synthetic peptide
  Seed: TDFGRAKLL (EGFR L858R)
TLFGRAKLV

SEQ ID NO: 5677 - protein, 9 aa, Artificial Sequence
  Description of Artificial Sequence: Synthetic peptide
  Seed: TDFGRAKLL (EGFR L858R)
TMFGRAKLF

SEQ ID NO: 5678 - protein, 9 aa, Artificial Sequence
  Description of Artificial Sequence: Synthetic peptide
  Seed: TDFGRAKLL (EGFR L858R)
TMFGRAKLI

SEQ ID NO: 5679 - protein, 9 aa, Artificial Sequence
  Description of Artificial Sequence: Synthetic peptide
  Seed: TDFGRAKLL (EGFR L858R)
TMFGRAKLL

SEQ ID NO: 5680 - protein, 9 aa, Artificial Sequence
  Description of Artificial Sequence: Synthetic peptide
  Seed: TDFGRAKLL (EGFR L858R)
TMFGRAKLM

SEQ ID NO: 5681 - protein, 9 aa, Artificial Sequence
  Description of Artificial Sequence: Synthetic peptide
  Seed: TDFGRAKLL (EGFR L858R)
TMFGRAKLV

SEQ ID NO: 5682 - protein, 8 aa, Artificial Sequence
  Description of Artificial Sequence: Synthetic peptide
  Seed: TDFGRAKL (EGFR L858R)
TNFGRAKL

SEQ ID NO: 5683 - protein, 9 aa, Artificial Sequence
  Description of Artificial Sequence: Synthetic peptide
  Seed: TDFGRAKLL (EGFR L858R)
TNFGRAKLF

SEQ ID NO: 5684 - protein, 9 aa, Artificial Sequence
  Description of Artificial Sequence: Synthetic peptide
  Seed: TDFGRAKLL (EGFR L858R)
TNFGRAKLI

SEQ ID NO: 5685 - protein, 9 aa, Artificial Sequence
  Description of Artificial Sequence: Synthetic peptide
  Seed: TDFGRAKLL (EGFR L858R)
TNFGRAKLL

SEQ ID NO: 5686 - protein, 9 aa, Artificial Sequence
  Description of Artificial Sequence: Synthetic peptide
  Seed: TDFGRAKLL (EGFR L858R)
TNFGRAKLM

SEQ ID NO: 5687 - protein, 9 aa, Artificial Sequence
  Description of Artificial Sequence: Synthetic peptide
  Seed: TDFGRAKLL (EGFR L858R)
TNFGRAKLV

SEQ ID NO: 5688 - protein, 8 aa, Artificial Sequence
  Description of Artificial Sequence: Synthetic peptide
  Seed: TDFGRAKL (EGFR L858R)
TPFGRAKL

SEQ ID NO: 5689 - protein, 9 aa, Artificial Sequence
  Description of Artificial Sequence: Synthetic peptide
  Seed: TDFGRAKLL (EGFR L858R)
TPFGRAKLF

SEQ ID NO: 5690 - protein, 9 aa, Artificial Sequence
  Description of Artificial Sequence: Synthetic peptide
  Seed: TDFGRAKLL (EGFR L858R)
TPFGRAKLI

SEQ ID NO: 5691 - protein, 9 aa, Artificial Sequence
  Description of Artificial Sequence: Synthetic peptide
  Seed: TDFGRAKLL (EGFR L858R)
TPFGRAKLL

SEQ ID NO: 5692 - protein, 9 aa, Artificial Sequence
  Description of Artificial Sequence: Synthetic peptide
  Seed: TDFGRAKLL (EGFR L858R)
TPFGRAKLM

SEQ ID NO: 5693 - protein, 9 aa, Artificial Sequence
  Description of Artificial Sequence: Synthetic peptide
  Seed: TDFGRAKLL (EGFR L858R)
TPFGRAKLV

SEQ ID NO: 5694 - protein, 8 aa, Artificial Sequence
  Description of Artificial Sequence: Synthetic peptide
  Seed: TDFGRAKL (EGFR L858R)
TQFGRAKI

SEQ ID NO: 5695 - protein, 8 aa, Artificial Sequence
  Description of Artificial Sequence: Synthetic peptide
  Seed: TDFGRAKL (EGFR L858R)
TQFGRAKL

SEQ ID NO: 5696 - protein, 9 aa, Artificial Sequence
  Description of Artificial Sequence: Synthetic peptide
  Seed: TDFGRAKLL (EGFR L858R)
TQFGRAKLA

SEQ ID NO: 5697 - protein, 9 aa, Artificial Sequence
  Description of Artificial Sequence: Synthetic peptide
  Seed: TDFGRAKLL (EGFR L858R)
TQFGRAKLC

SEQ ID NO: 5698 - protein, 9 aa, Artificial Sequence
  Description of Artificial Sequence: Synthetic peptide
  Seed: TDFGRAKLL (EGFR L858R)
TQFGRAKLF

SEQ ID NO: 5699 - protein, 9 aa, Artificial Sequence
  Description of Artificial Sequence: Synthetic peptide
  Seed: TDFGRAKLL (EGFR L858R)
TQFGRAKLI

SEQ ID NO: 5700 - protein, 9 aa, Artificial Sequence
  Description of Artificial Sequence: Synthetic peptide
  Seed: TDFGRAKLL (EGFR L858R)
TQFGRAKLK

SEQ ID NO: 5701 - protein, 9 aa, Artificial Sequence
  Description of Artificial Sequence: Synthetic peptide
  Seed: TDFGRAKLL (EGFR L858R)
TQFGRAKLM

SEQ ID NO: 5702 - protein, 9 aa, Artificial Sequence
  Description of Artificial Sequence: Synthetic peptide
  Seed: TDFGRAKLL (EGFR L858R)
TQFGRAKLT

SEQ ID NO: 5703 - protein, 9 aa, Artificial Sequence
  Description of Artificial Sequence: Synthetic peptide
  Seed: TDFGRAKLL (EGFR L858R)
TQFGRAKLV

SEQ ID NO: 5704 - protein, 9 aa, Artificial Sequence
  Description of Artificial Sequence: Synthetic peptide
  Seed: TDFGRAKLL (EGFR L858R)
TQFGRAKLW

SEQ ID NO: 5705 - protein, 9 aa, Artificial Sequence
  Description of Artificial Sequence: Synthetic peptide
  Seed: TDFGRAKLL (EGFR L858R)
TQFGRAKLY

SEQ ID NO: 5706 - protein, 8 aa, Artificial Sequence
  Description of Artificial Sequence: Synthetic peptide
  Seed: TDFGRAKL (EGFR L858R)
TQFGRAKM

SEQ ID NO: 5707 - protein, 8 aa, Artificial Sequence
  Description of Artificial Sequence: Synthetic peptide
  Seed: TDFGRAKL (EGFR L858R)
TQFGRAKV

SEQ ID NO: 5708 - protein, 8 aa, Artificial Sequence
  Description of Artificial Sequence: Synthetic peptide
  Seed: TDFGRAKL (EGFR L858R)
TRFGRAKI

SEQ ID NO: 5709 - protein, 8 aa, Artificial Sequence
  Description of Artificial Sequence: Synthetic peptide
  Seed: TDFGRAKL (EGFR L858R)
TRFGRAKL

SEQ ID NO: 5710 - protein, 9 aa, Artificial Sequence
  Description of Artificial Sequence: Synthetic peptide
  Seed: TDFGRAKLL (EGFR L858R)
TRFGRAKLA

SEQ ID NO: 5711 - protein, 9 aa, Artificial Sequence
  Description of Artificial Sequence: Synthetic peptide
  Seed: TDFGRAKLL (EGFR L858R)
TRFGRAKLC

SEQ ID NO: 5712 - protein, 9 aa, Artificial Sequence
  Description of Artificial Sequence: Synthetic peptide
  Seed: TDFGRAKLL (EGFR L858R)
TRFGRAKLF

SEQ ID NO: 5713 - protein, 9 aa, Artificial Sequence
  Description of Artificial Sequence: Synthetic peptide
  Seed: TDFGRAKLL (EGFR L858R)
TRFGRAKLI

SEQ ID NO: 5714 - protein, 9 aa, Artificial Sequence
  Description of Artificial Sequence: Synthetic peptide
  Seed: TDFGRAKLL (EGFR L858R)
TRFGRAKLL

SEQ ID NO: 5715 - protein, 9 aa, Artificial Sequence
  Description of Artificial Sequence: Synthetic peptide
  Seed: TDFGRAKLL (EGFR L858R)
TRFGRAKLM

SEQ ID NO: 5716 - protein, 9 aa, Artificial Sequence
  Description of Artificial Sequence: Synthetic peptide
  Seed: TDFGRAKLL (EGFR L858R)
TRFGRAKLT

SEQ ID NO: 5717 - protein, 9 aa, Artificial Sequence
  Description of Artificial Sequence: Synthetic peptide
  Seed: TDFGRAKLL (EGFR L858R)
TRFGRAKLV

SEQ ID NO: 5718 - protein, 8 aa, Artificial Sequence
  Description of Artificial Sequence: Synthetic peptide
  Seed: TDFGRAKL (EGFR L858R)
TRFGRAKM

SEQ ID NO: 5719 - protein, 8 aa, Artificial Sequence
  Description of Artificial Sequence: Synthetic peptide
  Seed: TDFGRAKL (EGFR L858R)
TRFGRAKV

SEQ ID NO: 5720 - protein, 8 aa, Artificial Sequence
  Description of Artificial Sequence: Synthetic peptide
  Seed: TDFGRAKL (EGFR L858R)
TSFGRAKL

SEQ ID NO: 5721 - protein, 9 aa, Artificial Sequence
  Description of Artificial Sequence: Synthetic peptide
  Seed: TDFGRAKLL (EGFR L858R)
TSFGRAKLF

SEQ ID NO: 5722 - protein, 9 aa, Artificial Sequence
  Description of Artificial Sequence: Synthetic peptide
  Seed: TDFGRAKLL (EGFR L858R)
TSFGRAKLI

SEQ ID NO: 5723 - protein, 9 aa, Artificial Sequence
  Description of Artificial Sequence: Synthetic peptide
  Seed: TDFGRAKLL (EGFR L858R)
TSFGRAKLL

SEQ ID NO: 5724 - protein, 9 aa, Artificial Sequence
  Description of Artificial Sequence: Synthetic peptide
  Seed: TDFGRAKLL (EGFR L858R)
TSFGRAKLM

SEQ ID NO: 5725 - protein, 9 aa, Artificial Sequence
  Description of Artificial Sequence: Synthetic peptide
  Seed: TDFGRAKLL (EGFR L858R)
TSFGRAKLV

SEQ ID NO: 5726 - protein, 9 aa, Artificial Sequence
  Description of Artificial Sequence: Synthetic peptide
  Seed: TDFGRAKLL (EGFR L858R)
TTFGRAKLF

SEQ ID NO: 5727 - protein, 9 aa, Artificial Sequence
  Description of Artificial Sequence: Synthetic peptide
  Seed: TDFGRAKLL (EGFR L858R)
TTFGRAKLI

SEQ ID NO: 5728 - protein, 9 aa, Artificial Sequence
  Description of Artificial Sequence: Synthetic peptide
  Seed: TDFGRAKLL (EGFR L858R)
TTFGRAKLL

SEQ ID NO: 5729 - protein, 9 aa, Artificial Sequence
  Description of Artificial Sequence: Synthetic peptide
  Seed: TDFGRAKLL (EGFR L858R)
TTFGRAKLM

SEQ ID NO: 5730 - protein, 9 aa, Artificial Sequence
  Description of Artificial Sequence: Synthetic peptide
  Seed: TDFGRAKLL (EGFR L858R)
TTFGRAKLV

SEQ ID NO: 5731 - protein, 9 aa, Artificial Sequence
  Description of Artificial Sequence: Synthetic peptide
  Seed: TDFGRAKLL (EGFR L858R)
TVFGRAKLF

SEQ ID NO: 5732 - protein, 9 aa, Artificial Sequence
  Description of Artificial Sequence: Synthetic peptide
  Seed: TDFGRAKLL (EGFR L858R)
TVFGRAKLI

SEQ ID NO: 5733 - protein, 9 aa, Artificial Sequence
  Description of Artificial Sequence: Synthetic peptide
  Seed: TDFGRAKLL (EGFR L858R)
TVFGRAKLL

SEQ ID NO: 5734 - protein, 9 aa, Artificial Sequence
  Description of Artificial Sequence: Synthetic peptide
  Seed: TDFGRAKLL (EGFR L858R)
TVFGRAKLM

SEQ ID NO: 5735 - protein, 9 aa, Artificial Sequence
  Description of Artificial Sequence: Synthetic peptide
  Seed: TDFGRAKLL (EGFR L858R)
TVFGRAKLV

SEQ ID NO: 5736 - protein, 9 aa, Artificial Sequence
  Description of Artificial Sequence: Synthetic peptide
  Seed: TDFGRAKLL (EGFR L858R)
TWFGRAKLF

SEQ ID NO: 5737 - protein, 9 aa, Artificial Sequence
  Description of Artificial Sequence: Synthetic peptide
  Seed: TDFGRAKLL (EGFR L858R)
TWFGRAKLL

SEQ ID NO: 5738 - protein, 9 aa, Artificial Sequence
  Description of Artificial Sequence: Synthetic peptide
  Seed: TDFGRAKLL (EGFR L858R)
TWFGRAKLM

SEQ ID NO: 5739 - protein, 8 aa, Artificial Sequence
  Description of Artificial Sequence: Synthetic peptide
  Seed: TDFGRAKL (EGFR L858R)
TYFGRAKL

SEQ ID NO: 5740 - protein, 9 aa, Artificial Sequence
  Description of Artificial Sequence: Synthetic peptide
  Seed: TDFGRAKLL (EGFR L858R)
TYFGRAKLF

SEQ ID NO: 5741 - protein, 9 aa, Artificial Sequence
  Description of Artificial Sequence: Synthetic peptide
  Seed: TDFGRAKLL (EGFR L858R)
TYFGRAKLI

SEQ ID NO: 5742 - protein, 9 aa, Artificial Sequence
  Description of Artificial Sequence: Synthetic peptide
  Seed: TDFGRAKLL (EGFR L858R)
TYFGRAKLL

SEQ ID NO: 5743 - protein, 9 aa, Artificial Sequence
  Description of Artificial Sequence: Synthetic peptide
  Seed: TDFGRAKLL (EGFR L858R)
TYFGRAKLM

SEQ ID NO: 5744 - protein, 9 aa, Artificial Sequence
  Description of Artificial Sequence: Synthetic peptide
  Seed: TDFGRAKLL (EGFR L858R)
TYFGRAKLV

SEQ ID NO: 5745 - protein, 9 aa, Homo sapiens
  Native (EGFR L858R)
FGRAKLLGA

SEQ ID NO: 5746 - protein, 11 aa, Homo sapiens
  Native (EGFR L858R)
HVKITDFGRAK

SEQ ID NO: 5747 - protein, 9 aa, Homo sapiens
  Native (EGFR L858R)
ITDFGRAKL

SEQ ID NO: 5748 - protein, 10 aa, Homo sapiens
  Native (EGFR L858R)
ITDFGRAKLL

SEQ ID NO: 5749 - protein, 9 aa, Homo sapiens
  Native (EGFR L858R)
KITDFGRAK

SEQ ID NO: 5750 - protein, 10 aa, Homo sapiens
  Native (EGFR L858R)
RAKLLGAEEK

SEQ ID NO: 5751 - protein, 10 aa, Homo sapiens
  Native (EGFR L858R)
VKITDFGRAK

SEQ ID NO: 5752 - protein, 8 aa, Homo sapiens
  Native (EGFR L858R)
ITDFGRAK

SEQ ID NO: 5753 - protein, 10 aa, Homo sapiens
  Native (EGFR L858R)
KITDFGRAKL

SEQ ID NO: 5754 - protein, 11 aa, Homo sapiens
  Native (EGFR L858R)
QHVKITDFGRA

SEQ ID NO: 5755 - protein, 8 aa, Homo sapiens
  Native (EGFR L858R)
TDFGRAKL

SEQ ID NO: 5756 - protein, 9 aa, Homo sapiens
  Native (EGFR L858R)
TDFGRAKLL

SEQ ID NO: 5757 - protein, 9 aa, Artificial Sequence
  Description of Artificial Sequence: Synthetic peptide
  Seed: HAKERIRFV (GTF2I L424H)
HAKERIRFA

SEQ ID NO: 5758 - protein, 9 aa, Artificial Sequence
  Description of Artificial Sequence: Synthetic peptide
  Seed: HAKERIRFV (GTF2I L424H)
HAKERIRFF

SEQ ID NO: 5759 - protein, 9 aa, Artificial Sequence
  Description of Artificial Sequence: Synthetic peptide
  Seed: HAKERIRFV (GTF2I L424H)
HAKERIRFI

SEQ ID NO: 5760 - protein, 9 aa, Artificial Sequence
  Description of Artificial Sequence: Synthetic peptide
  Seed: HAKERIRFV (GTF2I L424H)
HAKERIRFK

SEQ ID NO: 5761 - protein, 9 aa, Artificial Sequence
  Description of Artificial Sequence: Synthetic peptide
  Seed: HAKERIRFV (GTF2I L424H)
HAKERIRFS

SEQ ID NO: 5762 - protein, 10 aa, Artificial Sequence
  Description of Artificial Sequence: Synthetic peptide
  Seed: HAKERIRFVI (GTF2I L424H)
HAKERIRFVA

SEQ ID NO: 5763 - protein, 10 aa, Artificial Sequence
  Description of Artificial Sequence: Synthetic peptide
  Seed: HAKERIRFVI (GTF2I L424H)
HAKERIRFVF

SEQ ID NO: 5764 - protein, 10 aa, Artificial Sequence
  Description of Artificial Sequence: Synthetic peptide
  Seed: HAKERIRFVI (GTF2I L424H)
HAKERIRFVL

SEQ ID NO: 5765 - protein, 10 aa, Artificial Sequence
  Description of Artificial Sequence: Synthetic peptide
  Seed: HAKERIRFVI (GTF2I L424H)
HAKERIRFVM

SEQ ID NO: 5766 - protein, 10 aa, Artificial Sequence
  Description of Artificial Sequence: Synthetic peptide
  Seed: HAKERIRFVI (GTF2I L424H)
HAKERIRFVV

SEQ ID NO: 5767 - protein, 9 aa, Artificial Sequence
  Description of Artificial Sequence: Synthetic peptide
  Seed: HAKERIRFV (GTF2I L424H)
HAKERIRFY

SEQ ID NO: 5768 - protein, 9 aa, Artificial Sequence
  Description of Artificial Sequence: Synthetic peptide
  Seed: HAKERIRFV (GTF2I L424H)
HCKERIRFK

SEQ ID NO: 5769 - protein, 9 aa, Artificial Sequence
  Description of Artificial Sequence: Synthetic peptide
  Seed: HAKERIRFV (GTF2I L424H)
HCKERIRFL

SEQ ID NO: 5770 - protein, 10 aa, Artificial Sequence
  Description of Artificial Sequence: Synthetic peptide
  Seed: HAKERIRFVI (GTF2I L424H)
HCKERIRFVL

SEQ ID NO: 5771 - protein, 9 aa, Artificial Sequence
  Description of Artificial Sequence: Synthetic peptide
  Seed: HAKERIRFV (GTF2I L424H)
HFKERIRFA

SEQ ID NO: 5772 - protein, 9 aa, Artificial Sequence
  Description of Artificial Sequence: Synthetic peptide
  Seed: HAKERIRFV (GTF2I L424H)
HFKERIRFG

SEQ ID NO: 5773 - protein, 9 aa, Artificial Sequence
  Description of Artificial Sequence: Synthetic peptide
  Seed: HAKERIRFV (GTF2I L424H)
HFKERIRFI

SEQ ID NO: 5774 - protein, 9 aa, Artificial Sequence
  Description of Artificial Sequence: Synthetic peptide
  Seed: HAKERIRFV (GTF2I L424H)
HFKERIRFK

SEQ ID NO: 5775 - protein, 9 aa, Artificial Sequence
  Description of Artificial Sequence: Synthetic peptide
  Seed: HAKERIRFV (GTF2I L424H)
HFKERIRFM

SEQ ID NO: 5776 - protein, 9 aa, Artificial Sequence
  Description of Artificial Sequence: Synthetic peptide
  Seed: HAKERIRFV (GTF2I L424H)
HFKERIRFS

SEQ ID NO: 5777 - protein, 9 aa, Artificial Sequence
  Description of Artificial Sequence: Synthetic peptide
  Seed: HAKERIRFV (GTF2I L424H)
HFKERIRFV

SEQ ID NO: 5778 - protein, 10 aa, Artificial Sequence
  Description of Artificial Sequence: Synthetic peptide
  Seed: HAKERIRFVI (GTF2I L424H)
HFKERIRFVI

SEQ ID NO: 5779 - protein, 11 aa, Artificial Sequence
  Description of Artificial Sequence: Synthetic peptide
  Seed: HAKERIRFVIK (GTF2I L424H)
HFKERIRFVIK

SEQ ID NO: 5780 - protein, 10 aa, Artificial Sequence
  Description of Artificial Sequence: Synthetic peptide
  Seed: HAKERIRFVI (GTF2I L424H)
HFKERIRFVL

SEQ ID NO: 5781 - protein, 10 aa, Artificial Sequence
  Description of Artificial Sequence: Synthetic peptide
  Seed: HAKERIRFVI (GTF2I L424H)
HFKERIRFVM

SEQ ID NO: 5782 - protein, 9 aa, Artificial Sequence
  Description of Artificial Sequence: Synthetic peptide
  Seed: HAKERIRFV (GTF2I L424H)
HGKERIRFA

SEQ ID NO: 5783 - protein, 9 aa, Artificial Sequence
  Description of Artificial Sequence: Synthetic peptide
  Seed: HAKERIRFV (GTF2I L424H)
HGKERIRFK

SEQ ID NO: 5784 - protein, 9 aa, Artificial Sequence
  Description of Artificial Sequence: Synthetic peptide
  Seed: HAKERIRFV (GTF2I L424H)
HGKERIRFL

SEQ ID NO: 5785 - protein, 9 aa, Artificial Sequence
  Description of Artificial Sequence: Synthetic peptide
  Seed: HAKERIRFV (GTF2I L424H)
HGKERIRFM

SEQ ID NO: 5786 - protein, 9 aa, Artificial Sequence
  Description of Artificial Sequence: Synthetic peptide
  Seed: HAKERIRFV (GTF2I L424H)
HGKERIRFV

SEQ ID NO: 5787 - protein, 11 aa, Artificial Sequence
  Description of Artificial Sequence: Synthetic peptide
  Seed: HAKERIRFVIK (GTF2I L424H)
HGKERIRFVIK

SEQ ID NO: 5788 - protein, 10 aa, Artificial Sequence
  Description of Artificial Sequence: Synthetic peptide
  Seed: HAKERIRFVI (GTF2I L424H)
HGKERIRFVL

SEQ ID NO: 5789 - protein, 10 aa, Artificial Sequence
  Description of Artificial Sequence: Synthetic peptide
  Seed: HAKERIRFVI (GTF2I L424H)
HGKERIRFVM

SEQ ID NO: 5790 - protein, 9 aa, Artificial Sequence
  Description of Artificial Sequence: Synthetic peptide
  Seed: HAKERIRFV (GTF2I L424H)
HHKERIRFI

SEQ ID NO: 5791 - protein, 9 aa, Artificial Sequence
  Description of Artificial Sequence: Synthetic peptide
  Seed: HAKERIRFV (GTF2I L424H)
HHKERIRFK

SEQ ID NO: 5792 - protein, 9 aa, Artificial Sequence
  Description of Artificial Sequence: Synthetic peptide
  Seed: HAKERIRFV (GTF2I L424H)
HHKERIRFL

SEQ ID NO: 5793 - protein, 9 aa, Artificial Sequence
  Description of Artificial Sequence: Synthetic peptide
  Seed: HAKERIRFV (GTF2I L424H)
HHKERIRFM

SEQ ID NO: 5794 - protein, 9 aa, Artificial Sequence
  Description of Artificial Sequence: Synthetic peptide
  Seed: HAKERIRFV (GTF2I L424H)
HHKERIRFV

SEQ ID NO: 5795 - protein, 9 aa, Artificial Sequence
  Description of Artificial Sequence: Synthetic peptide
  Seed: HAKERIRFV (GTF2I L424H)
HIKERIRFA

SEQ ID NO: 5796 - protein, 9 aa, Artificial Sequence
  Description of Artificial Sequence: Synthetic peptide
  Seed: HAKERIRFV (GTF2I L424H)
HIKERIRFF

SEQ ID NO: 5797 - protein, 9 aa, Artificial Sequence
  Description of Artificial Sequence: Synthetic peptide
  Seed: HAKERIRFV (GTF2I L424H)
HIKERIRFG

SEQ ID NO: 5798 - protein, 9 aa, Artificial Sequence
  Description of Artificial Sequence: Synthetic peptide
  Seed: HAKERIRFV (GTF2I L424H)
HIKERIRFI

SEQ ID NO: 5799 - protein, 9 aa, Artificial Sequence
  Description of Artificial Sequence: Synthetic peptide
  Seed: HAKERIRFV (GTF2I L424H)
HIKERIRFK

SEQ ID NO: 5800 - protein, 9 aa, Artificial Sequence
  Description of Artificial Sequence: Synthetic peptide
  Seed: HAKERIRFV (GTF2I L424H)
HIKERIRFL

SEQ ID NO: 5801 - protein, 9 aa, Artificial Sequence
  Description of Artificial Sequence: Synthetic peptide
  Seed: HAKERIRFV (GTF2I L424H)
HIKERIRFM

SEQ ID NO: 5802 - protein, 9 aa, Artificial Sequence
  Description of Artificial Sequence: Synthetic peptide
  Seed: HAKERIRFV (GTF2I L424H)
HIKERIRFS

SEQ ID NO: 5803 - protein, 9 aa, Artificial Sequence
  Description of Artificial Sequence: Synthetic peptide
  Seed: HAKERIRFV (GTF2I L424H)
HIKERIRFV

SEQ ID NO: 5804 - protein, 10 aa, Artificial Sequence
  Description of Artificial Sequence: Synthetic peptide
  Seed: HAKERIRFVI (GTF2I L424H)
HIKERIRFVA

SEQ ID NO: 5805 - protein, 10 aa, Artificial Sequence
  Description of Artificial Sequence: Synthetic peptide
  Seed: HAKERIRFVI (GTF2I L424H)
HIKERIRFVF

SEQ ID NO: 5806 - protein, 10 aa, Artificial Sequence
  Description of Artificial Sequence: Synthetic peptide
  Seed: HAKERIRFVI (GTF2I L424H)
HIKERIRFVI

SEQ ID NO: 5807 - protein, 11 aa, Artificial Sequence
  Description of Artificial Sequence: Synthetic peptide
  Seed: HAKERIRFVIK (GTF2I L424H)
HIKERIRFVIK

SEQ ID NO: 5808 - protein, 10 aa, Artificial Sequence
  Description of Artificial Sequence: Synthetic peptide
  Seed: HAKERIRFVI (GTF2I L424H)
HIKERIRFVL

SEQ ID NO: 5809 - protein, 10 aa, Artificial Sequence
  Description of Artificial Sequence: Synthetic peptide
  Seed: HAKERIRFVI (GTF2I L424H)
HIKERIRFVM

SEQ ID NO: 5810 - protein, 10 aa, Artificial Sequence
  Description of Artificial Sequence: Synthetic peptide
  Seed: HAKERIRFVI (GTF2I L424H)
HIKERIRFVV

SEQ ID NO: 5811 - protein, 9 aa, Artificial Sequence
  Description of Artificial Sequence: Synthetic peptide
  Seed: HAKERIRFV (GTF2I L424H)
HIKERIRFY

SEQ ID NO: 5812 - protein, 9 aa, Artificial Sequence
  Description of Artificial Sequence: Synthetic peptide
  Seed: HAKERIRFV (GTF2I L424H)
HKKERIRFI

SEQ ID NO: 5813 - protein, 9 aa, Artificial Sequence
  Description of Artificial Sequence: Synthetic peptide
  Seed: HAKERIRFV (GTF2I L424H)
HKKERIRFL

SEQ ID NO: 5814 - protein, 9 aa, Artificial Sequence
  Description of Artificial Sequence: Synthetic peptide
  Seed: HAKERIRFV (GTF2I L424H)
HKKERIRFM

SEQ ID NO: 5815 - protein, 9 aa, Artificial Sequence
  Description of Artificial Sequence: Synthetic peptide
  Seed: HAKERIRFV (GTF2I L424H)
HKKERIRFV

SEQ ID NO: 5816 - protein, 10 aa, Artificial Sequence
  Description of Artificial Sequence: Synthetic peptide
  Seed: HAKERIRFVI (GTF2I L424H)
HKKERIRFVL

SEQ ID NO: 5817 - protein, 10 aa, Artificial Sequence
  Description of Artificial Sequence: Synthetic peptide
  Seed: HAKERIRFVI (GTF2I L424H)
HKKERIRFVM

SEQ ID NO: 5818 - protein, 9 aa, Artificial Sequence
  Description of Artificial Sequence: Synthetic peptide
  Seed: HAKERIRFV (GTF2I L424H)
HLKERIRFA

SEQ ID NO: 5819 - protein, 9 aa, Artificial Sequence
  Description of Artificial Sequence: Synthetic peptide
  Seed: HAKERIRFV (GTF2I L424H)
HLKERIRFC

SEQ ID NO: 5820 - protein, 9 aa, Artificial Sequence
  Description of Artificial Sequence: Synthetic peptide
  Seed: HAKERIRFV (GTF2I L424H)
HLKERIRFF

SEQ ID NO: 5821 - protein, 9 aa, Artificial Sequence
  Description of Artificial Sequence: Synthetic peptide
  Seed: HAKERIRFV (GTF2I L424H)
HLKERIRFI

SEQ ID NO: 5822 - protein, 9 aa, Artificial Sequence
  Description of Artificial Sequence: Synthetic peptide
  Seed: HAKERIRFV (GTF2I L424H)
HLKERIRFK

SEQ ID NO: 5823 - protein, 9 aa, Artificial Sequence
  Description of Artificial Sequence: Synthetic peptide
  Seed: HAKERIRFV (GTF2I L424H)
HLKERIRFL

SEQ ID NO: 5824 - protein, 9 aa, Artificial Sequence
  Description of Artificial Sequence: Synthetic peptide
  Seed: HAKERIRFV (GTF2I L424H)
HLKERIRFM

SEQ ID NO: 5825 - protein, 9 aa, Artificial Sequence
  Description of Artificial Sequence: Synthetic peptide
  Seed: HAKERIRFV (GTF2I L424H)
HLKERIRFT

SEQ ID NO: 5826 - protein, 9 aa, Artificial Sequence
  Description of Artificial Sequence: Synthetic peptide
  Seed: HAKERIRFV (GTF2I L424H)
HLKERIRFV

SEQ ID NO: 5827 - protein, 10 aa, Artificial Sequence
  Description of Artificial Sequence: Synthetic peptide
  Seed: HAKERIRFVI (GTF2I L424H)
HLKERIRFVA

SEQ ID NO: 5828 - protein, 10 aa, Artificial Sequence
  Description of Artificial Sequence: Synthetic peptide
  Seed: HAKERIRFVI (GTF2I L424H)
HLKERIRFVC

SEQ ID NO: 5829 - protein, 10 aa, Artificial Sequence
  Description of Artificial Sequence: Synthetic peptide
  Seed: HAKERIRFVI (GTF2I L424H)
HLKERIRFVF

SEQ ID NO: 5830 - protein, 10 aa, Artificial Sequence
  Description of Artificial Sequence: Synthetic peptide
  Seed: HAKERIRFVI (GTF2I L424H)
HLKERIRFVI

SEQ ID NO: 5831 - protein, 10 aa, Artificial Sequence
  Description of Artificial Sequence: Synthetic peptide
  Seed: HAKERIRFVI (GTF2I L424H)
HLKERIRFVL

SEQ ID NO: 5832 - protein, 10 aa, Artificial Sequence
  Description of Artificial Sequence: Synthetic peptide
  Seed: HAKERIRFVI (GTF2I L424H)
HLKERIRFVM

SEQ ID NO: 5833 - protein, 10 aa, Artificial Sequence
  Description of Artificial Sequence: Synthetic peptide
  Seed: HAKERIRFVI (GTF2I L424H)
HLKERIRFVV

SEQ ID NO: 5834 - protein, 9 aa, Artificial Sequence
  Description of Artificial Sequence: Synthetic peptide
  Seed: HAKERIRFV (GTF2I L424H)
HMKERIRFA

SEQ ID NO: 5835 - protein, 9 aa, Artificial Sequence
  Description of Artificial Sequence: Synthetic peptide
  Seed: HAKERIRFV (GTF2I L424H)
HMKERIRFC

SEQ ID NO: 5836 - protein, 9 aa, Artificial Sequence
  Description of Artificial Sequence: Synthetic peptide
  Seed: HAKERIRFV (GTF2I L424H)
HMKERIRFF

SEQ ID NO: 5837 - protein, 9 aa, Artificial Sequence
  Description of Artificial Sequence: Synthetic peptide
  Seed: HAKERIRFV (GTF2I L424H)
HMKERIRFG

SEQ ID NO: 5838 - protein, 9 aa, Artificial Sequence
  Description of Artificial Sequence: Synthetic peptide
  Seed: HAKERIRFV (GTF2I L424H)
HMKERIRFI

SEQ ID NO: 5839 - protein, 9 aa, Artificial Sequence
  Description of Artificial Sequence: Synthetic peptide
  Seed: HAKERIRFV (GTF2I L424H)
HMKERIRFK

SEQ ID NO: 5840 - protein, 9 aa, Artificial Sequence
  Description of Artificial Sequence: Synthetic peptide
  Seed: HAKERIRFV (GTF2I L424H)
HMKERIRFL

SEQ ID NO: 5841 - protein, 9 aa, Artificial Sequence
  Description of Artificial Sequence: Synthetic peptide
  Seed: HAKERIRFV (GTF2I L424H)
HMKERIRFM

SEQ ID NO: 5842 - protein, 9 aa, Artificial Sequence
  Description of Artificial Sequence: Synthetic peptide
  Seed: HAKERIRFV (GTF2I L424H)
HMKERIRFR

SEQ ID NO: 5843 - protein, 9 aa, Artificial Sequence
  Description of Artificial Sequence: Synthetic peptide
  Seed: HAKERIRFV (GTF2I L424H)
HMKERIRFS

SEQ ID NO: 5844 - protein, 9 aa, Artificial Sequence
  Description of Artificial Sequence: Synthetic peptide
  Seed: HAKERIRFV (GTF2I L424H)
HMKERIRFT

SEQ ID NO: 5845 - protein, 9 aa, Artificial Sequence
  Description of Artificial Sequence: Synthetic peptide
  Seed: HAKERIRFV (GTF2I L424H)
HMKERIRFV

SEQ ID NO: 5846 - protein, 10 aa, Artificial Sequence
  Description of Artificial Sequence: Synthetic peptide
  Seed: HAKERIRFVI (GTF2I L424H)
HMKERIRFVA

SEQ ID NO: 5847 - protein, 10 aa, Artificial Sequence
  Description of Artificial Sequence: Synthetic peptide
  Seed: HAKERIRFVI (GTF2I L424H)
HMKERIRFVC

SEQ ID NO: 5848 - protein, 10 aa, Artificial Sequence
  Description of Artificial Sequence: Synthetic peptide
  Seed: HAKERIRFVI (GTF2I L424H)
HMKERIRFVF

SEQ ID NO: 5849 - protein, 10 aa, Artificial Sequence
  Description of Artificial Sequence: Synthetic peptide
  Seed: HAKERIRFVI (GTF2I L424H)
HMKERIRFVI

SEQ ID NO: 5850 - protein, 11 aa, Artificial Sequence
  Description of Artificial Sequence: Synthetic peptide
  Seed: HAKERIRFVIK (GTF2I L424H)
HMKERIRFVIK

SEQ ID NO: 5851 - protein, 10 aa, Artificial Sequence
  Description of Artificial Sequence: Synthetic peptide
  Seed: HAKERIRFVI (GTF2I L424H)
HMKERIRFVL

SEQ ID NO: 5852 - protein, 10 aa, Artificial Sequence
  Description of Artificial Sequence: Synthetic peptide
  Seed: HAKERIRFVI (GTF2I L424H)
HMKERIRFVM

SEQ ID NO: 5853 - protein, 10 aa, Artificial Sequence
  Description of Artificial Sequence: Synthetic peptide
  Seed: HAKERIRFVI (GTF2I L424H)
HMKERIRFVT

SEQ ID NO: 5854 - protein, 10 aa, Artificial Sequence
  Description of Artificial Sequence: Synthetic peptide
  Seed: HAKERIRFVI (GTF2I L424H)
HMKERIRFVV

SEQ ID NO: 5855 - protein, 9 aa, Artificial Sequence
  Description of Artificial Sequence: Synthetic peptide
  Seed: HAKERIRFV (GTF2I L424H)
HMKERIRFY

SEQ ID NO: 5856 - protein, 9 aa, Artificial Sequence
  Description of Artificial Sequence: Synthetic peptide
  Seed: HAKERIRFV (GTF2I L424H)
HNKERIRFA

SEQ ID NO: 5857 - protein, 9 aa, Artificial Sequence
  Description of Artificial Sequence: Synthetic peptide
  Seed: HAKERIRFV (GTF2I L424H)
HNKERIRFI

SEQ ID NO: 5858 - protein, 9 aa, Artificial Sequence
  Description of Artificial Sequence: Synthetic peptide
  Seed: HAKERIRFV (GTF2I L424H)
HNKERIRFK

SEQ ID NO: 5859 - protein, 9 aa, Artificial Sequence
  Description of Artificial Sequence: Synthetic peptide
  Seed: HAKERIRFV (GTF2I L424H)
HNKERIRFL

SEQ ID NO: 5860 - protein, 9 aa, Artificial Sequence
  Description of Artificial Sequence: Synthetic peptide
  Seed: HAKERIRFV (GTF2I L424H)
HNKERIRFM

SEQ ID NO: 5861 - protein, 10 aa, Artificial Sequence
  Description of Artificial Sequence: Synthetic peptide
  Seed: HAKERIRFVI (GTF2I L424H)
HNKERIRFVL

SEQ ID NO: 5862 - protein, 10 aa, Artificial Sequence
  Description of Artificial Sequence: Synthetic peptide
  Seed: HAKERIRFVI (GTF2I L424H)
HNKERIRFVM

SEQ ID NO: 5863 - protein, 9 aa, Artificial Sequence
  Description of Artificial Sequence: Synthetic peptide
  Seed: HAKERIRFV (GTF2I L424H)
HPKERIRFA

SEQ ID NO: 5864 - protein, 9 aa, Artificial Sequence
  Description of Artificial Sequence: Synthetic peptide
  Seed: HAKERIRFV (GTF2I L424H)
HPKERIRFF

SEQ ID NO: 5865 - protein, 9 aa, Artificial Sequence
  Description of Artificial Sequence: Synthetic peptide
  Seed: HAKERIRFV (GTF2I L424H)
HPKERIRFI

SEQ ID NO: 5866 - protein, 9 aa, Artificial Sequence
  Description of Artificial Sequence: Synthetic peptide
  Seed: HAKERIRFV (GTF2I L424H)
HPKERIRFM

SEQ ID NO: 5867 - protein, 9 aa, Artificial Sequence
  Description of Artificial Sequence: Synthetic peptide
  Seed: HAKERIRFV (GTF2I L424H)
HPKERIRFV

SEQ ID NO: 5868 - protein, 10 aa, Artificial Sequence
  Description of Artificial Sequence: Synthetic peptide
  Seed: HAKERIRFVI (GTF2I L424H)
HPKERIRFVA

SEQ ID NO: 5869 - protein, 10 aa, Artificial Sequence
  Description of Artificial Sequence: Synthetic peptide
  Seed: HAKERIRFVI (GTF2I L424H)
HPKERIRFVF

SEQ ID NO: 5870 - protein, 10 aa, Artificial Sequence
  Description of Artificial Sequence: Synthetic peptide
  Seed: HAKERIRFVI (GTF2I L424H)
HPKERIRFVI

SEQ ID NO: 5871 - protein, 10 aa, Artificial Sequence
  Description of Artificial Sequence: Synthetic peptide
  Seed: HAKERIRFVI (GTF2I L424H)
HPKERIRFVL

SEQ ID NO: 5872 - protein, 10 aa, Artificial Sequence
  Description of Artificial Sequence: Synthetic peptide
  Seed: HAKERIRFVI (GTF2I L424H)
HPKERIRFVM

SEQ ID NO: 5873 - protein, 10 aa, Artificial Sequence
  Description of Artificial Sequence: Synthetic peptide
  Seed: HAKERIRFVI (GTF2I L424H)
HPKERIRFVV

SEQ ID NO: 5874 - protein, 9 aa, Artificial Sequence
  Description of Artificial Sequence: Synthetic peptide
  Seed: HAKERIRFV (GTF2I L424H)
HQKERIRFA

SEQ ID NO: 5875 - protein, 9 aa, Artificial Sequence
  Description of Artificial Sequence: Synthetic peptide
  Seed: HAKERIRFV (GTF2I L424H)
HQKERIRFF

SEQ ID NO: 5876 - protein, 9 aa, Artificial Sequence
  Description of Artificial Sequence: Synthetic peptide
  Seed: HAKERIRFV (GTF2I L424H)
HQKERIRFI

SEQ ID NO: 5877 - protein, 9 aa, Artificial Sequence
  Description of Artificial Sequence: Synthetic peptide
  Seed: HAKERIRFV (GTF2I L424H)
HQKERIRFK

SEQ ID NO: 5878 - protein, 9 aa, Artificial Sequence
  Description of Artificial Sequence: Synthetic peptide
  Seed: HAKERIRFV (GTF2I L424H)
HQKERIRFM

SEQ ID NO: 5879 - protein, 9 aa, Artificial Sequence
  Description of Artificial Sequence: Synthetic peptide
  Seed: HAKERIRFV (GTF2I L424H)
HQKERIRFS

SEQ ID NO: 5880 - protein, 9 aa, Artificial Sequence
  Description of Artificial Sequence: Synthetic peptide
  Seed: HAKERIRFV (GTF2I L424H)
HQKERIRFV

SEQ ID NO: 5881 - protein, 10 aa, Artificial Sequence
  Description of Artificial Sequence: Synthetic peptide
  Seed: HAKERIRFVI (GTF2I L424H)
HQKERIRFVA

SEQ ID NO: 5882 - protein, 10 aa, Artificial Sequence
  Description of Artificial Sequence: Synthetic peptide
  Seed: HAKERIRFVI (GTF2I L424H)
HQKERIRFVF

SEQ ID NO: 5883 - protein, 10 aa, Artificial Sequence
  Description of Artificial Sequence: Synthetic peptide
  Seed: HAKERIRFVI (GTF2I L424H)
HQKERIRFVI

SEQ ID NO: 5884 - protein, 11 aa, Artificial Sequence
  Description of Artificial Sequence: Synthetic peptide
  Seed: HAKERIRFVIK (GTF2I L424H)
HQKERIRFVIK

SEQ ID NO: 5885 - protein, 10 aa, Artificial Sequence
  Description of Artificial Sequence: Synthetic peptide
  Seed: HAKERIRFVI (GTF2I L424H)
HQKERIRFVL

SEQ ID NO: 5886 - protein, 10 aa, Artificial Sequence
  Description of Artificial Sequence: Synthetic peptide
  Seed: HAKERIRFVI (GTF2I L424H)
HQKERIRFVM

SEQ ID NO: 5887 - protein, 10 aa, Artificial Sequence
  Description of Artificial Sequence: Synthetic peptide
  Seed: HAKERIRFVI (GTF2I L424H)
HQKERIRFVV

SEQ ID NO: 5888 - protein, 9 aa, Artificial Sequence
  Description of Artificial Sequence: Synthetic peptide
  Seed: HAKERIRFV (GTF2I L424H)
HRKERIRFF

SEQ ID NO: 5889 - protein, 9 aa, Artificial Sequence
  Description of Artificial Sequence: Synthetic peptide
  Seed: HAKERIRFV (GTF2I L424H)
HRKERIRFI

SEQ ID NO: 5890 - protein, 9 aa, Artificial Sequence
  Description of Artificial Sequence: Synthetic peptide
  Seed: HAKERIRFV (GTF2I L424H)
HRKERIRFL

SEQ ID NO: 5891 - protein, 10 aa, Artificial Sequence
  Description of Artificial Sequence: Synthetic peptide
  Seed: HAKERIRFVI (GTF2I L424H)
HRKERIRFVL

SEQ ID NO: 5892 - protein, 10 aa, Artificial Sequence
  Description of Artificial Sequence: Synthetic peptide
  Seed: HAKERIRFVI (GTF2I L424H)
HRKERIRFVM

SEQ ID NO: 5893 - protein, 9 aa, Artificial Sequence
  Description of Artificial Sequence: Synthetic peptide
  Seed: HAKERIRFV (GTF2I L424H)
HRKERIRFY

SEQ ID NO: 5894 - protein, 9 aa, Artificial Sequence
  Description of Artificial Sequence: Synthetic peptide
  Seed: HAKERIRFV (GTF2I L424H)
HSKERIRFA

SEQ ID NO: 5895 - protein, 9 aa, Artificial Sequence
  Description of Artificial Sequence: Synthetic peptide
  Seed: HAKERIRFV (GTF2I L424H)
HSKERIRFC

SEQ ID NO: 5896 - protein, 9 aa, Artificial Sequence
  Description of Artificial Sequence: Synthetic peptide
  Seed: HAKERIRFV (GTF2I L424H)
HSKERIRFF

SEQ ID NO: 5897 - protein, 9 aa, Artificial Sequence
  Description of Artificial Sequence: Synthetic peptide
  Seed: HAKERIRFV (GTF2I L424H)
HSKERIRFG

SEQ ID NO: 5898 - protein, 9 aa, Artificial Sequence
  Description of Artificial Sequence: Synthetic peptide
  Seed: HAKERIRFV (GTF2I L424H)
HSKERIRFI

SEQ ID NO: 5899 - protein, 9 aa, Artificial Sequence
  Description of Artificial Sequence: Synthetic peptide
  Seed: HAKERIRFV (GTF2I L424H)
HSKERIRFK

SEQ ID NO: 5900 - protein, 9 aa, Artificial Sequence
  Description of Artificial Sequence: Synthetic peptide
  Seed: HAKERIRFV (GTF2I L424H)
HSKERIRFL

SEQ ID NO: 5901 - protein, 9 aa, Artificial Sequence
  Description of Artificial Sequence: Synthetic peptide
  Seed: HAKERIRFV (GTF2I L424H)
HSKERIRFM

SEQ ID NO: 5902 - protein, 9 aa, Artificial Sequence
  Description of Artificial Sequence: Synthetic peptide
  Seed: HAKERIRFV (GTF2I L424H)
HSKERIRFN

SEQ ID NO: 5903 - protein, 9 aa, Artificial Sequence
  Description of Artificial Sequence: Synthetic peptide
  Seed: HAKERIRFV (GTF2I L424H)
HSKERIRFP

SEQ ID NO: 5904 - protein, 9 aa, Artificial Sequence
  Description of Artificial Sequence: Synthetic peptide
  Seed: HAKERIRFV (GTF2I L424H)
HSKERIRFQ

SEQ ID NO: 5905 - protein, 9 aa, Artificial Sequence
  Description of Artificial Sequence: Synthetic peptide
  Seed: HAKERIRFV (GTF2I L424H)
HSKERIRFR

SEQ ID NO: 5906 - protein, 9 aa, Artificial Sequence
  Description of Artificial Sequence: Synthetic peptide
  Seed: HAKERIRFV (GTF2I L424H)
HSKERIRFS

SEQ ID NO: 5907 - protein, 9 aa, Artificial Sequence
  Description of Artificial Sequence: Synthetic peptide
  Seed: HAKERIRFV (GTF2I L424H)
HSKERIRFT

SEQ ID NO: 5908 - protein, 9 aa, Artificial Sequence
  Description of Artificial Sequence: Synthetic peptide
  Seed: HAKERIRFV (GTF2I L424H)
HSKERIRFV

SEQ ID NO: 5909 - protein, 11 aa, Artificial Sequence
  Description of Artificial Sequence: Synthetic peptide
  Seed: HAKERIRFVIK (GTF2I L424H)
HSKERIRFVIA

SEQ ID NO: 5910 - protein, 11 aa, Artificial Sequence
  Description of Artificial Sequence: Synthetic peptide
  Seed: HAKERIRFVIK (GTF2I L424H)
HSKERIRFVIK

SEQ ID NO: 5911 - protein, 11 aa, Artificial Sequence
  Description of Artificial Sequence: Synthetic peptide
  Seed: HAKERIRFVIK (GTF2I L424H)
HSKERIRFVIV

SEQ ID NO: 5912 - protein, 10 aa, Artificial Sequence
  Description of Artificial Sequence: Synthetic peptide
  Seed: HAKERIRFVI (GTF2I L424H)
HSKERIRFVL

SEQ ID NO: 5913 - protein, 10 aa, Artificial Sequence
  Description of Artificial Sequence: Synthetic peptide
  Seed: HAKERIRFVI (GTF2I L424H)
HSKERIRFVM

SEQ ID NO: 5914 - protein, 9 aa, Artificial Sequence
  Description of Artificial Sequence: Synthetic peptide
  Seed: HAKERIRFV (GTF2I L424H)
HSKERIRFY

SEQ ID NO: 5915 - protein, 9 aa, Artificial Sequence
  Description of Artificial Sequence: Synthetic peptide
  Seed: HAKERIRFV (GTF2I L424H)
HTKERIRFA

SEQ ID NO: 5916 - protein, 9 aa, Artificial Sequence
  Description of Artificial Sequence: Synthetic peptide
  Seed: HAKERIRFV (GTF2I L424H)
HTKERIRFC

SEQ ID NO: 5917 - protein, 9 aa, Artificial Sequence
  Description of Artificial Sequence: Synthetic peptide
  Seed: HAKERIRFV (GTF2I L424H)
HTKERIRFE

SEQ ID NO: 5918 - protein, 9 aa, Artificial Sequence
  Description of Artificial Sequence: Synthetic peptide
  Seed: HAKERIRFV (GTF2I L424H)
HTKERIRFF

SEQ ID NO: 5919 - protein, 9 aa, Artificial Sequence
  Description of Artificial Sequence: Synthetic peptide
  Seed: HAKERIRFV (GTF2I L424H)
HTKERIRFG

SEQ ID NO: 5920 - protein, 9 aa, Artificial Sequence
  Description of Artificial Sequence: Synthetic peptide
  Seed: HAKERIRFV (GTF2I L424H)
HTKERIRFH

SEQ ID NO: 5921 - protein, 9 aa, Artificial Sequence
  Description of Artificial Sequence: Synthetic peptide
  Seed: HAKERIRFV (GTF2I L424H)
HTKERIRFI

SEQ ID NO: 5922 - protein, 9 aa, Artificial Sequence
  Description of Artificial Sequence: Synthetic peptide
  Seed: HAKERIRFV (GTF2I L424H)
HTKERIRFK

SEQ ID NO: 5923 - protein, 9 aa, Artificial Sequence
  Description of Artificial Sequence: Synthetic peptide
  Seed: HAKERIRFV (GTF2I L424H)
HTKERIRFL

SEQ ID NO: 5924 - protein, 9 aa, Artificial Sequence
  Description of Artificial Sequence: Synthetic peptide
  Seed: HAKERIRFV (GTF2I L424H)
HTKERIRFM

SEQ ID NO: 5925 - protein, 9 aa, Artificial Sequence
  Description of Artificial Sequence: Synthetic peptide
  Seed: HAKERIRFV (GTF2I L424H)
HTKERIRFN

SEQ ID NO: 5926 - protein, 9 aa, Artificial Sequence
  Description of Artificial Sequence: Synthetic peptide
  Seed: HAKERIRFV (GTF2I L424H)
HTKERIRFP

SEQ ID NO: 5927 - protein, 9 aa, Artificial Sequence
  Description of Artificial Sequence: Synthetic peptide
  Seed: HAKERIRFV (GTF2I L424H)
HTKERIRFQ

SEQ ID NO: 5928 - protein, 9 aa, Artificial Sequence
  Description of Artificial Sequence: Synthetic peptide
  Seed: HAKERIRFV (GTF2I L424H)
HTKERIRFR

SEQ ID NO: 5929 - protein, 9 aa, Artificial Sequence
  Description of Artificial Sequence: Synthetic peptide
  Seed: HAKERIRFV (GTF2I L424H)
HTKERIRFS

SEQ ID NO: 5930 - protein, 9 aa, Artificial Sequence
  Description of Artificial Sequence: Synthetic peptide
  Seed: HAKERIRFV (GTF2I L424H)
HTKERIRFT

SEQ ID NO: 5931 - protein, 9 aa, Artificial Sequence
  Description of Artificial Sequence: Synthetic peptide
  Seed: HAKERIRFV (GTF2I L424H)
HTKERIRFV

SEQ ID NO: 5932 - protein, 11 aa, Artificial Sequence
  Description of Artificial Sequence: Synthetic peptide
  Seed: HAKERIRFVIK (GTF2I L424H)
HTKERIRFVIA

SEQ ID NO: 5933 - protein, 11 aa, Artificial Sequence
  Description of Artificial Sequence: Synthetic peptide
  Seed: HAKERIRFVIK (GTF2I L424H)
HTKERIRFVIK

SEQ ID NO: 5934 - protein, 11 aa, Artificial Sequence
  Description of Artificial Sequence: Synthetic peptide
  Seed: HAKERIRFVIK (GTF2I L424H)
HTKERIRFVIV

SEQ ID NO: 5935 - protein, 10 aa, Artificial Sequence
  Description of Artificial Sequence: Synthetic peptide
  Seed: HAKERIRFVI (GTF2I L424H)
HTKERIRFVL

SEQ ID NO: 5936 - protein, 10 aa, Artificial Sequence
  Description of Artificial Sequence: Synthetic peptide
  Seed: HAKERIRFVI (GTF2I L424H)
HTKERIRFVM

SEQ ID NO: 5937 - protein, 9 aa, Artificial Sequence
  Description of Artificial Sequence: Synthetic peptide
  Seed: HAKERIRFV (GTF2I L424H)
HTKERIRFY

SEQ ID NO: 5938 - protein, 9 aa, Artificial Sequence
  Description of Artificial Sequence: Synthetic peptide
  Seed: HAKERIRFV (GTF2I L424H)
HVKERIRFA

SEQ ID NO: 5939 - protein, 9 aa, Artificial Sequence
  Description of Artificial Sequence: Synthetic peptide
  Seed: HAKERIRFV (GTF2I L424H)
HVKERIRFC

SEQ ID NO: 5940 - protein, 9 aa, Artificial Sequence
  Description of Artificial Sequence: Synthetic peptide
  Seed: HAKERIRFV (GTF2I L424H)
HVKERIRFF

SEQ ID NO: 5941 - protein, 9 aa, Artificial Sequence
  Description of Artificial Sequence: Synthetic peptide
  Seed: HAKERIRFV (GTF2I L424H)
HVKERIRFG

SEQ ID NO: 5942 - protein, 9 aa, Artificial Sequence
  Description of Artificial Sequence: Synthetic peptide
  Seed: HAKERIRFV (GTF2I L424H)
HVKERIRFI

SEQ ID NO: 5943 - protein, 9 aa, Artificial Sequence
  Description of Artificial Sequence: Synthetic peptide
  Seed: HAKERIRFV (GTF2I L424H)
HVKERIRFK

SEQ ID NO: 5944 - protein, 9 aa, Artificial Sequence
  Description of Artificial Sequence: Synthetic peptide
  Seed: HAKERIRFV (GTF2I L424H)
HVKERIRFL

SEQ ID NO: 5945 - protein, 9 aa, Artificial Sequence
  Description of Artificial Sequence: Synthetic peptide
  Seed: HAKERIRFV (GTF2I L424H)
HVKERIRFM

SEQ ID NO: 5946 - protein, 9 aa, Artificial Sequence
  Description of Artificial Sequence: Synthetic peptide
  Seed: HAKERIRFV (GTF2I L424H)
HVKERIRFP

SEQ ID NO: 5947 - protein, 9 aa, Artificial Sequence
  Description of Artificial Sequence: Synthetic peptide
  Seed: HAKERIRFV (GTF2I L424H)
HVKERIRFS

SEQ ID NO: 5948 - protein, 9 aa, Artificial Sequence
  Description of Artificial Sequence: Synthetic peptide
  Seed: HAKERIRFV (GTF2I L424H)
HVKERIRFT

SEQ ID NO: 5949 - protein, 9 aa, Artificial Sequence
  Description of Artificial Sequence: Synthetic peptide
  Seed: HAKERIRFV (GTF2I L424H)
HVKERIRFV

SEQ ID NO: 5950 - protein, 10 aa, Artificial Sequence
  Description of Artificial Sequence: Synthetic peptide
  Seed: HAKERIRFVI (GTF2I L424H)
HVKERIRFVA

SEQ ID NO: 5951 - protein, 10 aa, Artificial Sequence
  Description of Artificial Sequence: Synthetic peptide
  Seed: HAKERIRFVI (GTF2I L424H)
HVKERIRFVF

SEQ ID NO: 5952 - protein, 10 aa, Artificial Sequence
  Description of Artificial Sequence: Synthetic peptide
  Seed: HAKERIRFVI (GTF2I L424H)
HVKERIRFVI

SEQ ID NO: 5953 - protein, 11 aa, Artificial Sequence
  Description of Artificial Sequence: Synthetic peptide
  Seed: HAKERIRFVIK (GTF2I L424H)
HVKERIRFVIK

SEQ ID NO: 5954 - protein, 10 aa, Artificial Sequence
  Description of Artificial Sequence: Synthetic peptide
  Seed: HAKERIRFVI (GTF2I L424H)
HVKERIRFVL

SEQ ID NO: 5955 - protein, 10 aa, Artificial Sequence
  Description of Artificial Sequence: Synthetic peptide
  Seed: HAKERIRFVI (GTF2I L424H)
HVKERIRFVM

SEQ ID NO: 5956 - protein, 10 aa, Artificial Sequence
  Description of Artificial Sequence: Synthetic peptide
  Seed: HAKERIRFVI (GTF2I L424H)
HVKERIRFVV

SEQ ID NO: 5957 - protein, 9 aa, Artificial Sequence
  Description of Artificial Sequence: Synthetic peptide
  Seed: HAKERIRFV (GTF2I L424H)
HVKERIRFY

SEQ ID NO: 5958 - protein, 9 aa, Artificial Sequence
  Description of Artificial Sequence: Synthetic peptide
  Seed: HAKERIRFV (GTF2I L424H)
HWKERIRFA

SEQ ID NO: 5959 - protein, 9 aa, Artificial Sequence
  Description of Artificial Sequence: Synthetic peptide
  Seed: HAKERIRFV (GTF2I L424H)
HWKERIRFI

SEQ ID NO: 5960 - protein, 9 aa, Artificial Sequence
  Description of Artificial Sequence: Synthetic peptide
  Seed: HAKERIRFV (GTF2I L424H)
HWKERIRFK

SEQ ID NO: 5961 - protein, 9 aa, Artificial Sequence
  Description of Artificial Sequence: Synthetic peptide
  Seed: HAKERIRFV (GTF2I L424H)
HWKERIRFL

SEQ ID NO: 5962 - protein, 9 aa, Artificial Sequence
  Description of Artificial Sequence: Synthetic peptide
  Seed: HAKERIRFV (GTF2I L424H)
HWKERIRFM

SEQ ID NO: 5963 - protein, 9 aa, Artificial Sequence
  Description of Artificial Sequence: Synthetic peptide
  Seed: HAKERIRFV (GTF2I L424H)
HWKERIRFV

SEQ ID NO: 5964 - protein, 10 aa, Artificial Sequence
  Description of Artificial Sequence: Synthetic peptide
  Seed: HAKERIRFVI (GTF2I L424H)
HWKERIRFVL

SEQ ID NO: 5965 - protein, 9 aa, Artificial Sequence
  Description of Artificial Sequence: Synthetic peptide
  Seed: HAKERIRFV (GTF2I L424H)
HYKERIRFA

SEQ ID NO: 5966 - protein, 9 aa, Artificial Sequence
  Description of Artificial Sequence: Synthetic peptide
  Seed: HAKERIRFV (GTF2I L424H)
HYKERIRFF

SEQ ID NO: 5967 - protein, 9 aa, Artificial Sequence
  Description of Artificial Sequence: Synthetic peptide
  Seed: HAKERIRFV (GTF2I L424H)
HYKERIRFG

SEQ ID NO: 5968 - protein, 9 aa, Artificial Sequence
  Description of Artificial Sequence: Synthetic peptide
  Seed: HAKERIRFV (GTF2I L424H)
HYKERIRFI

SEQ ID NO: 5969 - protein, 9 aa, Artificial Sequence
  Description of Artificial Sequence: Synthetic peptide
  Seed: HAKERIRFV (GTF2I L424H)
HYKERIRFK

SEQ ID NO: 5970 - protein, 9 aa, Artificial Sequence
  Description of Artificial Sequence: Synthetic peptide
  Seed: HAKERIRFV (GTF2I L424H)
HYKERIRFL

SEQ ID NO: 5971 - protein, 9 aa, Artificial Sequence
  Description of Artificial Sequence: Synthetic peptide
  Seed: HAKERIRFV (GTF2I L424H)
HYKERIRFR

SEQ ID NO: 5972 - protein, 9 aa, Artificial Sequence
  Description of Artificial Sequence: Synthetic peptide
  Seed: HAKERIRFV (GTF2I L424H)
HYKERIRFS

SEQ ID NO: 5973 - protein, 9 aa, Artificial Sequence
  Description of Artificial Sequence: Synthetic peptide
  Seed: HAKERIRFV (GTF2I L424H)
HYKERIRFV

SEQ ID NO: 5974 - protein, 11 aa, Artificial Sequence
  Description of Artificial Sequence: Synthetic peptide
  Seed: HAKERIRFVIK (GTF2I L424H)
HYKERIRFVIK

SEQ ID NO: 5975 - protein, 9 aa, Artificial Sequence
  Description of Artificial Sequence: Synthetic peptide
  Seed: HAKERIRFV (GTF2I L424H)
HYKERIRFY

SEQ ID NO: 5976 - protein, 9 aa, Artificial Sequence
  Description of Artificial Sequence: Synthetic peptide
  Seed: ILHAKERIR (GTF2I L424H)
IFHAKERIR

SEQ ID NO: 5977 - protein, 9 aa, Artificial Sequence
  Description of Artificial Sequence: Synthetic peptide
  Seed: ILHAKERIR (GTF2I L424H)
IIHAKERIR

SEQ ID NO: 5978 - protein, 9 aa, Artificial Sequence
  Description of Artificial Sequence: Synthetic peptide
  Seed: ILHAKERIR (GTF2I L424H)
IMHAKERIR

SEQ ID NO: 5979 - protein, 11 aa, Artificial Sequence
  Description of Artificial Sequence: Synthetic peptide
  Seed: ILHAKERIRFV (GTF2I L424H)
IMHAKERIRFV

SEQ ID NO: 5980 - protein, 10 aa, Artificial Sequence
  Description of Artificial Sequence: Synthetic peptide
  Seed: IPRLERILHA (GTF2I L424H)
IPRLERILHF

SEQ ID NO: 5981 - protein, 10 aa, Artificial Sequence
  Description of Artificial Sequence: Synthetic peptide
  Seed: IPRLERILHA (GTF2I L424H)
IPRLERILHI

SEQ ID NO: 5982 - protein, 10 aa, Artificial Sequence
  Description of Artificial Sequence: Synthetic peptide
  Seed: IPRLERILHA (GTF2I L424H)
IPRLERILHV

SEQ ID NO: 5983 - protein, 9 aa, Artificial Sequence
  Description of Artificial Sequence: Synthetic peptide
  Seed: ILHAKERIR (GTF2I L424H)
ISHAKERIR

SEQ ID NO: 5984 - protein, 9 aa, Artificial Sequence
  Description of Artificial Sequence: Synthetic peptide
  Seed: ILHAKERIR (GTF2I L424H)
ITHAKERIR

SEQ ID NO: 5985 - protein, 9 aa, Artificial Sequence
  Description of Artificial Sequence: Synthetic peptide
  Seed: ILHAKERIR (GTF2I L424H)
IVHAKERIR

SEQ ID NO: 5986 - protein, 9 aa, Artificial Sequence
  Description of Artificial Sequence: Synthetic peptide
  Seed: ILHAKERIR (GTF2I L424H)
IYHAKERIR

SEQ ID NO: 5987 - protein, 10 aa, Artificial Sequence
  Description of Artificial Sequence: Synthetic peptide
  Seed: PRLERILHAK (GTF2I L424H)
PMLERILHAK

SEQ ID NO: 5988 - protein, 9 aa, Artificial Sequence
  Description of Artificial Sequence: Synthetic peptide
  Seed: RLERILHAK (GTF2I L424H)
RAERILHAK

SEQ ID NO: 5989 - protein, 11 aa, Artificial Sequence
  Description of Artificial Sequence: Synthetic peptide
  Seed: RLERILHAKER (GTF2I L424H)
RAERILHAKEF

SEQ ID NO: 5990 - protein, 11 aa, Artificial Sequence
  Description of Artificial Sequence: Synthetic peptide
  Seed: RLERILHAKER (GTF2I L424H)
RAERILHAKEK

SEQ ID NO: 5991 - protein, 11 aa, Artificial Sequence
  Description of Artificial Sequence: Synthetic peptide
  Seed: RLERILHAKER (GTF2I L424H)
RAERILHAKEL

SEQ ID NO: 5992 - protein, 11 aa, Artificial Sequence
  Description of Artificial Sequence: Synthetic peptide
  Seed: RLERILHAKER (GTF2I L424H)
RAERILHAKEM

SEQ ID NO: 5993 - protein, 11 aa, Artificial Sequence
  Description of Artificial Sequence: Synthetic peptide
  Seed: RLERILHAKER (GTF2I L424H)
RAERILHAKER

SEQ ID NO: 5994 - protein, 9 aa, Artificial Sequence
  Description of Artificial Sequence: Synthetic peptide
  Seed: RLERILHAK (GTF2I L424H)
RAERILHAR

SEQ ID NO: 5995 - protein, 10 aa, Artificial Sequence
  Description of Artificial Sequence: Synthetic peptide
  Seed: RILHAKERIR (GTF2I L424H)
RALHAKERIR

SEQ ID NO: 5996 - protein, 9 aa, Artificial Sequence
  Description of Artificial Sequence: Synthetic peptide
  Seed: RILHAKERI (GTF2I L424H)
RALHAKERW

SEQ ID NO: 5997 - protein, 11 aa, Artificial Sequence
  Description of Artificial Sequence: Synthetic peptide
  Seed: RLERILHAKER (GTF2I L424H)
RCERILHAKEF

SEQ ID NO: 5998 - protein, 11 aa, Artificial Sequence
  Description of Artificial Sequence: Synthetic peptide
  Seed: RLERILHAKER (GTF2I L424H)
RCERILHAKEK

SEQ ID NO: 5999 - protein, 11 aa, Artificial Sequence
  Description of Artificial Sequence: Synthetic peptide
  Seed: RLERILHAKER (GTF2I L424H)
RCERILHAKEL

SEQ ID NO: 6000 - protein, 11 aa, Artificial Sequence
  Description of Artificial Sequence: Synthetic peptide
  Seed: RLERILHAKER (GTF2I L424H)
RCERILHAKEM

SEQ ID NO: 6001 - protein, 11 aa, Artificial Sequence
  Description of Artificial Sequence: Synthetic peptide
  Seed: RLERILHAKER (GTF2I L424H)
RCERILHAKER

SEQ ID NO: 6002 - protein, 9 aa, Artificial Sequence
  Description of Artificial Sequence: Synthetic peptide
  Seed: RLERILHAK (GTF2I L424H)
RCERILHAR

SEQ ID NO: 6003 - protein, 10 aa, Artificial Sequence
  Description of Artificial Sequence: Synthetic peptide
  Seed: RILHAKERIR (GTF2I L424H)
RCLHAKERIR

SEQ ID NO: 6004 - protein, 11 aa, Artificial Sequence
  Description of Artificial Sequence: Synthetic peptide
  Seed: RLERILHAKER (GTF2I L424H)
RDERILHAKEF

SEQ ID NO: 6005 - protein, 11 aa, Artificial Sequence
  Description of Artificial Sequence: Synthetic peptide
  Seed: RLERILHAKER (GTF2I L424H)
RDERILHAKEK

SEQ ID NO: 6006 - protein, 11 aa, Artificial Sequence
  Description of Artificial Sequence: Synthetic peptide
  Seed: RLERILHAKER (GTF2I L424H)
RDERILHAKEL

SEQ ID NO: 6007 - protein, 11 aa, Artificial Sequence
  Description of Artificial Sequence: Synthetic peptide
  Seed: RLERILHAKER (GTF2I L424H)
RDERILHAKEM

SEQ ID NO: 6008 - protein, 11 aa, Artificial Sequence
  Description of Artificial Sequence: Synthetic peptide
  Seed: RLERILHAKER (GTF2I L424H)
RDERILHAKER

SEQ ID NO: 6009 - protein, 11 aa, Artificial Sequence
  Description of Artificial Sequence: Synthetic peptide
  Seed: RLERILHAKER (GTF2I L424H)
REERILHAKEF

SEQ ID NO: 6010 - protein, 11 aa, Artificial Sequence
  Description of Artificial Sequence: Synthetic peptide
  Seed: RLERILHAKER (GTF2I L424H)
REERILHAKEK

SEQ ID NO: 6011 - protein, 11 aa, Artificial Sequence
  Description of Artificial Sequence: Synthetic peptide
  Seed: RLERILHAKER (GTF2I L424H)
REERILHAKEL

SEQ ID NO: 6012 - protein, 11 aa, Artificial Sequence
  Description of Artificial Sequence: Synthetic peptide
  Seed: RLERILHAKER (GTF2I L424H)
REERILHAKEM

SEQ ID NO: 6013 - protein, 11 aa, Artificial Sequence
  Description of Artificial Sequence: Synthetic peptide
  Seed: RLERILHAKER (GTF2I L424H)
REERILHAKER

SEQ ID NO: 6014 - protein, 9 aa, Artificial Sequence
  Description of Artificial Sequence: Synthetic peptide
  Seed: RLERILHAK (GTF2I L424H)
RFERILHAK

SEQ ID NO: 6015 - protein, 11 aa, Artificial Sequence
  Description of Artificial Sequence: Synthetic peptide
  Seed: RLERILHAKER (GTF2I L424H)
RFERILHAKEF

SEQ ID NO: 6016 - protein, 11 aa, Artificial Sequence
  Description of Artificial Sequence: Synthetic peptide
  Seed: RLERILHAKER (GTF2I L424H)
RFERILHAKEK

SEQ ID NO: 6017 - protein, 11 aa, Artificial Sequence
  Description of Artificial Sequence: Synthetic peptide
  Seed: RLERILHAKER (GTF2I L424H)
RFERILHAKEL

SEQ ID NO: 6018 - protein, 11 aa, Artificial Sequence
  Description of Artificial Sequence: Synthetic peptide
  Seed: RLERILHAKER (GTF2I L424H)
RFERILHAKEM

SEQ ID NO: 6019 - protein, 11 aa, Artificial Sequence
  Description of Artificial Sequence: Synthetic peptide
  Seed: RLERILHAKER (GTF2I L424H)
RFERILHAKER

SEQ ID NO: 6020 - protein, 9 aa, Artificial Sequence
  Description of Artificial Sequence: Synthetic peptide
  Seed: RLERILHAK (GTF2I L424H)
RFERILHAR

SEQ ID NO: 6021 - protein, 8 aa, Artificial Sequence
  Description of Artificial Sequence: Synthetic peptide
  Seed: RILHAKER (GTF2I L424H)
RFLHAKER

SEQ ID NO: 6022 - protein, 10 aa, Artificial Sequence
  Description of Artificial Sequence: Synthetic peptide
  Seed: RILHAKERIR (GTF2I L424H)
RFLHAKERIK

SEQ ID NO: 6023 - protein, 10 aa, Artificial Sequence
  Description of Artificial Sequence: Synthetic peptide
  Seed: RILHAKERIR (GTF2I L424H)
RFLHAKERIR

SEQ ID NO: 6024 - protein, 9 aa, Artificial Sequence
  Description of Artificial Sequence: Synthetic peptide
  Seed: RLERILHAK (GTF2I L424H)
RGERILHAK

SEQ ID NO: 6025 - protein, 11 aa, Artificial Sequence
  Description of Artificial Sequence: Synthetic peptide
  Seed: RLERILHAKER (GTF2I L424H)
RGERILHAKEF

SEQ ID NO: 6026 - protein, 11 aa, Artificial Sequence
  Description of Artificial Sequence: Synthetic peptide
  Seed: RLERILHAKER (GTF2I L424H)
RGERILHAKEK

SEQ ID NO: 6027 - protein, 11 aa, Artificial Sequence
  Description of Artificial Sequence: Synthetic peptide
  Seed: RLERILHAKER (GTF2I L424H)
RGERILHAKEL

SEQ ID NO: 6028 - protein, 11 aa, Artificial Sequence
  Description of Artificial Sequence: Synthetic peptide
  Seed: RLERILHAKER (GTF2I L424H)
RGERILHAKEM

SEQ ID NO: 6029 - protein, 11 aa, Artificial Sequence
  Description of Artificial Sequence: Synthetic peptide
  Seed: RLERILHAKER (GTF2I L424H)
RGERILHAKER

SEQ ID NO: 6030 - protein, 9 aa, Artificial Sequence
  Description of Artificial Sequence: Synthetic peptide
  Seed: RLERILHAK (GTF2I L424H)
RGERILHAR

SEQ ID NO: 6031 - protein, 10 aa, Artificial Sequence
  Description of Artificial Sequence: Synthetic peptide
  Seed: RILHAKERIR (GTF2I L424H)
RGLHAKERIR

SEQ ID NO: 6032 - protein, 11 aa, Artificial Sequence
  Description of Artificial Sequence: Synthetic peptide
  Seed: RLERILHAKER (GTF2I L424H)
RHERILHAKEF

SEQ ID NO: 6033 - protein, 11 aa, Artificial Sequence
  Description of Artificial Sequence: Synthetic peptide
  Seed: RLERILHAKER (GTF2I L424H)
RHERILHAKEK

SEQ ID NO: 6034 - protein, 11 aa, Artificial Sequence
  Description of Artificial Sequence: Synthetic peptide
  Seed: RLERILHAKER (GTF2I L424H)
RHERILHAKEL

SEQ ID NO: 6035 - protein, 11 aa, Artificial Sequence
  Description of Artificial Sequence: Synthetic peptide
  Seed: RLERILHAKER (GTF2I L424H)
RHERILHAKEM

SEQ ID NO: 6036 - protein, 11 aa, Artificial Sequence
  Description of Artificial Sequence: Synthetic peptide
  Seed: RLERILHAKER (GTF2I L424H)
RHERILHAKER

SEQ ID NO: 6037 - protein, 10 aa, Artificial Sequence
  Description of Artificial Sequence: Synthetic peptide
  Seed: RILHAKERIR (GTF2I L424H)
RHLHAKERIR

SEQ ID NO: 6038 - protein, 9 aa, Artificial Sequence
  Description of Artificial Sequence: Synthetic peptide
  Seed: RLERILHAK (GTF2I L424H)
RIERILHAK

SEQ ID NO: 6039 - protein, 11 aa, Artificial Sequence
  Description of Artificial Sequence: Synthetic peptide
  Seed: RLERILHAKER (GTF2I L424H)
RIERILHAKEF

SEQ ID NO: 6040 - protein, 11 aa, Artificial Sequence
  Description of Artificial Sequence: Synthetic peptide
  Seed: RLERILHAKER (GTF2I L424H)
RIERILHAKEK

SEQ ID NO: 6041 - protein, 11 aa, Artificial Sequence
  Description of Artificial Sequence: Synthetic peptide
  Seed: RLERILHAKER (GTF2I L424H)
RIERILHAKEL

SEQ ID NO: 6042 - protein, 11 aa, Artificial Sequence
  Description of Artificial Sequence: Synthetic peptide
  Seed: RLERILHAKER (GTF2I L424H)
RIERILHAKEM

SEQ ID NO: 6043 - protein, 11 aa, Artificial Sequence
  Description of Artificial Sequence: Synthetic peptide
  Seed: RLERILHAKER (GTF2I L424H)
RIERILHAKER

SEQ ID NO: 6044 - protein, 9 aa, Artificial Sequence
  Description of Artificial Sequence: Synthetic peptide
  Seed: RLERILHAK (GTF2I L424H)
RIERILHAR

SEQ ID NO: 6045 - protein, 9 aa, Artificial Sequence
  Description of Artificial Sequence: Synthetic peptide
  Seed: RILHAKERI (GTF2I L424H)
RILHAKERF

SEQ ID NO: 6046 - protein, 10 aa, Artificial Sequence
  Description of Artificial Sequence: Synthetic peptide
  Seed: RILHAKERIR (GTF2I L424H)
RILHAKERIK

SEQ ID NO: 6047 - protein, 9 aa, Artificial Sequence
  Description of Artificial Sequence: Synthetic peptide
  Seed: RILHAKERI (GTF2I L424H)
RILHAKERW

SEQ ID NO: 6048 - protein, 11 aa, Artificial Sequence
  Description of Artificial Sequence: Synthetic peptide
  Seed: RLERILHAKER (GTF2I L424H)
RKERILHAKEF

SEQ ID NO: 6049 - protein, 11 aa, Artificial Sequence
  Description of Artificial Sequence: Synthetic peptide
  Seed: RLERILHAKER (GTF2I L424H)
RKERILHAKEK

SEQ ID NO: 6050 - protein, 11 aa, Artificial Sequence
  Description of Artificial Sequence: Synthetic peptide
  Seed: RLERILHAKER (GTF2I L424H)
RKERILHAKEL

SEQ ID NO: 6051 - protein, 11 aa, Artificial Sequence
  Description of Artificial Sequence: Synthetic peptide
  Seed: RLERILHAKER (GTF2I L424H)
RKERILHAKEM

SEQ ID NO: 6052 - protein, 11 aa, Artificial Sequence
  Description of Artificial Sequence: Synthetic peptide
  Seed: RLERILHAKER (GTF2I L424H)
RKERILHAKER

SEQ ID NO: 6053 - protein, 11 aa, Artificial Sequence
  Description of Artificial Sequence: Synthetic peptide
  Seed: RLERILHAKER (GTF2I L424H)
RLERILHAKEF

SEQ ID NO: 6054 - protein, 11 aa, Artificial Sequence
  Description of Artificial Sequence: Synthetic peptide
  Seed: RLERILHAKER (GTF2I L424H)
RLERILHAKEK

SEQ ID NO: 6055 - protein, 11 aa, Artificial Sequence
  Description of Artificial Sequence: Synthetic peptide
  Seed: RLERILHAKER (GTF2I L424H)
RLERILHAKEL

SEQ ID NO: 6056 - protein, 11 aa, Artificial Sequence
  Description of Artificial Sequence: Synthetic peptide
  Seed: RLERILHAKER (GTF2I L424H)
RLERILHAKEM

SEQ ID NO: 6057 - protein, 9 aa, Artificial Sequence
  Description of Artificial Sequence: Synthetic peptide
  Seed: RLERILHAK (GTF2I L424H)
RLERILHAR

SEQ ID NO: 6058 - protein, 8 aa, Artificial Sequence
  Description of Artificial Sequence: Synthetic peptide
  Seed: RILHAKER (GTF2I L424H)
RLLHAKER

SEQ ID NO: 6059 - protein, 9 aa, Artificial Sequence
  Description of Artificial Sequence: Synthetic peptide
  Seed: RILHAKERI (GTF2I L424H)
RLLHAKERF

SEQ ID NO: 6060 - protein, 9 aa, Artificial Sequence
  Description of Artificial Sequence: Synthetic peptide
  Seed: RILHAKERI (GTF2I L424H)
RLLHAKERI

SEQ ID NO: 6061 - protein, 10 aa, Artificial Sequence
  Description of Artificial Sequence: Synthetic peptide
  Seed: RILHAKERIR (GTF2I L424H)
RLLHAKERIK

SEQ ID NO: 6062 - protein, 10 aa, Artificial Sequence
  Description of Artificial Sequence: Synthetic peptide
  Seed: RILHAKERIR (GTF2I L424H)
RLLHAKERIR

SEQ ID NO: 6063 - protein, 9 aa, Artificial Sequence
  Description of Artificial Sequence: Synthetic peptide
  Seed: RILHAKERI (GTF2I L424H)
RLLHAKERL

SEQ ID NO: 6064 - protein, 9 aa, Artificial Sequence
  Description of Artificial Sequence: Synthetic peptide
  Seed: RILHAKERI (GTF2I L424H)
RLLHAKERW

SEQ ID NO: 6065 - protein, 9 aa, Artificial Sequence
  Description of Artificial Sequence: Synthetic peptide
  Seed: RLERILHAK (GTF2I L424H)
RMERILHAH

SEQ ID NO: 6066 - protein, 11 aa, Artificial Sequence
  Description of Artificial Sequence: Synthetic peptide
  Seed: RLERILHAKER (GTF2I L424H)
RMERILHAKEF

SEQ ID NO: 6067 - protein, 11 aa, Artificial Sequence
  Description of Artificial Sequence: Synthetic peptide
  Seed: RLERILHAKER (GTF2I L424H)
RMERILHAKEK

SEQ ID NO: 6068 - protein, 11 aa, Artificial Sequence
  Description of Artificial Sequence: Synthetic peptide
  Seed: RLERILHAKER (GTF2I L424H)
RMERILHAKEL

SEQ ID NO: 6069 - protein, 11 aa, Artificial Sequence
  Description of Artificial Sequence: Synthetic peptide
  Seed: RLERILHAKER (GTF2I L424H)
RMERILHAKEM

SEQ ID NO: 6070 - protein, 11 aa, Artificial Sequence
  Description of Artificial Sequence: Synthetic peptide
  Seed: RLERILHAKER (GTF2I L424H)
RMERILHAKER

SEQ ID NO: 6071 - protein, 9 aa, Artificial Sequence
  Description of Artificial Sequence: Synthetic peptide
  Seed: RLERILHAK (GTF2I L424H)
RMERILHAR

SEQ ID NO: 6072 - protein, 8 aa, Artificial Sequence
  Description of Artificial Sequence: Synthetic peptide
  Seed: RILHAKER (GTF2I L424H)
RMLHAKER

SEQ ID NO: 6073 - protein, 9 aa, Artificial Sequence
  Description of Artificial Sequence: Synthetic peptide
  Seed: RILHAKERI (GTF2I L424H)
RMLHAKERF

SEQ ID NO: 6074 - protein, 9 aa, Artificial Sequence
  Description of Artificial Sequence: Synthetic peptide
  Seed: RILHAKERI (GTF2I L424H)
RMLHAKERI

SEQ ID NO: 6075 - protein, 10 aa, Artificial Sequence
  Description of Artificial Sequence: Synthetic peptide
  Seed: RILHAKERIR (GTF2I L424H)
RMLHAKERIK

SEQ ID NO: 6076 - protein, 10 aa, Artificial Sequence
  Description of Artificial Sequence: Synthetic peptide
  Seed: RILHAKERIR (GTF2I L424H)
RMLHAKERIR

SEQ ID NO: 6077 - protein, 9 aa, Artificial Sequence
  Description of Artificial Sequence: Synthetic peptide
  Seed: RILHAKERI (GTF2I L424H)
RMLHAKERY

SEQ ID NO: 6078 - protein, 9 aa, Artificial Sequence
  Description of Artificial Sequence: Synthetic peptide
  Seed: RLERILHAK (GTF2I L424H)
RNERILHAK

SEQ ID NO: 6079 - protein, 11 aa, Artificial Sequence
  Description of Artificial Sequence: Synthetic peptide
  Seed: RLERILHAKER (GTF2I L424H)
RNERILHAKEF

SEQ ID NO: 6080 - protein, 11 aa, Artificial Sequence
  Description of Artificial Sequence: Synthetic peptide
  Seed: RLERILHAKER (GTF2I L424H)
RNERILHAKEK

SEQ ID NO: 6081 - protein, 11 aa, Artificial Sequence
  Description of Artificial Sequence: Synthetic peptide
  Seed: RLERILHAKER (GTF2I L424H)
RNERILHAKEL

SEQ ID NO: 6082 - protein, 11 aa, Artificial Sequence
  Description of Artificial Sequence: Synthetic peptide
  Seed: RLERILHAKER (GTF2I L424H)
RNERILHAKEM

SEQ ID NO: 6083 - protein, 11 aa, Artificial Sequence
  Description of Artificial Sequence: Synthetic peptide
  Seed: RLERILHAKER (GTF2I L424H)
RNERILHAKER

SEQ ID NO: 6084 - protein, 9 aa, Artificial Sequence
  Description of Artificial Sequence: Synthetic peptide
  Seed: RLERILHAK (GTF2I L424H)
RNERILHAR

SEQ ID NO: 6085 - protein, 10 aa, Artificial Sequence
  Description of Artificial Sequence: Synthetic peptide
  Seed: RILHAKERIR (GTF2I L424H)
RNLHAKERIR

SEQ ID NO: 6086 - protein, 11 aa, Artificial Sequence
  Description of Artificial Sequence: Synthetic peptide
  Seed: RLERILHAKER (GTF2I L424H)
RPERILHAKEF

SEQ ID NO: 6087 - protein, 11 aa, Artificial Sequence
  Description of Artificial Sequence: Synthetic peptide
  Seed: RLERILHAKER (GTF2I L424H)
RPERILHAKEK

SEQ ID NO: 6088 - protein, 11 aa, Artificial Sequence
  Description of Artificial Sequence: Synthetic peptide
  Seed: RLERILHAKER (GTF2I L424H)
RPERILHAKEL

SEQ ID NO: 6089 - protein, 11 aa, Artificial Sequence
  Description of Artificial Sequence: Synthetic peptide
  Seed: RLERILHAKER (GTF2I L424H)
RPERILHAKEM

SEQ ID NO: 6090 - protein, 11 aa, Artificial Sequence
  Description of Artificial Sequence: Synthetic peptide
  Seed: RLERILHAKER (GTF2I L424H)
RPERILHAKER

SEQ ID NO: 6091 - protein, 9 aa, Artificial Sequence
  Description of Artificial Sequence: Synthetic peptide
  Seed: RLERILHAK (GTF2I L424H)
RQERILHAK

SEQ ID NO: 6092 - protein, 11 aa, Artificial Sequence
  Description of Artificial Sequence: Synthetic peptide
  Seed: RLERILHAKER (GTF2I L424H)
RQERILHAKEF

SEQ ID NO: 6093 - protein, 11 aa, Artificial Sequence
  Description of Artificial Sequence: Synthetic peptide
  Seed: RLERILHAKER (GTF2I L424H)
RQERILHAKEK

SEQ ID NO: 6094 - protein, 11 aa, Artificial Sequence
  Description of Artificial Sequence: Synthetic peptide
  Seed: RLERILHAKER (GTF2I L424H)
RQERILHAKEL

SEQ ID NO: 6095 - protein, 11 aa, Artificial Sequence
  Description of Artificial Sequence: Synthetic peptide
  Seed: RLERILHAKER (GTF2I L424H)
RQERILHAKEM

SEQ ID NO: 6096 - protein, 11 aa, Artificial Sequence
  Description of Artificial Sequence: Synthetic peptide
  Seed: RLERILHAKER (GTF2I L424H)
RQERILHAKER

SEQ ID NO: 6097 - protein, 9 aa, Artificial Sequence
  Description of Artificial Sequence: Synthetic peptide
  Seed: RLERILHAK (GTF2I L424H)
RQERILHAR

SEQ ID NO: 6098 - protein, 10 aa, Artificial Sequence
  Description of Artificial Sequence: Synthetic peptide
  Seed: RILHAKERIR (GTF2I L424H)
RQLHAKERIR

SEQ ID NO: 6099 - protein, 9 aa, Artificial Sequence
  Description of Artificial Sequence: Synthetic peptide
  Seed: RILHAKERI (GTF2I L424H)
RQLHAKERW

SEQ ID NO: 6100 - protein, 11 aa, Artificial Sequence
  Description of Artificial Sequence: Synthetic peptide
  Seed: RLERILHAKER (GTF2I L424H)
RRERILHAKEF

SEQ ID NO: 6101 - protein, 11 aa, Artificial Sequence
  Description of Artificial Sequence: Synthetic peptide
  Seed: RLERILHAKER (GTF2I L424H)
RRERILHAKEI

SEQ ID NO: 6102 - protein, 11 aa, Artificial Sequence
  Description of Artificial Sequence: Synthetic peptide
  Seed: RLERILHAKER (GTF2I L424H)
RRERILHAKEK

SEQ ID NO: 6103 - protein, 11 aa, Artificial Sequence
  Description of Artificial Sequence: Synthetic peptide
  Seed: RLERILHAKER (GTF2I L424H)
RRERILHAKEL

SEQ ID NO: 6104 - protein, 11 aa, Artificial Sequence
  Description of Artificial Sequence: Synthetic peptide
  Seed: RLERILHAKER (GTF2I L424H)
RRERILHAKEM

SEQ ID NO: 6105 - protein, 11 aa, Artificial Sequence
  Description of Artificial Sequence: Synthetic peptide
  Seed: RLERILHAKER (GTF2I L424H)
RRERILHAKER

SEQ ID NO: 6106 - protein, 11 aa, Artificial Sequence
  Description of Artificial Sequence: Synthetic peptide
  Seed: RLERILHAKER (GTF2I L424H)
RRERILHAKEY

SEQ ID NO: 6107 - protein, 9 aa, Artificial Sequence
  Description of Artificial Sequence: Synthetic peptide
  Seed: RLERILHAK (GTF2I L424H)
RSERILHAA

SEQ ID NO: 6108 - protein, 9 aa, Artificial Sequence
  Description of Artificial Sequence: Synthetic peptide
  Seed: RLERILHAK (GTF2I L424H)
RSERILHAK

SEQ ID NO: 6109 - protein, 11 aa, Artificial Sequence
  Description of Artificial Sequence: Synthetic peptide
  Seed: RLERILHAKER (GTF2I L424H)
RSERILHAKEF

SEQ ID NO: 6110 - protein, 11 aa, Artificial Sequence
  Description of Artificial Sequence: Synthetic peptide
  Seed: RLERILHAKER (GTF2I L424H)
RSERILHAKEK

SEQ ID NO: 6111 - protein, 11 aa, Artificial Sequence
  Description of Artificial Sequence: Synthetic peptide
  Seed: RLERILHAKER (GTF2I L424H)
RSERILHAKEL

SEQ ID NO: 6112 - protein, 11 aa, Artificial Sequence
  Description of Artificial Sequence: Synthetic peptide
  Seed: RLERILHAKER (GTF2I L424H)
RSERILHAKEM

SEQ ID NO: 6113 - protein, 11 aa, Artificial Sequence
  Description of Artificial Sequence: Synthetic peptide
  Seed: RLERILHAKER (GTF2I L424H)
RSERILHAKER

SEQ ID NO: 6114 - protein, 9 aa, Artificial Sequence
  Description of Artificial Sequence: Synthetic peptide
  Seed: RLERILHAK (GTF2I L424H)
RSERILHAR

SEQ ID NO: 6115 - protein, 9 aa, Artificial Sequence
  Description of Artificial Sequence: Synthetic peptide
  Seed: RILHAKERI (GTF2I L424H)
RSLHAKERF

SEQ ID NO: 6116 - protein, 10 aa, Artificial Sequence
  Description of Artificial Sequence: Synthetic peptide
  Seed: RILHAKERIR (GTF2I L424H)
RSLHAKERIR

SEQ ID NO: 6117 - protein, 9 aa, Artificial Sequence
  Description of Artificial Sequence: Synthetic peptide
  Seed: RILHAKERI (GTF2I L424H)
RSLHAKERW

SEQ ID NO: 6118 - protein, 9 aa, Artificial Sequence
  Description of Artificial Sequence: Synthetic peptide
  Seed: RLERILHAK (GTF2I L424H)
RTERILHAA

SEQ ID NO: 6119 - protein, 9 aa, Artificial Sequence
  Description of Artificial Sequence: Synthetic peptide
  Seed: RLERILHAK (GTF2I L424H)
RTERILHAI

SEQ ID NO: 6120 - protein, 11 aa, Artificial Sequence
  Description of Artificial Sequence: Synthetic peptide
  Seed: RLERILHAKER (GTF2I L424H)
RTERILHAKEF

SEQ ID NO: 6121 - protein, 11 aa, Artificial Sequence
  Description of Artificial Sequence: Synthetic peptide
  Seed: RLERILHAKER (GTF2I L424H)
RTERILHAKEK

SEQ ID NO: 6122 - protein, 11 aa, Artificial Sequence
  Description of Artificial Sequence: Synthetic peptide
  Seed: RLERILHAKER (GTF2I L424H)
RTERILHAKEL

SEQ ID NO: 6123 - protein, 11 aa, Artificial Sequence
  Description of Artificial Sequence: Synthetic peptide
  Seed: RLERILHAKER (GTF2I L424H)
RTERILHAKEM

SEQ ID NO: 6124 - protein, 11 aa, Artificial Sequence
  Description of Artificial Sequence: Synthetic peptide
  Seed: RLERILHAKER (GTF2I L424H)
RTERILHAKER

SEQ ID NO: 6125 - protein, 9 aa, Artificial Sequence
  Description of Artificial Sequence: Synthetic peptide
  Seed: RLERILHAK (GTF2I L424H)
RTERILHAV

SEQ ID NO: 6126 - protein, 8 aa, Artificial Sequence
  Description of Artificial Sequence: Synthetic peptide
  Seed: RILHAKER (GTF2I L424H)
RTLHAKER

SEQ ID NO: 6127 - protein, 9 aa, Artificial Sequence
  Description of Artificial Sequence: Synthetic peptide
  Seed: RILHAKERI (GTF2I L424H)
RTLHAKERF

SEQ ID NO: 6128 - protein, 9 aa, Artificial Sequence
  Description of Artificial Sequence: Synthetic peptide
  Seed: RILHAKERI (GTF2I L424H)
RTLHAKERI

SEQ ID NO: 6129 - protein, 10 aa, Artificial Sequence
  Description of Artificial Sequence: Synthetic peptide
  Seed: RILHAKERIR (GTF2I L424H)
RTLHAKERIK

SEQ ID NO: 6130 - protein, 10 aa, Artificial Sequence
  Description of Artificial Sequence: Synthetic peptide
  Seed: RILHAKERIR (GTF2I L424H)
RTLHAKERIR

SEQ ID NO: 6131 - protein, 9 aa, Artificial Sequence
  Description of Artificial Sequence: Synthetic peptide
  Seed: RILHAKERI (GTF2I L424H)
RTLHAKERL

SEQ ID NO: 6132 - protein, 9 aa, Artificial Sequence
  Description of Artificial Sequence: Synthetic peptide
  Seed: RILHAKERI (GTF2I L424H)
RTLHAKERW

SEQ ID NO: 6133 - protein, 9 aa, Artificial Sequence
  Description of Artificial Sequence: Synthetic peptide
  Seed: RLERILHAK (GTF2I L424H)
RVERILHAA

SEQ ID NO: 6134 - protein, 11 aa, Artificial Sequence
  Description of Artificial Sequence: Synthetic peptide
  Seed: RLERILHAKER (GTF2I L424H)
RVERILHAKEF

SEQ ID NO: 6135 - protein, 11 aa, Artificial Sequence
  Description of Artificial Sequence: Synthetic peptide
  Seed: RLERILHAKER (GTF2I L424H)
RVERILHAKEK

SEQ ID NO: 6136 - protein, 11 aa, Artificial Sequence
  Description of Artificial Sequence: Synthetic peptide
  Seed: RLERILHAKER (GTF2I L424H)
RVERILHAKEL

SEQ ID NO: 6137 - protein, 11 aa, Artificial Sequence
  Description of Artificial Sequence: Synthetic peptide
  Seed: RLERILHAKER (GTF2I L424H)
RVERILHAKEM

SEQ ID NO: 6138 - protein, 11 aa, Artificial Sequence
  Description of Artificial Sequence: Synthetic peptide
  Seed: RLERILHAKER (GTF2I L424H)
RVERILHAKER

SEQ ID NO: 6139 - protein, 9 aa, Artificial Sequence
  Description of Artificial Sequence: Synthetic peptide
  Seed: RLERILHAK (GTF2I L424H)
RVERILHAR

SEQ ID NO: 6140 - protein, 8 aa, Artificial Sequence
  Description of Artificial Sequence: Synthetic peptide
  Seed: RILHAKER (GTF2I L424H)
RVLHAKER

SEQ ID NO: 6141 - protein, 9 aa, Artificial Sequence
  Description of Artificial Sequence: Synthetic peptide
  Seed: RILHAKERI (GTF2I L424H)
RVLHAKERF

SEQ ID NO: 6142 - protein, 9 aa, Artificial Sequence
  Description of Artificial Sequence: Synthetic peptide
  Seed: RILHAKERI (GTF2I L424H)
RVLHAKERI

SEQ ID NO: 6143 - protein, 10 aa, Artificial Sequence
  Description of Artificial Sequence: Synthetic peptide
  Seed: RILHAKERIR (GTF2I L424H)
RVLHAKERIK

SEQ ID NO: 6144 - protein, 10 aa, Artificial Sequence
  Description of Artificial Sequence: Synthetic peptide
  Seed: RILHAKERIR (GTF2I L424H)
RVLHAKERIR

SEQ ID NO: 6145 - protein, 9 aa, Artificial Sequence
  Description of Artificial Sequence: Synthetic peptide
  Seed: RILHAKERI (GTF2I L424H)
RVLHAKERL

SEQ ID NO: 6146 - protein, 9 aa, Artificial Sequence
  Description of Artificial Sequence: Synthetic peptide
  Seed: RILHAKERI (GTF2I L424H)
RVLHAKERW

SEQ ID NO: 6147 - protein, 9 aa, Artificial Sequence
  Description of Artificial Sequence: Synthetic peptide
  Seed: RLERILHAK (GTF2I L424H)
RWERILHAK

SEQ ID NO: 6148 - protein, 11 aa, Artificial Sequence
  Description of Artificial Sequence: Synthetic peptide
  Seed: RLERILHAKER (GTF2I L424H)
RWERILHAKEF

SEQ ID NO: 6149 - protein, 11 aa, Artificial Sequence
  Description of Artificial Sequence: Synthetic peptide
  Seed: RLERILHAKER (GTF2I L424H)
RWERILHAKEK

SEQ ID NO: 6150 - protein, 11 aa, Artificial Sequence
  Description of Artificial Sequence: Synthetic peptide
  Seed: RLERILHAKER (GTF2I L424H)
RWERILHAKEL

SEQ ID NO: 6151 - protein, 11 aa, Artificial Sequence
  Description of Artificial Sequence: Synthetic peptide
  Seed: RLERILHAKER (GTF2I L424H)
RWERILHAKEM

SEQ ID NO: 6152 - protein, 11 aa, Artificial Sequence
  Description of Artificial Sequence: Synthetic peptide
  Seed: RLERILHAKER (GTF2I L424H)
RWERILHAKER

SEQ ID NO: 6153 - protein, 9 aa, Artificial Sequence
  Description of Artificial Sequence: Synthetic peptide
  Seed: RLERILHAK (GTF2I L424H)
RWERILHAR

SEQ ID NO: 6154 - protein, 10 aa, Artificial Sequence
  Description of Artificial Sequence: Synthetic peptide
  Seed: RILHAKERIR (GTF2I L424H)
RWLHAKERIK

SEQ ID NO: 6155 - protein, 10 aa, Artificial Sequence
  Description of Artificial Sequence: Synthetic peptide
  Seed: RILHAKERIR (GTF2I L424H)
RWLHAKERIR

SEQ ID NO: 6156 - protein, 9 aa, Artificial Sequence
  Description of Artificial Sequence: Synthetic peptide
  Seed: RLERILHAK (GTF2I L424H)
RYERILHAK

SEQ ID NO: 6157 - protein, 11 aa, Artificial Sequence
  Description of Artificial Sequence: Synthetic peptide
  Seed: RLERILHAKER (GTF2I L424H)
RYERILHAKEF

SEQ ID NO: 6158 - protein, 11 aa, Artificial Sequence
  Description of Artificial Sequence: Synthetic peptide
  Seed: RLERILHAKER (GTF2I L424H)
RYERILHAKEK

SEQ ID NO: 6159 - protein, 11 aa, Artificial Sequence
  Description of Artificial Sequence: Synthetic peptide
  Seed: RLERILHAKER (GTF2I L424H)
RYERILHAKEL

SEQ ID NO: 6160 - protein, 11 aa, Artificial Sequence
  Description of Artificial Sequence: Synthetic peptide
  Seed: RLERILHAKER (GTF2I L424H)
RYERILHAKEM

SEQ ID NO: 6161 - protein, 11 aa, Artificial Sequence
  Description of Artificial Sequence: Synthetic peptide
  Seed: RLERILHAKER (GTF2I L424H)
RYERILHAKER

SEQ ID NO: 6162 - protein, 9 aa, Artificial Sequence
  Description of Artificial Sequence: Synthetic peptide
  Seed: RLERILHAK (GTF2I L424H)
RYERILHAR

SEQ ID NO: 6163 - protein, 10 aa, Artificial Sequence
  Description of Artificial Sequence: Synthetic peptide
  Seed: RILHAKERIR (GTF2I L424H)
RYLHAKERIK

SEQ ID NO: 6164 - protein, 10 aa, Artificial Sequence
  Description of Artificial Sequence: Synthetic peptide
  Seed: RILHAKERIR (GTF2I L424H)
RYLHAKERIR

SEQ ID NO: 6165 - protein, 9 aa, Artificial Sequence
  Description of Artificial Sequence: Synthetic peptide
  Seed: ERILHAKER (GTF2I L424H)
ERILHAKEF

SEQ ID NO: 6166 - protein, 9 aa, Artificial Sequence
  Description of Artificial Sequence: Synthetic peptide
  Seed: ERILHAKER (GTF2I L424H)
ERILHAKEH

SEQ ID NO: 6167 - protein, 9 aa, Artificial Sequence
  Description of Artificial Sequence: Synthetic peptide
  Seed: ERILHAKER (GTF2I L424H)
ERILHAKEI

SEQ ID NO: 6168 - protein, 9 aa, Artificial Sequence
  Description of Artificial Sequence: Synthetic peptide
  Seed: ERILHAKER (GTF2I L424H)
ERILHAKEK

SEQ ID NO: 6169 - protein, 9 aa, Artificial Sequence
  Description of Artificial Sequence: Synthetic peptide
  Seed: ERILHAKER (GTF2I L424H)
ERILHAKEL

SEQ ID NO: 6170 - protein, 9 aa, Artificial Sequence
  Description of Artificial Sequence: Synthetic peptide
  Seed: ERILHAKER (GTF2I L424H)
ERILHAKEM

SEQ ID NO: 6171 - protein, 10 aa, Artificial Sequence
  Description of Artificial Sequence: Synthetic peptide
  Seed: ERILHAKERI (GTF2I L424H)
ERILHAKERF

SEQ ID NO: 6172 - protein, 10 aa, Artificial Sequence
  Description of Artificial Sequence: Synthetic peptide
  Seed: ERILHAKERI (GTF2I L424H)
ERILHAKERL

SEQ ID NO: 6173 - protein, 10 aa, Artificial Sequence
  Description of Artificial Sequence: Synthetic peptide
  Seed: ERILHAKERI (GTF2I L424H)
ERILHAKERM

SEQ ID NO: 6174 - protein, 9 aa, Artificial Sequence
  Description of Artificial Sequence: Synthetic peptide
  Seed: ERILHAKER (GTF2I L424H)
ERILHAKEV

SEQ ID NO: 6175 - protein, 9 aa, Artificial Sequence
  Description of Artificial Sequence: Synthetic peptide
  Seed: ERILHAKER (GTF2I L424H)
ERILHAKEW

SEQ ID NO: 6176 - protein, 9 aa, Artificial Sequence
  Description of Artificial Sequence: Synthetic peptide
  Seed: ERILHAKER (GTF2I L424H)
ERILHAKEY

SEQ ID NO: 6177 - protein, 9 aa, Artificial Sequence
  Description of Artificial Sequence: Synthetic peptide
  Seed: HAKERIRFV (GTF2I L424H)
HAKERIRFC

SEQ ID NO: 6178 - protein, 9 aa, Artificial Sequence
  Description of Artificial Sequence: Synthetic peptide
  Seed: HAKERIRFV (GTF2I L424H)
HAKERIRFH

SEQ ID NO: 6179 - protein, 9 aa, Artificial Sequence
  Description of Artificial Sequence: Synthetic peptide
  Seed: HAKERIRFV (GTF2I L424H)
HAKERIRFW

SEQ ID NO: 6180 - protein, 8 aa, Artificial Sequence
  Description of Artificial Sequence: Synthetic peptide
  Seed: HAKERIRF (GTF2I L424H)
HAKERIRI

SEQ ID NO: 6181 - protein, 8 aa, Artificial Sequence
  Description of Artificial Sequence: Synthetic peptide
  Seed: HAKERIRF (GTF2I L424H)
HAKERIRL

SEQ ID NO: 6182 - protein, 8 aa, Artificial Sequence
  Description of Artificial Sequence: Synthetic peptide
  Seed: HAKERIRF (GTF2I L424H)
HAKERIRM

SEQ ID NO: 6183 - protein, 8 aa, Artificial Sequence
  Description of Artificial Sequence: Synthetic peptide
  Seed: HAKERIRF (GTF2I L424H)
HAKERIRV

SEQ ID NO: 6184 - protein, 8 aa, Artificial Sequence
  Description of Artificial Sequence: Synthetic peptide
  Seed: HAKERIRF (GTF2I L424H)
HAKERIRY

SEQ ID NO: 6185 - protein, 9 aa, Artificial Sequence
  Description of Artificial Sequence: Synthetic peptide
  Seed: HAKERIRFV (GTF2I L424H)
HCKERIRFF

SEQ ID NO: 6186 - protein, 9 aa, Artificial Sequence
  Description of Artificial Sequence: Synthetic peptide
  Seed: HAKERIRFV (GTF2I L424H)
HCKERIRFI

SEQ ID NO: 6187 - protein, 9 aa, Artificial Sequence
  Description of Artificial Sequence: Synthetic peptide
  Seed: HAKERIRFV (GTF2I L424H)
HCKERIRFM

SEQ ID NO: 6188 - protein, 9 aa, Artificial Sequence
  Description of Artificial Sequence: Synthetic peptide
  Seed: HAKERIRFV (GTF2I L424H)
HCKERIRFV

SEQ ID NO: 6189 - protein, 9 aa, Artificial Sequence
  Description of Artificial Sequence: Synthetic peptide
  Seed: HAKERIRFV (GTF2I L424H)
HCKERIRFY

SEQ ID NO: 6190 - protein, 8 aa, Artificial Sequence
  Description of Artificial Sequence: Synthetic peptide
  Seed: HAKERIRF (GTF2I L424H)
HCKERIRL

SEQ ID NO: 6191 - protein, 8 aa, Artificial Sequence
  Description of Artificial Sequence: Synthetic peptide
  Seed: HAKERIRF (GTF2I L424H)
HCKERIRM

SEQ ID NO: 6192 - protein, 9 aa, Artificial Sequence
  Description of Artificial Sequence: Synthetic peptide
  Seed: HAKERIRFV (GTF2I L424H)
HDKERIRFF

SEQ ID NO: 6193 - protein, 9 aa, Artificial Sequence
  Description of Artificial Sequence: Synthetic peptide
  Seed: HAKERIRFV (GTF2I L424H)
HDKERIRFI

SEQ ID NO: 6194 - protein, 9 aa, Artificial Sequence
  Description of Artificial Sequence: Synthetic peptide
  Seed: HAKERIRFV (GTF2I L424H)
HDKERIRFL

SEQ ID NO: 6195 - protein, 9 aa, Artificial Sequence
  Description of Artificial Sequence: Synthetic peptide
  Seed: HAKERIRFV (GTF2I L424H)
HDKERIRFM

SEQ ID NO: 6196 - protein, 9 aa, Artificial Sequence
  Description of Artificial Sequence: Synthetic peptide
  Seed: HAKERIRFV (GTF2I L424H)
HDKERIRFV

SEQ ID NO: 6197 - protein, 9 aa, Artificial Sequence
  Description of Artificial Sequence: Synthetic peptide
  Seed: HAKERIRFV (GTF2I L424H)
HDKERIRFY

SEQ ID NO: 6198 - protein, 8 aa, Artificial Sequence
  Description of Artificial Sequence: Synthetic peptide
  Seed: HAKERIRF (GTF2I L424H)
HDKERIRI

SEQ ID NO: 6199 - protein, 8 aa, Artificial Sequence
  Description of Artificial Sequence: Synthetic peptide
  Seed: HAKERIRF (GTF2I L424H)
HDKERIRL

SEQ ID NO: 6200 - protein, 8 aa, Artificial Sequence
  Description of Artificial Sequence: Synthetic peptide
  Seed: HAKERIRF (GTF2I L424H)
HDKERIRM

SEQ ID NO: 6201 - protein, 9 aa, Artificial Sequence
  Description of Artificial Sequence: Synthetic peptide
  Seed: HAKERIRFV (GTF2I L424H)
HEKERIRFC

SEQ ID NO: 6202 - protein, 9 aa, Artificial Sequence
  Description of Artificial Sequence: Synthetic peptide
  Seed: HAKERIRFV (GTF2I L424H)
HEKERIRFF

SEQ ID NO: 6203 - protein, 9 aa, Artificial Sequence
  Description of Artificial Sequence: Synthetic peptide
  Seed: HAKERIRFV (GTF2I L424H)
HEKERIRFI

SEQ ID NO: 6204 - protein, 9 aa, Artificial Sequence
  Description of Artificial Sequence: Synthetic peptide
  Seed: HAKERIRFV (GTF2I L424H)
HEKERIRFL

SEQ ID NO: 6205 - protein, 9 aa, Artificial Sequence
  Description of Artificial Sequence: Synthetic peptide
  Seed: HAKERIRFV (GTF2I L424H)
HEKERIRFM

SEQ ID NO: 6206 - protein, 9 aa, Artificial Sequence
  Description of Artificial Sequence: Synthetic peptide
  Seed: HAKERIRFV (GTF2I L424H)
HEKERIRFV

SEQ ID NO: 6207 - protein, 9 aa, Artificial Sequence
  Description of Artificial Sequence: Synthetic peptide
  Seed: HAKERIRFV (GTF2I L424H)
HEKERIRFY

SEQ ID NO: 6208 - protein, 8 aa, Artificial Sequence
  Description of Artificial Sequence: Synthetic peptide
  Seed: HAKERIRF (GTF2I L424H)
HEKERIRI

SEQ ID NO: 6209 - protein, 8 aa, Artificial Sequence
  Description of Artificial Sequence: Synthetic peptide
  Seed: HAKERIRF (GTF2I L424H)
HEKERIRL

SEQ ID NO: 6210 - protein, 8 aa, Artificial Sequence
  Description of Artificial Sequence: Synthetic peptide
  Seed: HAKERIRF (GTF2I L424H)
HEKERIRM

SEQ ID NO: 6211 - protein, 8 aa, Artificial Sequence
  Description of Artificial Sequence: Synthetic peptide
  Seed: HAKERIRF (GTF2I L424H)
HFKERIRF

SEQ ID NO: 6212 - protein, 9 aa, Artificial Sequence
  Description of Artificial Sequence: Synthetic peptide
  Seed: HAKERIRFV (GTF2I L424H)
HFKERIRFC

SEQ ID NO: 6213 - protein, 9 aa, Artificial Sequence
  Description of Artificial Sequence: Synthetic peptide
  Seed: HAKERIRFV (GTF2I L424H)
HFKERIRFF

SEQ ID NO: 6214 - protein, 9 aa, Artificial Sequence
  Description of Artificial Sequence: Synthetic peptide
  Seed: HAKERIRFV (GTF2I L424H)
HFKERIRFW

SEQ ID NO: 6215 - protein, 9 aa, Artificial Sequence
  Description of Artificial Sequence: Synthetic peptide
  Seed: HAKERIRFV (GTF2I L424H)
HFKERIRFY

SEQ ID NO: 6216 - protein, 8 aa, Artificial Sequence
  Description of Artificial Sequence: Synthetic peptide
  Seed: HAKERIRF (GTF2I L424H)
HFKERIRI

SEQ ID NO: 6217 - protein, 8 aa, Artificial Sequence
  Description of Artificial Sequence: Synthetic peptide
  Seed: HAKERIRF (GTF2I L424H)
HFKERIRL

SEQ ID NO: 6218 - protein, 8 aa, Artificial Sequence
  Description of Artificial Sequence: Synthetic peptide
  Seed: HAKERIRF (GTF2I L424H)
HFKERIRM

SEQ ID NO: 6219 - protein, 8 aa, Artificial Sequence
  Description of Artificial Sequence: Synthetic peptide
  Seed: HAKERIRF (GTF2I L424H)
HFKERIRY

SEQ ID NO: 6220 - protein, 8 aa, Artificial Sequence
  Description of Artificial Sequence: Synthetic peptide
  Seed: HAKERIRF (GTF2I L424H)
HGKERIRF

SEQ ID NO: 6221 - protein, 9 aa, Artificial Sequence
  Description of Artificial Sequence: Synthetic peptide
  Seed: HAKERIRFV (GTF2I L424H)
HGKERIRFC

SEQ ID NO: 6222 - protein, 9 aa, Artificial Sequence
  Description of Artificial Sequence: Synthetic peptide
  Seed: HAKERIRFV (GTF2I L424H)
HGKERIRFF

SEQ ID NO: 6223 - protein, 9 aa, Artificial Sequence
  Description of Artificial Sequence: Synthetic peptide
  Seed: HAKERIRFV (GTF2I L424H)
HGKERIRFI

SEQ ID NO: 6224 - protein, 9 aa, Artificial Sequence
  Description of Artificial Sequence: Synthetic peptide
  Seed: HAKERIRFV (GTF2I L424H)
HGKERIRFY

SEQ ID NO: 6225 - protein, 8 aa, Artificial Sequence
  Description of Artificial Sequence: Synthetic peptide
  Seed: HAKERIRF (GTF2I L424H)
HGKERIRI

SEQ ID NO: 6226 - protein, 8 aa, Artificial Sequence
  Description of Artificial Sequence: Synthetic peptide
  Seed: HAKERIRF (GTF2I L424H)
HGKERIRL

SEQ ID NO: 6227 - protein, 8 aa, Artificial Sequence
  Description of Artificial Sequence: Synthetic peptide
  Seed: HAKERIRF (GTF2I L424H)
HGKERIRM

SEQ ID NO: 6228 - protein, 8 aa, Artificial Sequence
  Description of Artificial Sequence: Synthetic peptide
  Seed: HAKERIRF (GTF2I L424H)
HGKERIRV

SEQ ID NO: 6229 - protein, 8 aa, Artificial Sequence
  Description of Artificial Sequence: Synthetic peptide
  Seed: HAKERIRF (GTF2I L424H)
HHKERIRF

SEQ ID NO: 6230 - protein, 9 aa, Artificial Sequence
  Description of Artificial Sequence: Synthetic peptide
  Seed: HAKERIRFV (GTF2I L424H)
HHKERIRFF

SEQ ID NO: 6231 - protein, 9 aa, Artificial Sequence
  Description of Artificial Sequence: Synthetic peptide
  Seed: HAKERIRFV (GTF2I L424H)
HHKERIRFY

SEQ ID NO: 6232 - protein, 8 aa, Artificial Sequence
  Description of Artificial Sequence: Synthetic peptide
  Seed: HAKERIRF (GTF2I L424H)
HHKERIRL

SEQ ID NO: 6233 - protein, 8 aa, Artificial Sequence
  Description of Artificial Sequence: Synthetic peptide
  Seed: HAKERIRF (GTF2I L424H)
HHKERIRY

SEQ ID NO: 6234 - protein, 8 aa, Artificial Sequence
  Description of Artificial Sequence: Synthetic peptide
  Seed: HAKERIRF (GTF2I L424H)
HIKERIRF

SEQ ID NO: 6235 - protein, 9 aa, Artificial Sequence
  Description of Artificial Sequence: Synthetic peptide
  Seed: HAKERIRFV (GTF2I L424H)
HIKERIRFC

SEQ ID NO: 6236 - protein, 9 aa, Artificial Sequence
  Description of Artificial Sequence: Synthetic peptide
  Seed: HAKERIRFV (GTF2I L424H)
HIKERIRFH

SEQ ID NO: 6237 - protein, 9 aa, Artificial Sequence
  Description of Artificial Sequence: Synthetic peptide
  Seed: HAKERIRFV (GTF2I L424H)
HIKERIRFW

SEQ ID NO: 6238 - protein, 8 aa, Artificial Sequence
  Description of Artificial Sequence: Synthetic peptide
  Seed: HAKERIRF (GTF2I L424H)
HIKERIRI

SEQ ID NO: 6239 - protein, 8 aa, Artificial Sequence
  Description of Artificial Sequence: Synthetic peptide
  Seed: HAKERIRF (GTF2I L424H)
HIKERIRL

SEQ ID NO: 6240 - protein, 8 aa, Artificial Sequence
  Description of Artificial Sequence: Synthetic peptide
  Seed: HAKERIRF (GTF2I L424H)
HIKERIRM

SEQ ID NO: 6241 - protein, 8 aa, Artificial Sequence
  Description of Artificial Sequence: Synthetic peptide
  Seed: HAKERIRF (GTF2I L424H)
HIKERIRV

SEQ ID NO: 6242 - protein, 8 aa, Artificial Sequence
  Description of Artificial Sequence: Synthetic peptide
  Seed: HAKERIRF (GTF2I L424H)
HIKERIRY

SEQ ID NO: 6243 - protein, 9 aa, Artificial Sequence
  Description of Artificial Sequence: Synthetic peptide
  Seed: HAKERIRFV (GTF2I L424H)
HKKERIRFF

SEQ ID NO: 6244 - protein, 9 aa, Artificial Sequence
  Description of Artificial Sequence: Synthetic peptide
  Seed: HAKERIRFV (GTF2I L424H)
HKKERIRFY

SEQ ID NO: 6245 - protein, 8 aa, Artificial Sequence
  Description of Artificial Sequence: Synthetic peptide
  Seed: HAKERIRF (GTF2I L424H)
HKKERIRL

SEQ ID NO: 6246 - protein, 8 aa, Artificial Sequence
  Description of Artificial Sequence: Synthetic peptide
  Seed: HAKERIRF (GTF2I L424H)
HLKERIRA

SEQ ID NO: 6247 - protein, 8 aa, Artificial Sequence
  Description of Artificial Sequence: Synthetic peptide
  Seed: HAKERIRF (GTF2I L424H)
HLKERIRC

SEQ ID NO: 6248 - protein, 8 aa, Artificial Sequence
  Description of Artificial Sequence: Synthetic peptide
  Seed: HAKERIRF (GTF2I L424H)
HLKERIRF

SEQ ID NO: 6249 - protein, 9 aa, Artificial Sequence
  Description of Artificial Sequence: Synthetic peptide
  Seed: HAKERIRFV (GTF2I L424H)
HLKERIRFH

SEQ ID NO: 6250 - protein, 9 aa, Artificial Sequence
  Description of Artificial Sequence: Synthetic peptide
  Seed: HAKERIRFV (GTF2I L424H)
HLKERIRFW

SEQ ID NO: 6251 - protein, 9 aa, Artificial Sequence
  Description of Artificial Sequence: Synthetic peptide
  Seed: HAKERIRFV (GTF2I L424H)
HLKERIRFY

SEQ ID NO: 6252 - protein, 8 aa, Artificial Sequence
  Description of Artificial Sequence: Synthetic peptide
  Seed: HAKERIRF (GTF2I L424H)
HLKERIRI

SEQ ID NO: 6253 - protein, 8 aa, Artificial Sequence
  Description of Artificial Sequence: Synthetic peptide
  Seed: HAKERIRF (GTF2I L424H)
HLKERIRL

SEQ ID NO: 6254 - protein, 8 aa, Artificial Sequence
  Description of Artificial Sequence: Synthetic peptide
  Seed: HAKERIRF (GTF2I L424H)
HLKERIRM

SEQ ID NO: 6255 - protein, 8 aa, Artificial Sequence
  Description of Artificial Sequence: Synthetic peptide
  Seed: HAKERIRF (GTF2I L424H)
HLKERIRV

SEQ ID NO: 6256 - protein, 8 aa, Artificial Sequence
  Description of Artificial Sequence: Synthetic peptide
  Seed: HAKERIRF (GTF2I L424H)
HMKERIRA

SEQ ID NO: 6257 - protein, 8 aa, Artificial Sequence
  Description of Artificial Sequence: Synthetic peptide
  Seed: HAKERIRF (GTF2I L424H)
HMKERIRC

SEQ ID NO: 6258 - protein, 8 aa, Artificial Sequence
  Description of Artificial Sequence: Synthetic peptide
  Seed: HAKERIRF (GTF2I L424H)
HMKERIRF

SEQ ID NO: 6259 - protein, 9 aa, Artificial Sequence
  Description of Artificial Sequence: Synthetic peptide
  Seed: HAKERIRFV (GTF2I L424H)
HMKERIRFH

SEQ ID NO: 6260 - protein, 9 aa, Artificial Sequence
  Description of Artificial Sequence: Synthetic peptide
  Seed: HAKERIRFV (GTF2I L424H)
HMKERIRFW

SEQ ID NO: 6261 - protein, 8 aa, Artificial Sequence
  Description of Artificial Sequence: Synthetic peptide
  Seed: HAKERIRF (GTF2I L424H)
HMKERIRI

SEQ ID NO: 6262 - protein, 8 aa, Artificial Sequence
  Description of Artificial Sequence: Synthetic peptide
  Seed: HAKERIRF (GTF2I L424H)
HMKERIRL

SEQ ID NO: 6263 - protein, 8 aa, Artificial Sequence
  Description of Artificial Sequence: Synthetic peptide
  Seed: HAKERIRF (GTF2I L424H)
HMKERIRM

SEQ ID NO: 6264 - protein, 8 aa, Artificial Sequence
  Description of Artificial Sequence: Synthetic peptide
  Seed: HAKERIRF (GTF2I L424H)
HMKERIRV

SEQ ID NO: 6265 - protein, 9 aa, Artificial Sequence
  Description of Artificial Sequence: Synthetic peptide
  Seed: HAKERIRFV (GTF2I L424H)
HNKERIRFF

SEQ ID NO: 6266 - protein, 9 aa, Artificial Sequence
  Description of Artificial Sequence: Synthetic peptide
  Seed: HAKERIRFV (GTF2I L424H)
HNKERIRFV

SEQ ID NO: 6267 - protein, 9 aa, Artificial Sequence
  Description of Artificial Sequence: Synthetic peptide
  Seed: HAKERIRFV (GTF2I L424H)
HNKERIRFY

SEQ ID NO: 6268 - protein, 8 aa, Artificial Sequence
  Description of Artificial Sequence: Synthetic peptide
  Seed: HAKERIRF (GTF2I L424H)
HNKERIRI

SEQ ID NO: 6269 - protein, 8 aa, Artificial Sequence
  Description of Artificial Sequence: Synthetic peptide
  Seed: HAKERIRF (GTF2I L424H)
HNKERIRL

SEQ ID NO: 6270 - protein, 8 aa, Artificial Sequence
  Description of Artificial Sequence: Synthetic peptide
  Seed: HAKERIRF (GTF2I L424H)
HNKERIRM

SEQ ID NO: 6271 - protein, 8 aa, Artificial Sequence
  Description of Artificial Sequence: Synthetic peptide
  Seed: HAKERIRF (GTF2I L424H)
HNKERIRV

SEQ ID NO: 6272 - protein, 8 aa, Artificial Sequence
  Description of Artificial Sequence: Synthetic peptide
  Seed: HAKERIRF (GTF2I L424H)
HPKERIRA

SEQ ID NO: 6273 - protein, 8 aa, Artificial Sequence
  Description of Artificial Sequence: Synthetic peptide
  Seed: HAKERIRF (GTF2I L424H)
HPKERIRC

SEQ ID NO: 6274 - protein, 8 aa, Artificial Sequence
  Description of Artificial Sequence: Synthetic peptide
  Seed: HAKERIRF (GTF2I L424H)
HPKERIRF

SEQ ID NO: 6275 - protein, 9 aa, Artificial Sequence
  Description of Artificial Sequence: Synthetic peptide
  Seed: HAKERIRFV (GTF2I L424H)
HPKERIRFC

SEQ ID NO: 6276 - protein, 9 aa, Artificial Sequence
  Description of Artificial Sequence: Synthetic peptide
  Seed: HAKERIRFV (GTF2I L424H)
HPKERIRFG

SEQ ID NO: 6277 - protein, 9 aa, Artificial Sequence
  Description of Artificial Sequence: Synthetic peptide
  Seed: HAKERIRFV (GTF2I L424H)
HPKERIRFP

SEQ ID NO: 6278 - protein, 9 aa, Artificial Sequence
  Description of Artificial Sequence: Synthetic peptide
  Seed: HAKERIRFV (GTF2I L424H)
HPKERIRFS

SEQ ID NO: 6279 - protein, 9 aa, Artificial Sequence
  Description of Artificial Sequence: Synthetic peptide
  Seed: HAKERIRFV (GTF2I L424H)
HPKERIRFT

SEQ ID NO: 6280 - protein, 9 aa, Artificial Sequence
  Description of Artificial Sequence: Synthetic peptide
  Seed: HAKERIRFV (GTF2I L424H)
HPKERIRFW

SEQ ID NO: 6281 - protein, 9 aa, Artificial Sequence
  Description of Artificial Sequence: Synthetic peptide
  Seed: HAKERIRFV (GTF2I L424H)
HPKERIRFY

SEQ ID NO: 6282 - protein, 8 aa, Artificial Sequence
  Description of Artificial Sequence: Synthetic peptide
  Seed: HAKERIRF (GTF2I L424H)
HPKERIRI

SEQ ID NO: 6283 - protein, 8 aa, Artificial Sequence
  Description of Artificial Sequence: Synthetic peptide
  Seed: HAKERIRF (GTF2I L424H)
HPKERIRL

SEQ ID NO: 6284 - protein, 8 aa, Artificial Sequence
  Description of Artificial Sequence: Synthetic peptide
  Seed: HAKERIRF (GTF2I L424H)
HPKERIRM

SEQ ID NO: 6285 - protein, 8 aa, Artificial Sequence
  Description of Artificial Sequence: Synthetic peptide
  Seed: HAKERIRF (GTF2I L424H)
HPKERIRV

SEQ ID NO: 6286 - protein, 8 aa, Artificial Sequence
  Description of Artificial Sequence: Synthetic peptide
  Seed: HAKERIRF (GTF2I L424H)
HQKERIRF

SEQ ID NO: 6287 - protein, 9 aa, Artificial Sequence
  Description of Artificial Sequence: Synthetic peptide
  Seed: HAKERIRFV (GTF2I L424H)
HQKERIRFC

SEQ ID NO: 6288 - protein, 9 aa, Artificial Sequence
  Description of Artificial Sequence: Synthetic peptide
  Seed: HAKERIRFV (GTF2I L424H)
HQKERIRFH

SEQ ID NO: 6289 - protein, 9 aa, Artificial Sequence
  Description of Artificial Sequence: Synthetic peptide
  Seed: HAKERIRFV (GTF2I L424H)
HQKERIRFY

SEQ ID NO: 6290 - protein, 8 aa, Artificial Sequence
  Description of Artificial Sequence: Synthetic peptide
  Seed: HAKERIRF (GTF2I L424H)
HQKERIRI

SEQ ID NO: 6291 - protein, 8 aa, Artificial Sequence
  Description of Artificial Sequence: Synthetic peptide
  Seed: HAKERIRF (GTF2I L424H)
HQKERIRL

SEQ ID NO: 6292 - protein, 8 aa, Artificial Sequence
  Description of Artificial Sequence: Synthetic peptide
  Seed: HAKERIRF (GTF2I L424H)
HQKERIRM

SEQ ID NO: 6293 - protein, 8 aa, Artificial Sequence
  Description of Artificial Sequence: Synthetic peptide
  Seed: HAKERIRF (GTF2I L424H)
HQKERIRV

SEQ ID NO: 6294 - protein, 8 aa, Artificial Sequence
  Description of Artificial Sequence: Synthetic peptide
  Seed: HAKERIRF (GTF2I L424H)
HQKERIRY

SEQ ID NO: 6295 - protein, 8 aa, Artificial Sequence
  Description of Artificial Sequence: Synthetic peptide
  Seed: HAKERIRF (GTF2I L424H)
HRKERIRF

SEQ ID NO: 6296 - protein, 9 aa, Artificial Sequence
  Description of Artificial Sequence: Synthetic peptide
  Seed: HAKERIRFV (GTF2I L424H)
HRKERIRFA

SEQ ID NO: 6297 - protein, 9 aa, Artificial Sequence
  Description of Artificial Sequence: Synthetic peptide
  Seed: HAKERIRFV (GTF2I L424H)
HRKERIRFC

SEQ ID NO: 6298 - protein, 9 aa, Artificial Sequence
  Description of Artificial Sequence: Synthetic peptide
  Seed: HAKERIRFV (GTF2I L424H)
HRKERIRFH

SEQ ID NO: 6299 - protein, 9 aa, Artificial Sequence
  Description of Artificial Sequence: Synthetic peptide
  Seed: HAKERIRFV (GTF2I L424H)
HRKERIRFK

SEQ ID NO: 6300 - protein, 9 aa, Artificial Sequence
  Description of Artificial Sequence: Synthetic peptide
  Seed: HAKERIRFV (GTF2I L424H)
HRKERIRFR

SEQ ID NO: 6301 - protein, 9 aa, Artificial Sequence
  Description of Artificial Sequence: Synthetic peptide
  Seed: HAKERIRFV (GTF2I L424H)
HRKERIRFW

SEQ ID NO: 6302 - protein, 8 aa, Artificial Sequence
  Description of Artificial Sequence: Synthetic peptide
  Seed: HAKERIRF (GTF2I L424H)
HRKERIRI

SEQ ID NO: 6303 - protein, 8 aa, Artificial Sequence
  Description of Artificial Sequence: Synthetic peptide
  Seed: HAKERIRF (GTF2I L424H)
HRKERIRL

SEQ ID NO: 6304 - protein, 8 aa, Artificial Sequence
  Description of Artificial Sequence: Synthetic peptide
  Seed: HAKERIRF (GTF2I L424H)
HRKERIRM

SEQ ID NO: 6305 - protein, 8 aa, Artificial Sequence
  Description of Artificial Sequence: Synthetic peptide
  Seed: HAKERIRF (GTF2I L424H)
HRKERIRY

SEQ ID NO: 6306 - protein, 8 aa, Artificial Sequence
  Description of Artificial Sequence: Synthetic peptide
  Seed: HAKERIRF (GTF2I L424H)
HSKERIRF

SEQ ID NO: 6307 - protein, 9 aa, Artificial Sequence
  Description of Artificial Sequence: Synthetic peptide
  Seed: HAKERIRFV (GTF2I L424H)
HSKERIRFH

SEQ ID NO: 6308 - protein, 9 aa, Artificial Sequence
  Description of Artificial Sequence: Synthetic peptide
  Seed: HAKERIRFV (GTF2I L424H)
HSKERIRFW

SEQ ID NO: 6309 - protein, 8 aa, Artificial Sequence
  Description of Artificial Sequence: Synthetic peptide
  Seed: HAKERIRF (GTF2I L424H)
HSKERIRI

SEQ ID NO: 6310 - protein, 8 aa, Artificial Sequence
  Description of Artificial Sequence: Synthetic peptide
  Seed: HAKERIRF (GTF2I L424H)
HSKERIRL

SEQ ID NO: 6311 - protein, 8 aa, Artificial Sequence
  Description of Artificial Sequence: Synthetic peptide
  Seed: HAKERIRF (GTF2I L424H)
HSKERIRM

SEQ ID NO: 6312 - protein, 8 aa, Artificial Sequence
  Description of Artificial Sequence: Synthetic peptide
  Seed: HAKERIRF (GTF2I L424H)
HSKERIRV

SEQ ID NO: 6313 - protein, 8 aa, Artificial Sequence
  Description of Artificial Sequence: Synthetic peptide
  Seed: HAKERIRF (GTF2I L424H)
HSKERIRY

SEQ ID NO: 6314 - protein, 8 aa, Artificial Sequence
  Description of Artificial Sequence: Synthetic peptide
  Seed: HAKERIRF (GTF2I L424H)
HTKERIRF

SEQ ID NO: 6315 - protein, 9 aa, Artificial Sequence
  Description of Artificial Sequence: Synthetic peptide
  Seed: HAKERIRFV (GTF2I L424H)
HTKERIRFW

SEQ ID NO: 6316 - protein, 8 aa, Artificial Sequence
  Description of Artificial Sequence: Synthetic peptide
  Seed: HAKERIRF (GTF2I L424H)
HTKERIRI

SEQ ID NO: 6317 - protein, 8 aa, Artificial Sequence
  Description of Artificial Sequence: Synthetic peptide
  Seed: HAKERIRF (GTF2I L424H)
HTKERIRL

SEQ ID NO: 6318 - protein, 8 aa, Artificial Sequence
  Description of Artificial Sequence: Synthetic peptide
  Seed: HAKERIRF (GTF2I L424H)
HTKERIRM

SEQ ID NO: 6319 - protein, 8 aa, Artificial Sequence
  Description of Artificial Sequence: Synthetic peptide
  Seed: HAKERIRF (GTF2I L424H)
HTKERIRV

SEQ ID NO: 6320 - protein, 8 aa, Artificial Sequence
  Description of Artificial Sequence: Synthetic peptide
  Seed: HAKERIRF (GTF2I L424H)
HTKERIRY

SEQ ID NO: 6321 - protein, 8 aa, Artificial Sequence
  Description of Artificial Sequence: Synthetic peptide
  Seed: HAKERIRF (GTF2I L424H)
HVKERIRF

SEQ ID NO: 6322 - protein, 9 aa, Artificial Sequence
  Description of Artificial Sequence: Synthetic peptide
  Seed: HAKERIRFV (GTF2I L424H)
HVKERIRFH

SEQ ID NO: 6323 - protein, 9 aa, Artificial Sequence
  Description of Artificial Sequence: Synthetic peptide
  Seed: HAKERIRFV (GTF2I L424H)
HVKERIRFW

SEQ ID NO: 6324 - protein, 8 aa, Artificial Sequence
  Description of Artificial Sequence: Synthetic peptide
  Seed: HAKERIRF (GTF2I L424H)
HVKERIRI

SEQ ID NO: 6325 - protein, 8 aa, Artificial Sequence
  Description of Artificial Sequence: Synthetic peptide
  Seed: HAKERIRF (GTF2I L424H)
HVKERIRL

SEQ ID NO: 6326 - protein, 8 aa, Artificial Sequence
  Description of Artificial Sequence: Synthetic peptide
  Seed: HAKERIRF (GTF2I L424H)
HVKERIRM

SEQ ID NO: 6327 - protein, 8 aa, Artificial Sequence
  Description of Artificial Sequence: Synthetic peptide
  Seed: HAKERIRF (GTF2I L424H)
HVKERIRV

SEQ ID NO: 6328 - protein, 8 aa, Artificial Sequence
  Description of Artificial Sequence: Synthetic peptide
  Seed: HAKERIRF (GTF2I L424H)
HVKERIRY

SEQ ID NO: 6329 - protein, 9 aa, Artificial Sequence
  Description of Artificial Sequence: Synthetic peptide
  Seed: HAKERIRFV (GTF2I L424H)
HWKERIRFF

SEQ ID NO: 6330 - protein, 9 aa, Artificial Sequence
  Description of Artificial Sequence: Synthetic peptide
  Seed: HAKERIRFV (GTF2I L424H)
HWKERIRFY

SEQ ID NO: 6331 - protein, 8 aa, Artificial Sequence
  Description of Artificial Sequence: Synthetic peptide
  Seed: HAKERIRF (GTF2I L424H)
HWKERIRL

SEQ ID NO: 6332 - protein, 8 aa, Artificial Sequence
  Description of Artificial Sequence: Synthetic peptide
  Seed: HAKERIRF (GTF2I L424H)
HYKERIRF

SEQ ID NO: 6333 - protein, 9 aa, Artificial Sequence
  Description of Artificial Sequence: Synthetic peptide
  Seed: HAKERIRFV (GTF2I L424H)
HYKERIRFC

SEQ ID NO: 6334 - protein, 9 aa, Artificial Sequence
  Description of Artificial Sequence: Synthetic peptide
  Seed: HAKERIRFV (GTF2I L424H)
HYKERIRFH

SEQ ID NO: 6335 - protein, 9 aa, Artificial Sequence
  Description of Artificial Sequence: Synthetic peptide
  Seed: HAKERIRFV (GTF2I L424H)
HYKERIRFW

SEQ ID NO: 6336 - protein, 8 aa, Artificial Sequence
  Description of Artificial Sequence: Synthetic peptide
  Seed: HAKERIRF (GTF2I L424H)
HYKERIRL

SEQ ID NO: 6337 - protein, 8 aa, Artificial Sequence
  Description of Artificial Sequence: Synthetic peptide
  Seed: HAKERIRF (GTF2I L424H)
HYKERIRM

SEQ ID NO: 6338 - protein, 8 aa, Artificial Sequence
  Description of Artificial Sequence: Synthetic peptide
  Seed: HAKERIRF (GTF2I L424H)
HYKERIRY

SEQ ID NO: 6339 - protein, 9 aa, Artificial Sequence
  Description of Artificial Sequence: Synthetic peptide
  Seed: ILHAKERIR (GTF2I L424H)
IAHAKERIR

SEQ ID NO: 6340 - protein, 9 aa, Artificial Sequence
  Description of Artificial Sequence: Synthetic peptide
  Seed: ILHAKERIR (GTF2I L424H)
IDHAKERIR

SEQ ID NO: 6341 - protein, 9 aa, Artificial Sequence
  Description of Artificial Sequence: Synthetic peptide
  Seed: ILHAKERIR (GTF2I L424H)
IGHAKERIR

SEQ ID NO: 6342 - protein, 9 aa, Artificial Sequence
  Description of Artificial Sequence: Synthetic peptide
  Seed: ILHAKERIR (GTF2I L424H)
IIHAKERIK

SEQ ID NO: 6343 - protein, 9 aa, Artificial Sequence
  Description of Artificial Sequence: Synthetic peptide
  Seed: ILHAKERIR (GTF2I L424H)
ILHAKERIK

SEQ ID NO: 6344 - protein, 9 aa, Artificial Sequence
  Description of Artificial Sequence: Synthetic peptide
  Seed: ILHAKERIR (GTF2I L424H)
IMHAKERIK

SEQ ID NO: 6345 - protein, 9 aa, Artificial Sequence
  Description of Artificial Sequence: Synthetic peptide
  Seed: ILHAKERIR (GTF2I L424H)
INHAKERIR

SEQ ID NO: 6346 - protein, 9 aa, Artificial Sequence
  Description of Artificial Sequence: Synthetic peptide
  Seed: ILHAKERIR (GTF2I L424H)
IPHAKERIR

SEQ ID NO: 6347 - protein, 10 aa, Artificial Sequence
  Description of Artificial Sequence: Synthetic peptide
  Seed: IPRLERILHA (GTF2I L424H)
IPRLERILHC

SEQ ID NO: 6348 - protein, 10 aa, Artificial Sequence
  Description of Artificial Sequence: Synthetic peptide
  Seed: IPRLERILHA (GTF2I L424H)
IPRLERILHP

SEQ ID NO: 6349 - protein, 10 aa, Artificial Sequence
  Description of Artificial Sequence: Synthetic peptide
  Seed: IPRLERILHA (GTF2I L424H)
IPRLERILHS

SEQ ID NO: 6350 - protein, 10 aa, Artificial Sequence
  Description of Artificial Sequence: Synthetic peptide
  Seed: IPRLERILHA (GTF2I L424H)
IPRLERILHT

SEQ ID NO: 6351 - protein, 9 aa, Artificial Sequence
  Description of Artificial Sequence: Synthetic peptide
  Seed: ILHAKERIR (GTF2I L424H)
IQHAKERIR

SEQ ID NO: 6352 - protein, 9 aa, Artificial Sequence
  Description of Artificial Sequence: Synthetic peptide
  Seed: ILHAKERIR (GTF2I L424H)
ITHAKERIK

SEQ ID NO: 6353 - protein, 9 aa, Artificial Sequence
  Description of Artificial Sequence: Synthetic peptide
  Seed: ILHAKERIR (GTF2I L424H)
IVHAKERIK

SEQ ID NO: 6354 - protein, 9 aa, Artificial Sequence
  Description of Artificial Sequence: Synthetic peptide
  Seed: ILHAKERIR (GTF2I L424H)
IWHAKERIR

SEQ ID NO: 6355 - protein, 9 aa, Artificial Sequence
  Description of Artificial Sequence: Synthetic peptide
  Seed: PRLERILHA (GTF2I L424H)
PHLERILHA

SEQ ID NO: 6356 - protein, 9 aa, Artificial Sequence
  Description of Artificial Sequence: Synthetic peptide
  Seed: PRLERILHA (GTF2I L424H)
PHLERILHI

SEQ ID NO: 6357 - protein, 9 aa, Artificial Sequence
  Description of Artificial Sequence: Synthetic peptide
  Seed: PRLERILHA (GTF2I L424H)
PHLERILHL

SEQ ID NO: 6358 - protein, 9 aa, Artificial Sequence
  Description of Artificial Sequence: Synthetic peptide
  Seed: PRLERILHA (GTF2I L424H)
PHLERILHV

SEQ ID NO: 6359 - protein, 9 aa, Artificial Sequence
  Description of Artificial Sequence: Synthetic peptide
  Seed: PRLERILHA (GTF2I L424H)
PQLERILHA

SEQ ID NO: 6360 - protein, 9 aa, Artificial Sequence
  Description of Artificial Sequence: Synthetic peptide
  Seed: PRLERILHA (GTF2I L424H)
PQLERILHV

SEQ ID NO: 6361 - protein, 9 aa, Artificial Sequence
  Description of Artificial Sequence: Synthetic peptide
  Seed: PRLERILHA (GTF2I L424H)
PRLERILHV

SEQ ID NO: 6362 - protein, 9 aa, Artificial Sequence
  Description of Artificial Sequence: Synthetic peptide
  Seed: RILHAKERI (GTF2I L424H)
RALHAKERF

SEQ ID NO: 6363 - protein, 9 aa, Artificial Sequence
  Description of Artificial Sequence: Synthetic peptide
  Seed: RILHAKERI (GTF2I L424H)
RALHAKERI

SEQ ID NO: 6364 - protein, 10 aa, Artificial Sequence
  Description of Artificial Sequence: Synthetic peptide
  Seed: RILHAKERIR (GTF2I L424H)
RALHAKERIK

SEQ ID NO: 6365 - protein, 11 aa, Artificial Sequence
  Description of Artificial Sequence: Synthetic peptide
  Seed: RILHAKERIRF (GTF2I L424H)
RALHAKERIRF

SEQ ID NO: 6366 - protein, 11 aa, Artificial Sequence
  Description of Artificial Sequence: Synthetic peptide
  Seed: RILHAKERIRF (GTF2I L424H)
RALHAKERIRW

SEQ ID NO: 6367 - protein, 11 aa, Artificial Sequence
  Description of Artificial Sequence: Synthetic peptide
  Seed: RILHAKERIRF (GTF2I L424H)
RALHAKERIRY

SEQ ID NO: 6368 - protein, 9 aa, Artificial Sequence
  Description of Artificial Sequence: Synthetic peptide
  Seed: RILHAKERI (GTF2I L424H)
RALHAKERL

SEQ ID NO: 6369 - protein, 9 aa, Artificial Sequence
  Description of Artificial Sequence: Synthetic peptide
  Seed: RILHAKERI (GTF2I L424H)
RALHAKERM

SEQ ID NO: 6370 - protein, 9 aa, Artificial Sequence
  Description of Artificial Sequence: Synthetic peptide
  Seed: RILHAKERI (GTF2I L424H)
RALHAKERV

SEQ ID NO: 6371 - protein, 9 aa, Artificial Sequence
  Description of Artificial Sequence: Synthetic peptide
  Seed: RILHAKERI (GTF2I L424H)
RALHAKERY

SEQ ID NO: 6372 - protein, 11 aa, Artificial Sequence
  Description of Artificial Sequence: Synthetic peptide
  Seed: RILHAKERIRF (GTF2I L424H)
RCLHAKERIRY

SEQ ID NO: 6373 - protein, 9 aa, Artificial Sequence
  Description of Artificial Sequence: Synthetic peptide
  Seed: RILHAKERI (GTF2I L424H)
RCLHAKERW

SEQ ID NO: 6374 - protein, 9 aa, Artificial Sequence
  Description of Artificial Sequence: Synthetic peptide
  Seed: RILHAKERI (GTF2I L424H)
RDLHAKERF

SEQ ID NO: 6375 - protein, 9 aa, Artificial Sequence
  Description of Artificial Sequence: Synthetic peptide
  Seed: RILHAKERI (GTF2I L424H)
RDLHAKERI

SEQ ID NO: 6376 - protein, 9 aa, Artificial Sequence
  Description of Artificial Sequence: Synthetic peptide
  Seed: RILHAKERI (GTF2I L424H)
RDLHAKERL

SEQ ID NO: 6377 - protein, 9 aa, Artificial Sequence
  Description of Artificial Sequence: Synthetic peptide
  Seed: RILHAKERI (GTF2I L424H)
RDLHAKERV

SEQ ID NO: 6378 - protein, 9 aa, Artificial Sequence
  Description of Artificial Sequence: Synthetic peptide
  Seed: RLERILHAK (GTF2I L424H)
REERILHAR

SEQ ID NO: 6379 - protein, 9 aa, Artificial Sequence
  Description of Artificial Sequence: Synthetic peptide
  Seed: RILHAKERI (GTF2I L424H)
RELHAKERF

SEQ ID NO: 6380 - protein, 9 aa, Artificial Sequence
  Description of Artificial Sequence: Synthetic peptide
  Seed: RILHAKERI (GTF2I L424H)
RELHAKERI

SEQ ID NO: 6381 - protein, 11 aa, Artificial Sequence
  Description of Artificial Sequence: Synthetic peptide
  Seed: RILHAKERIRF (GTF2I L424H)
RELHAKERIRY

SEQ ID NO: 6382 - protein, 9 aa, Artificial Sequence
  Description of Artificial Sequence: Synthetic peptide
  Seed: RILHAKERI (GTF2I L424H)
RELHAKERL

SEQ ID NO: 6383 - protein, 9 aa, Artificial Sequence
  Description of Artificial Sequence: Synthetic peptide
  Seed: RILHAKERI (GTF2I L424H)
RELHAKERM

SEQ ID NO: 6384 - protein, 9 aa, Artificial Sequence
  Description of Artificial Sequence: Synthetic peptide
  Seed: RILHAKERI (GTF2I L424H)
RELHAKERV

SEQ ID NO: 6385 - protein, 9 aa, Artificial Sequence
  Description of Artificial Sequence: Synthetic peptide
  Seed: RILHAKERI (GTF2I L424H)
RELHAKERW

SEQ ID NO: 6386 - protein, 11 aa, Artificial Sequence
  Description of Artificial Sequence: Synthetic peptide
  Seed: RILHAKERIRF (GTF2I L424H)
RFLHAKERIRF

SEQ ID NO: 6387 - protein, 11 aa, Artificial Sequence
  Description of Artificial Sequence: Synthetic peptide
  Seed: RILHAKERIRF (GTF2I L424H)
RFLHAKERIRY

SEQ ID NO: 6388 - protein, 9 aa, Artificial Sequence
  Description of Artificial Sequence: Synthetic peptide
  Seed: RILHAKERI (GTF2I L424H)
RFLHAKERW

SEQ ID NO: 6389 - protein, 9 aa, Artificial Sequence
  Description of Artificial Sequence: Synthetic peptide
  Seed: RILHAKERI (GTF2I L424H)
RGLHAKERF

SEQ ID NO: 6390 - protein, 11 aa, Artificial Sequence
  Description of Artificial Sequence: Synthetic peptide
  Seed: RILHAKERIRF (GTF2I L424H)
RGLHAKERIRW

SEQ ID NO: 6391 - protein, 11 aa, Artificial Sequence
  Description of Artificial Sequence: Synthetic peptide
  Seed: RILHAKERIRF (GTF2I L424H)
RGLHAKERIRY

SEQ ID NO: 6392 - protein, 9 aa, Artificial Sequence
  Description of Artificial Sequence: Synthetic peptide
  Seed: RILHAKERI (GTF2I L424H)
RGLHAKERV

SEQ ID NO: 6393 - protein, 9 aa, Artificial Sequence
  Description of Artificial Sequence: Synthetic peptide
  Seed: RILHAKERI (GTF2I L424H)
RGLHAKERW

SEQ ID NO: 6394 - protein, 9 aa, Artificial Sequence
  Description of Artificial Sequence: Synthetic peptide
  Seed: RILHAKERI (GTF2I L424H)
RGLHAKERY

SEQ ID NO: 6395 - protein, 9 aa, Artificial Sequence
  Description of Artificial Sequence: Synthetic peptide
  Seed: RLERILHAK (GTF2I L424H)
RIERILHAL

SEQ ID NO: 6396 - protein, 9 aa, Artificial Sequence
  Description of Artificial Sequence: Synthetic peptide
  Seed: RLERILHAK (GTF2I L424H)
RIERILHAY

SEQ ID NO: 6397 - protein, 11 aa, Artificial Sequence
  Description of Artificial Sequence: Synthetic peptide
  Seed: RILHAKERIRF (GTF2I L424H)
RILHAKERIRL

SEQ ID NO: 6398 - protein, 11 aa, Artificial Sequence
  Description of Artificial Sequence: Synthetic peptide
  Seed: RILHAKERIRF (GTF2I L424H)
RILHAKERIRW

SEQ ID NO: 6399 - protein, 11 aa, Artificial Sequence
  Description of Artificial Sequence: Synthetic peptide
  Seed: RILHAKERIRF (GTF2I L424H)
RILHAKERIRY

SEQ ID NO: 6400 - protein, 9 aa, Artificial Sequence
  Description of Artificial Sequence: Synthetic peptide
  Seed: RILHAKERI (GTF2I L424H)
RILHAKERL

SEQ ID NO: 6401 - protein, 9 aa, Artificial Sequence
  Description of Artificial Sequence: Synthetic peptide
  Seed: RILHAKERI (GTF2I L424H)
RILHAKERM

SEQ ID NO: 6402 - protein, 9 aa, Artificial Sequence
  Description of Artificial Sequence: Synthetic peptide
  Seed: RILHAKERI (GTF2I L424H)
RILHAKERV

SEQ ID NO: 6403 - protein, 9 aa, Artificial Sequence
  Description of Artificial Sequence: Synthetic peptide
  Seed: RILHAKERI (GTF2I L424H)
RILHAKERY

SEQ ID NO: 6404 - protein, 9 aa, Artificial Sequence
  Description of Artificial Sequence: Synthetic peptide
  Seed: RLERILHAK (GTF2I L424H)
RLERILHAF

SEQ ID NO: 6405 - protein, 9 aa, Artificial Sequence
  Description of Artificial Sequence: Synthetic peptide
  Seed: RLERILHAK (GTF2I L424H)
RLERILHAI

SEQ ID NO: 6406 - protein, 9 aa, Artificial Sequence
  Description of Artificial Sequence: Synthetic peptide
  Seed: RLERILHAK (GTF2I L424H)
RLERILHAL

SEQ ID NO: 6407 - protein, 9 aa, Artificial Sequence
  Description of Artificial Sequence: Synthetic peptide
  Seed: RLERILHAK (GTF2I L424H)
RLERILHAM

SEQ ID NO: 6408 - protein, 9 aa, Artificial Sequence
  Description of Artificial Sequence: Synthetic peptide
  Seed: RLERILHAK (GTF2I L424H)
RLERILHAV

SEQ ID NO: 6409 - protein, 9 aa, Artificial Sequence
  Description of Artificial Sequence: Synthetic peptide
  Seed: RLERILHAK (GTF2I L424H)
RLERILHAY

SEQ ID NO: 6410 - protein, 11 aa, Artificial Sequence
  Description of Artificial Sequence: Synthetic peptide
  Seed: RILHAKERIRF (GTF2I L424H)
RLLHAKERIRF

SEQ ID NO: 6411 - protein, 11 aa, Artificial Sequence
  Description of Artificial Sequence: Synthetic peptide
  Seed: RILHAKERIRF (GTF2I L424H)
RLLHAKERIRL

SEQ ID NO: 6412 - protein, 11 aa, Artificial Sequence
  Description of Artificial Sequence: Synthetic peptide
  Seed: RILHAKERIRF (GTF2I L424H)
RLLHAKERIRW

SEQ ID NO: 6413 - protein, 11 aa, Artificial Sequence
  Description of Artificial Sequence: Synthetic peptide
  Seed: RILHAKERIRF (GTF2I L424H)
RLLHAKERIRY

SEQ ID NO: 6414 - protein, 9 aa, Artificial Sequence
  Description of Artificial Sequence: Synthetic peptide
  Seed: RILHAKERI (GTF2I L424H)
RLLHAKERM

SEQ ID NO: 6415 - protein, 9 aa, Artificial Sequence
  Description of Artificial Sequence: Synthetic peptide
  Seed: RILHAKERI (GTF2I L424H)
RLLHAKERV

SEQ ID NO: 6416 - protein, 9 aa, Artificial Sequence
  Description of Artificial Sequence: Synthetic peptide
  Seed: RILHAKERI (GTF2I L424H)
RLLHAKERY

SEQ ID NO: 6417 - protein, 9 aa, Artificial Sequence
  Description of Artificial Sequence: Synthetic peptide
  Seed: RLERILHAK (GTF2I L424H)
RMERILHAF

SEQ ID NO: 6418 - protein, 9 aa, Artificial Sequence
  Description of Artificial Sequence: Synthetic peptide
  Seed: RLERILHAK (GTF2I L424H)
RMERILHAI

SEQ ID NO: 6419 - protein, 9 aa, Artificial Sequence
  Description of Artificial Sequence: Synthetic peptide
  Seed: RLERILHAK (GTF2I L424H)
RMERILHAL

SEQ ID NO: 6420 - protein, 9 aa, Artificial Sequence
  Description of Artificial Sequence: Synthetic peptide
  Seed: RLERILHAK (GTF2I L424H)
RMERILHAM

SEQ ID NO: 6421 - protein, 9 aa, Artificial Sequence
  Description of Artificial Sequence: Synthetic peptide
  Seed: RLERILHAK (GTF2I L424H)
RMERILHAV

SEQ ID NO: 6422 - protein, 9 aa, Artificial Sequence
  Description of Artificial Sequence: Synthetic peptide
  Seed: RLERILHAK (GTF2I L424H)
RMERILHAY

SEQ ID NO: 6423 - protein, 11 aa, Artificial Sequence
  Description of Artificial Sequence: Synthetic peptide
  Seed: RILHAKERIRF (GTF2I L424H)
RMLHAKERIRF

SEQ ID NO: 6424 - protein, 11 aa, Artificial Sequence
  Description of Artificial Sequence: Synthetic peptide
  Seed: RILHAKERIRF (GTF2I L424H)
RMLHAKERIRL

SEQ ID NO: 6425 - protein, 11 aa, Artificial Sequence
  Description of Artificial Sequence: Synthetic peptide
  Seed: RILHAKERIRF (GTF2I L424H)
RMLHAKERIRM

SEQ ID NO: 6426 - protein, 11 aa, Artificial Sequence
  Description of Artificial Sequence: Synthetic peptide
  Seed: RILHAKERIRF (GTF2I L424H)
RMLHAKERIRW

SEQ ID NO: 6427 - protein, 11 aa, Artificial Sequence
  Description of Artificial Sequence: Synthetic peptide
  Seed: RILHAKERIRF (GTF2I L424H)
RMLHAKERIRY

SEQ ID NO: 6428 - protein, 9 aa, Artificial Sequence
  Description of Artificial Sequence: Synthetic peptide
  Seed: RILHAKERI (GTF2I L424H)
RMLHAKERM

SEQ ID NO: 6429 - protein, 9 aa, Artificial Sequence
  Description of Artificial Sequence: Synthetic peptide
  Seed: RILHAKERI (GTF2I L424H)
RMLHAKERV

SEQ ID NO: 6430 - protein, 9 aa, Artificial Sequence
  Description of Artificial Sequence: Synthetic peptide
  Seed: RILHAKERI (GTF2I L424H)
RNLHAKERF

SEQ ID NO: 6431 - protein, 9 aa, Artificial Sequence
  Description of Artificial Sequence: Synthetic peptide
  Seed: RILHAKERI (GTF2I L424H)
RNLHAKERI

SEQ ID NO: 6432 - protein, 11 aa, Artificial Sequence
  Description of Artificial Sequence: Synthetic peptide
  Seed: RILHAKERIRF (GTF2I L424H)
RNLHAKERIRW

SEQ ID NO: 6433 - protein, 11 aa, Artificial Sequence
  Description of Artificial Sequence: Synthetic peptide
  Seed: RILHAKERIRF (GTF2I L424H)
RNLHAKERIRY

SEQ ID NO: 6434 - protein, 9 aa, Artificial Sequence
  Description of Artificial Sequence: Synthetic peptide
  Seed: RILHAKERI (GTF2I L424H)
RNLHAKERL

SEQ ID NO: 6435 - protein, 9 aa, Artificial Sequence
  Description of Artificial Sequence: Synthetic peptide
  Seed: RILHAKERI (GTF2I L424H)
RNLHAKERV

SEQ ID NO: 6436 - protein, 9 aa, Artificial Sequence
  Description of Artificial Sequence: Synthetic peptide
  Seed: RILHAKERI (GTF2I L424H)
RNLHAKERW

SEQ ID NO: 6437 - protein, 9 aa, Artificial Sequence
  Description of Artificial Sequence: Synthetic peptide
  Seed: RILHAKERI (GTF2I L424H)
RNLHAKERY

SEQ ID NO: 6438 - protein, 9 aa, Artificial Sequence
  Description of Artificial Sequence: Synthetic peptide
  Seed: RILHAKERI (GTF2I L424H)
RQLHAKERA

SEQ ID NO: 6439 - protein, 9 aa, Artificial Sequence
  Description of Artificial Sequence: Synthetic peptide
  Seed: RILHAKERI (GTF2I L424H)
RQLHAKERC

SEQ ID NO: 6440 - protein, 9 aa, Artificial Sequence
  Description of Artificial Sequence: Synthetic peptide
  Seed: RILHAKERI (GTF2I L424H)
RQLHAKERF

SEQ ID NO: 6441 - protein, 9 aa, Artificial Sequence
  Description of Artificial Sequence: Synthetic peptide
  Seed: RILHAKERI (GTF2I L424H)
RQLHAKERI

SEQ ID NO: 6442 - protein, 11 aa, Artificial Sequence
  Description of Artificial Sequence: Synthetic peptide
  Seed: RILHAKERIRF (GTF2I L424H)
RQLHAKERIRF

SEQ ID NO: 6443 - protein, 11 aa, Artificial Sequence
  Description of Artificial Sequence: Synthetic peptide
  Seed: RILHAKERIRF (GTF2I L424H)
RQLHAKERIRW

SEQ ID NO: 6444 - protein, 11 aa, Artificial Sequence
  Description of Artificial Sequence: Synthetic peptide
  Seed: RILHAKERIRF (GTF2I L424H)
RQLHAKERIRY

SEQ ID NO: 6445 - protein, 9 aa, Artificial Sequence
  Description of Artificial Sequence: Synthetic peptide
  Seed: RILHAKERI (GTF2I L424H)
RQLHAKERM

SEQ ID NO: 6446 - protein, 9 aa, Artificial Sequence
  Description of Artificial Sequence: Synthetic peptide
  Seed: RILHAKERI (GTF2I L424H)
RQLHAKERT

SEQ ID NO: 6447 - protein, 9 aa, Artificial Sequence
  Description of Artificial Sequence: Synthetic peptide
  Seed: RILHAKERI (GTF2I L424H)
RQLHAKERY

SEQ ID NO: 6448 - protein, 9 aa, Artificial Sequence
  Description of Artificial Sequence: Synthetic peptide
  Seed: RILHAKERI (GTF2I L424H)
RSLHAKERI

SEQ ID NO: 6449 - protein, 10 aa, Artificial Sequence
  Description of Artificial Sequence: Synthetic peptide
  Seed: RILHAKERIR (GTF2I L424H)
RSLHAKERIK

SEQ ID NO: 6450 - protein, 11 aa, Artificial Sequence
  Description of Artificial Sequence: Synthetic peptide
  Seed: RILHAKERIRF (GTF2I L424H)
RSLHAKERIRF

SEQ ID NO: 6451 - protein, 11 aa, Artificial Sequence
  Description of Artificial Sequence: Synthetic peptide
  Seed: RILHAKERIRF (GTF2I L424H)
RSLHAKERIRL

SEQ ID NO: 6452 - protein, 11 aa, Artificial Sequence
  Description of Artificial Sequence: Synthetic peptide
  Seed: RILHAKERIRF (GTF2I L424H)
RSLHAKERIRW

SEQ ID NO: 6453 - protein, 11 aa, Artificial Sequence
  Description of Artificial Sequence: Synthetic peptide
  Seed: RILHAKERIRF (GTF2I L424H)
RSLHAKERIRY

SEQ ID NO: 6454 - protein, 9 aa, Artificial Sequence
  Description of Artificial Sequence: Synthetic peptide
  Seed: RILHAKERI (GTF2I L424H)
RSLHAKERL

SEQ ID NO: 6455 - protein, 9 aa, Artificial Sequence
  Description of Artificial Sequence: Synthetic peptide
  Seed: RILHAKERI (GTF2I L424H)
RSLHAKERM

SEQ ID NO: 6456 - protein, 9 aa, Artificial Sequence
  Description of Artificial Sequence: Synthetic peptide
  Seed: RILHAKERI (GTF2I L424H)
RSLHAKERV

SEQ ID NO: 6457 - protein, 9 aa, Artificial Sequence
  Description of Artificial Sequence: Synthetic peptide
  Seed: RILHAKERI (GTF2I L424H)
RSLHAKERY

SEQ ID NO: 6458 - protein, 9 aa, Artificial Sequence
  Description of Artificial Sequence: Synthetic peptide
  Seed: RLERILHAK (GTF2I L424H)
RTERILHAL

SEQ ID NO: 6459 - protein, 9 aa, Artificial Sequence
  Description of Artificial Sequence: Synthetic peptide
  Seed: RLERILHAK (GTF2I L424H)
RTERILHAY

SEQ ID NO: 6460 - protein, 11 aa, Artificial Sequence
  Description of Artificial Sequence: Synthetic peptide
  Seed: RILHAKERIRF (GTF2I L424H)
RTLHAKERIRF

SEQ ID NO: 6461 - protein, 11 aa, Artificial Sequence
  Description of Artificial Sequence: Synthetic peptide
  Seed: RILHAKERIRF (GTF2I L424H)
RTLHAKERIRI

SEQ ID NO: 6462 - protein, 11 aa, Artificial Sequence
  Description of Artificial Sequence: Synthetic peptide
  Seed: RILHAKERIRF (GTF2I L424H)
RTLHAKERIRL

SEQ ID NO: 6463 - protein, 11 aa, Artificial Sequence
  Description of Artificial Sequence: Synthetic peptide
  Seed: RILHAKERIRF (GTF2I L424H)
RTLHAKERIRM

SEQ ID NO: 6464 - protein, 11 aa, Artificial Sequence
  Description of Artificial Sequence: Synthetic peptide
  Seed: RILHAKERIRF (GTF2I L424H)
RTLHAKERIRW

SEQ ID NO: 6465 - protein, 11 aa, Artificial Sequence
  Description of Artificial Sequence: Synthetic peptide
  Seed: RILHAKERIRF (GTF2I L424H)
RTLHAKERIRY

SEQ ID NO: 6466 - protein, 9 aa, Artificial Sequence
  Description of Artificial Sequence: Synthetic peptide
  Seed: RILHAKERI (GTF2I L424H)
RTLHAKERM

SEQ ID NO: 6467 - protein, 9 aa, Artificial Sequence
  Description of Artificial Sequence: Synthetic peptide
  Seed: RILHAKERI (GTF2I L424H)
RTLHAKERV

SEQ ID NO: 6468 - protein, 9 aa, Artificial Sequence
  Description of Artificial Sequence: Synthetic peptide
  Seed: RLERILHAK (GTF2I L424H)
RVERILHAL

SEQ ID NO: 6469 - protein, 9 aa, Artificial Sequence
  Description of Artificial Sequence: Synthetic peptide
  Seed: RLERILHAK (GTF2I L424H)
RVERILHAY

SEQ ID NO: 6470 - protein, 11 aa, Artificial Sequence
  Description of Artificial Sequence: Synthetic peptide
  Seed: RILHAKERIRF (GTF2I L424H)
RVLHAKERIRF

SEQ ID NO: 6471 - protein, 11 aa, Artificial Sequence
  Description of Artificial Sequence: Synthetic peptide
  Seed: RILHAKERIRF (GTF2I L424H)
RVLHAKERIRL

SEQ ID NO: 6472 - protein, 11 aa, Artificial Sequence
  Description of Artificial Sequence: Synthetic peptide
  Seed: RILHAKERIRF (GTF2I L424H)
RVLHAKERIRM

SEQ ID NO: 6473 - protein, 11 aa, Artificial Sequence
  Description of Artificial Sequence: Synthetic peptide
  Seed: RILHAKERIRF (GTF2I L424H)
RVLHAKERIRW

SEQ ID NO: 6474 - protein, 9 aa, Artificial Sequence
  Description of Artificial Sequence: Synthetic peptide
  Seed: RILHAKERI (GTF2I L424H)
RVLHAKERM

SEQ ID NO: 6475 - protein, 9 aa, Artificial Sequence
  Description of Artificial Sequence: Synthetic peptide
  Seed: RILHAKERI (GTF2I L424H)
RVLHAKERV

SEQ ID NO: 6476 - protein, 9 aa, Artificial Sequence
  Description of Artificial Sequence: Synthetic peptide
  Seed: RILHAKERI (GTF2I L424H)
RVLHAKERY

SEQ ID NO: 6477 - protein, 11 aa, Artificial Sequence
  Description of Artificial Sequence: Synthetic peptide
  Seed: RILHAKERIRF (GTF2I L424H)
RWLHAKERIRF

SEQ ID NO: 6478 - protein, 11 aa, Artificial Sequence
  Description of Artificial Sequence: Synthetic peptide
  Seed: RILHAKERIRF (GTF2I L424H)
RWLHAKERIRY

SEQ ID NO: 6479 - protein, 11 aa, Artificial Sequence
  Description of Artificial Sequence: Synthetic peptide
  Seed: RILHAKERIRF (GTF2I L424H)
RYLHAKERIRF

SEQ ID NO: 6480 - protein, 11 aa, Artificial Sequence
  Description of Artificial Sequence: Synthetic peptide
  Seed: RILHAKERIRF (GTF2I L424H)
RYLHAKERIRW

SEQ ID NO: 6481 - protein, 11 aa, Artificial Sequence
  Description of Artificial Sequence: Synthetic peptide
  Seed: RILHAKERIRF (GTF2I L424H)
RYLHAKERIRY

SEQ ID NO: 6482 - protein, 9 aa, Homo sapiens
  Native (GTF2I L424H)
HAKERIRFV

SEQ ID NO: 6483 - protein, 10 aa, Homo sapiens
  Native (GTF2I L424H)
HAKERIRFVI

SEQ ID NO: 6484 - protein, 11 aa, Homo sapiens
  Native (GTF2I L424H)
HAKERIRFVIK

SEQ ID NO: 6485 - protein, 9 aa, Homo sapiens
  Native (GTF2I L424H)
ILHAKERIR

SEQ ID NO: 6486 - protein, 11 aa, Homo sapiens
  Native (GTF2I L424H)
ILHAKERIRFV

SEQ ID NO: 6487 - protein, 10 aa, Homo sapiens
  Native (GTF2I L424H)
IPRLERILHA

SEQ ID NO: 6488 - protein, 10 aa, Homo sapiens
  Native (GTF2I L424H)
PRLERILHAK

SEQ ID NO: 6489 - protein, 8 aa, Homo sapiens
  Native (GTF2I L424H)
RILHAKER

SEQ ID NO: 6490 - protein, 9 aa, Homo sapiens
  Native (GTF2I L424H)
RILHAKERI

SEQ ID NO: 6491 - protein, 10 aa, Homo sapiens
  Native (GTF2I L424H)
RILHAKERIR

SEQ ID NO: 6492 - protein, 9 aa, Homo sapiens
  Native (GTF2I L424H)
RLERILHAK

SEQ ID NO: 6493 - protein, 11 aa, Homo sapiens
  Native (GTF2I L424H)
RLERILHAKER

SEQ ID NO: 6494 - protein, 9 aa, Homo sapiens
  Native (GTF2I L424H)
ERILHAKER

SEQ ID NO: 6495 - protein, 10 aa, Homo sapiens
  Native (GTF2I L424H)
ERILHAKERI

SEQ ID NO: 6496 - protein, 8 aa, Homo sapiens
  Native (GTF2I L424H)
HAKERIRF

SEQ ID NO: 6497 - protein, 9 aa, Homo sapiens
  Native (GTF2I L424H)
PRLERILHA

SEQ ID NO: 6498 - protein, 11 aa, Homo sapiens
  Native (GTF2I L424H)
RILHAKERIRF

SEQ ID NO: 6499 - protein, 10 aa, Artificial Sequence
  Description of Artificial Sequence: Synthetic peptide
  Seed: IGCHAYGDQY (IDH1 R132C)
IACHAYGDQY

SEQ ID NO: 6500 - protein, 11 aa, Artificial Sequence
  Description of Artificial Sequence: Synthetic peptide
  Seed: IGCHAYGDQYR (IDH1 R132C)
IACHAYGDQYR

SEQ ID NO: 6501 - protein, 8 aa, Artificial Sequence
  Description of Artificial Sequence: Synthetic peptide
  Seed: IIIGCHAY (IDH1 R132C)
IAIGCHAY

SEQ ID NO: 6502 - protein, 10 aa, Artificial Sequence
  Description of Artificial Sequence: Synthetic peptide
  Seed: IGCHAYGDQY (IDH1 R132C)
IFCHAYGDQY

SEQ ID NO: 6503 - protein, 11 aa, Artificial Sequence
  Description of Artificial Sequence: Synthetic peptide
  Seed: IGCHAYGDQYR (IDH1 R132C)
IFCHAYGDQYK

SEQ ID NO: 6504 - protein, 11 aa, Artificial Sequence
  Description of Artificial Sequence: Synthetic peptide
  Seed: IGCHAYGDQYR (IDH1 R132C)
IFCHAYGDQYR

SEQ ID NO: 6505 - protein, 10 aa, Artificial Sequence
  Description of Artificial Sequence: Synthetic peptide
  Seed: IGCHAYGDQY (IDH1 R132C)
IICHAYGDQY

SEQ ID NO: 6506 - protein, 11 aa, Artificial Sequence
  Description of Artificial Sequence: Synthetic peptide
  Seed: IGCHAYGDQYR (IDH1 R132C)
IICHAYGDQYR

SEQ ID NO: 6507 - protein, 10 aa, Artificial Sequence
  Description of Artificial Sequence: Synthetic peptide
  Seed: IGCHAYGDQY (IDH1 R132C)
ILCHAYGDQY

SEQ ID NO: 6508 - protein, 11 aa, Artificial Sequence
  Description of Artificial Sequence: Synthetic peptide
  Seed: IGCHAYGDQYR (IDH1 R132C)
ILCHAYGDQYK

SEQ ID NO: 6509 - protein, 11 aa, Artificial Sequence
  Description of Artificial Sequence: Synthetic peptide
  Seed: IGCHAYGDQYR (IDH1 R132C)
ILCHAYGDQYR

SEQ ID NO: 6510 - protein, 8 aa, Artificial Sequence
  Description of Artificial Sequence: Synthetic peptide
  Seed: IIIGCHAY (IDH1 R132C)
ILIGCHAF

SEQ ID NO: 6511 - protein, 8 aa, Artificial Sequence
  Description of Artificial Sequence: Synthetic peptide
  Seed: IIIGCHAY (IDH1 R132C)
ILIGCHAY

SEQ ID NO: 6512 - protein, 10 aa, Artificial Sequence
  Description of Artificial Sequence: Synthetic peptide
  Seed: IGCHAYGDQY (IDH1 R132C)
IMCHAYGDQY

SEQ ID NO: 6513 - protein, 11 aa, Artificial Sequence
  Description of Artificial Sequence: Synthetic peptide
  Seed: IGCHAYGDQYR (IDH1 R132C)
IMCHAYGDQYK

SEQ ID NO: 6514 - protein, 11 aa, Artificial Sequence
  Description of Artificial Sequence: Synthetic peptide
  Seed: IGCHAYGDQYR (IDH1 R132C)
IMCHAYGDQYR

SEQ ID NO: 6515 - protein, 8 aa, Artificial Sequence
  Description of Artificial Sequence: Synthetic peptide
  Seed: IIIGCHAY (IDH1 R132C)
IMIGCHAF

SEQ ID NO: 6516 - protein, 8 aa, Artificial Sequence
  Description of Artificial Sequence: Synthetic peptide
  Seed: IIIGCHAY (IDH1 R132C)
IMIGCHAM

SEQ ID NO: 6517 - protein, 8 aa, Artificial Sequence
  Description of Artificial Sequence: Synthetic peptide
  Seed: IIIGCHAY (IDH1 R132C)
IMIGCHAY

SEQ ID NO: 6518 - protein, 10 aa, Artificial Sequence
  Description of Artificial Sequence: Synthetic peptide
  Seed: IGCHAYGDQY (IDH1 R132C)
INCHAYGDQY

SEQ ID NO: 6519 - protein, 11 aa, Artificial Sequence
  Description of Artificial Sequence: Synthetic peptide
  Seed: IGCHAYGDQYR (IDH1 R132C)
INCHAYGDQYR

SEQ ID NO: 6520 - protein, 10 aa, Artificial Sequence
  Description of Artificial Sequence: Synthetic peptide
  Seed: IGCHAYGDQY (IDH1 R132C)
IQCHAYGDQY

SEQ ID NO: 6521 - protein, 11 aa, Artificial Sequence
  Description of Artificial Sequence: Synthetic peptide
  Seed: IGCHAYGDQYR (IDH1 R132C)
IQCHAYGDQYR

SEQ ID NO: 6522 - protein, 8 aa, Artificial Sequence
  Description of Artificial Sequence: Synthetic peptide
  Seed: IIIGCHAY (IDH1 R132C)
IQIGCHAF

SEQ ID NO: 6523 - protein, 8 aa, Artificial Sequence
  Description of Artificial Sequence: Synthetic peptide
  Seed: IIIGCHAY (IDH1 R132C)
IQIGCHAM

SEQ ID NO: 6524 - protein, 8 aa, Artificial Sequence
  Description of Artificial Sequence: Synthetic peptide
  Seed: IIIGCHAY (IDH1 R132C)
IQIGCHAY

SEQ ID NO: 6525 - protein, 10 aa, Artificial Sequence
  Description of Artificial Sequence: Synthetic peptide
  Seed: IGCHAYGDQY (IDH1 R132C)
ISCHAYGDQY

SEQ ID NO: 6526 - protein, 11 aa, Artificial Sequence
  Description of Artificial Sequence: Synthetic peptide
  Seed: IGCHAYGDQYR (IDH1 R132C)
ISCHAYGDQYR

SEQ ID NO: 6527 - protein, 8 aa, Artificial Sequence
  Description of Artificial Sequence: Synthetic peptide
  Seed: IIIGCHAY (IDH1 R132C)
ISIGCHAF

SEQ ID NO: 6528 - protein, 8 aa, Artificial Sequence
  Description of Artificial Sequence: Synthetic peptide
  Seed: IIIGCHAY (IDH1 R132C)
ISIGCHAY

SEQ ID NO: 6529 - protein, 10 aa, Artificial Sequence
  Description of Artificial Sequence: Synthetic peptide
  Seed: IGCHAYGDQY (IDH1 R132C)
ITCHAYGDQY

SEQ ID NO: 6530 - protein, 11 aa, Artificial Sequence
  Description of Artificial Sequence: Synthetic peptide
  Seed: IGCHAYGDQYR (IDH1 R132C)
ITCHAYGDQYK

SEQ ID NO: 6531 - protein, 11 aa, Artificial Sequence
  Description of Artificial Sequence: Synthetic peptide
  Seed: IGCHAYGDQYR (IDH1 R132C)
ITCHAYGDQYR

SEQ ID NO: 6532 - protein, 8 aa, Artificial Sequence
  Description of Artificial Sequence: Synthetic peptide
  Seed: IIIGCHAY (IDH1 R132C)
ITIGCHAF

SEQ ID NO: 6533 - protein, 8 aa, Artificial Sequence
  Description of Artificial Sequence: Synthetic peptide
  Seed: IIIGCHAY (IDH1 R132C)
ITIGCHAY

SEQ ID NO: 6534 - protein, 10 aa, Artificial Sequence
  Description of Artificial Sequence: Synthetic peptide
  Seed: IGCHAYGDQY (IDH1 R132C)
IVCHAYGDQY

SEQ ID NO: 6535 - protein, 11 aa, Artificial Sequence
  Description of Artificial Sequence: Synthetic peptide
  Seed: IGCHAYGDQYR (IDH1 R132C)
IVCHAYGDQYK

SEQ ID NO: 6536 - protein, 11 aa, Artificial Sequence
  Description of Artificial Sequence: Synthetic peptide
  Seed: IGCHAYGDQYR (IDH1 R132C)
IVCHAYGDQYR

SEQ ID NO: 6537 - protein, 8 aa, Artificial Sequence
  Description of Artificial Sequence: Synthetic peptide
  Seed: IIIGCHAY (IDH1 R132C)
IVIGCHAF

SEQ ID NO: 6538 - protein, 8 aa, Artificial Sequence
  Description of Artificial Sequence: Synthetic peptide
  Seed: IIIGCHAY (IDH1 R132C)
IVIGCHAY

SEQ ID NO: 6539 - protein, 10 aa, Artificial Sequence
  Description of Artificial Sequence: Synthetic peptide
  Seed: IGCHAYGDQY (IDH1 R132C)
IWCHAYGDQY

SEQ ID NO: 6540 - protein, 11 aa, Artificial Sequence
  Description of Artificial Sequence: Synthetic peptide
  Seed: IGCHAYGDQYR (IDH1 R132C)
IWCHAYGDQYK

SEQ ID NO: 6541 - protein, 11 aa, Artificial Sequence
  Description of Artificial Sequence: Synthetic peptide
  Seed: IGCHAYGDQYR (IDH1 R132C)
IWCHAYGDQYR

SEQ ID NO: 6542 - protein, 10 aa, Artificial Sequence
  Description of Artificial Sequence: Synthetic peptide
  Seed: IGCHAYGDQY (IDH1 R132C)
IYCHAYGDQY

SEQ ID NO: 6543 - protein, 11 aa, Artificial Sequence
  Description of Artificial Sequence: Synthetic peptide
  Seed: IGCHAYGDQYR (IDH1 R132C)
IYCHAYGDQYK

SEQ ID NO: 6544 - protein, 11 aa, Artificial Sequence
  Description of Artificial Sequence: Synthetic peptide
  Seed: IGCHAYGDQYR (IDH1 R132C)
IYCHAYGDQYR

SEQ ID NO: 6545 - protein, 10 aa, Artificial Sequence
  Description of Artificial Sequence: Synthetic peptide
  Seed: KPIIIGCHAY (IDH1 R132C)
KAIIIGCHAF

SEQ ID NO: 6546 - protein, 10 aa, Artificial Sequence
  Description of Artificial Sequence: Synthetic peptide
  Seed: KPIIIGCHAY (IDH1 R132C)
KAIIIGCHAM

SEQ ID NO: 6547 - protein, 10 aa, Artificial Sequence
  Description of Artificial Sequence: Synthetic peptide
  Seed: KPIIIGCHAY (IDH1 R132C)
KAIIIGCHAY

SEQ ID NO: 6548 - protein, 10 aa, Artificial Sequence
  Description of Artificial Sequence: Synthetic peptide
  Seed: KPIIIGCHAY (IDH1 R132C)
KCIIIGCHAF

SEQ ID NO: 6549 - protein, 10 aa, Artificial Sequence
  Description of Artificial Sequence: Synthetic peptide
  Seed: KPIIIGCHAY (IDH1 R132C)
KCIIIGCHAY

SEQ ID NO: 6550 - protein, 10 aa, Artificial Sequence
  Description of Artificial Sequence: Synthetic peptide
  Seed: KPIIIGCHAY (IDH1 R132C)
KDIIIGCHAF

SEQ ID NO: 6551 - protein, 10 aa, Artificial Sequence
  Description of Artificial Sequence: Synthetic peptide
  Seed: KPIIIGCHAY (IDH1 R132C)
KDIIIGCHAY

SEQ ID NO: 6552 - protein, 10 aa, Artificial Sequence
  Description of Artificial Sequence: Synthetic peptide
  Seed: KPIIIGCHAY (IDH1 R132C)
KEIIIGCHAF

SEQ ID NO: 6553 - protein, 10 aa, Artificial Sequence
  Description of Artificial Sequence: Synthetic peptide
  Seed: KPIIIGCHAY (IDH1 R132C)
KEIIIGCHAY

SEQ ID NO: 6554 - protein, 10 aa, Artificial Sequence
  Description of Artificial Sequence: Synthetic peptide
  Seed: KPIIIGCHAY (IDH1 R132C)
KFIIIGCHAF

SEQ ID NO: 6555 - protein, 10 aa, Artificial Sequence
  Description of Artificial Sequence: Synthetic peptide
  Seed: KPIIIGCHAY (IDH1 R132C)
KFIIIGCHAY

SEQ ID NO: 6556 - protein, 10 aa, Artificial Sequence
  Description of Artificial Sequence: Synthetic peptide
  Seed: KPIIIGCHAY (IDH1 R132C)
KGIIIGCHAF

SEQ ID NO: 6557 - protein, 10 aa, Artificial Sequence
  Description of Artificial Sequence: Synthetic peptide
  Seed: KPIIIGCHAY (IDH1 R132C)
KGIIIGCHAY

SEQ ID NO: 6558 - protein, 10 aa, Artificial Sequence
  Description of Artificial Sequence: Synthetic peptide
  Seed: KPIIIGCHAY (IDH1 R132C)
KHIIIGCHAF

SEQ ID NO: 6559 - protein, 10 aa, Artificial Sequence
  Description of Artificial Sequence: Synthetic peptide
  Seed: KPIIIGCHAY (IDH1 R132C)
KHIIIGCHAY

SEQ ID NO: 6560 - protein, 10 aa, Artificial Sequence
  Description of Artificial Sequence: Synthetic peptide
  Seed: KPIIIGCHAY (IDH1 R132C)
KIIIIGCHAF

SEQ ID NO: 6561 - protein, 10 aa, Artificial Sequence
  Description of Artificial Sequence: Synthetic peptide
  Seed: KPIIIGCHAY (IDH1 R132C)
KIIIIGCHAM

SEQ ID NO: 6562 - protein, 10 aa, Artificial Sequence
  Description of Artificial Sequence: Synthetic peptide
  Seed: KPIIIGCHAY (IDH1 R132C)
KIIIIGCHAY

SEQ ID NO: 6563 - protein, 10 aa, Artificial Sequence
  Description of Artificial Sequence: Synthetic peptide
  Seed: KPIIIGCHAY (IDH1 R132C)
KKIIIGCHAF

SEQ ID NO: 6564 - protein, 10 aa, Artificial Sequence
  Description of Artificial Sequence: Synthetic peptide
  Seed: KPIIIGCHAY (IDH1 R132C)
KKIIIGCHAY

SEQ ID NO: 6565 - protein, 10 aa, Artificial Sequence
  Description of Artificial Sequence: Synthetic peptide
  Seed: KPIIIGCHAY (IDH1 R132C)
KLIIIGCHAF

SEQ ID NO: 6566 - protein, 10 aa, Artificial Sequence
  Description of Artificial Sequence: Synthetic peptide
  Seed: KPIIIGCHAY (IDH1 R132C)
KLIIIGCHAM

SEQ ID NO: 6567 - protein, 10 aa, Artificial Sequence
  Description of Artificial Sequence: Synthetic peptide
  Seed: KPIIIGCHAY (IDH1 R132C)
KLIIIGCHAY

SEQ ID NO: 6568 - protein, 10 aa, Artificial Sequence
  Description of Artificial Sequence: Synthetic peptide
  Seed: KPIIIGCHAY (IDH1 R132C)
KMIIIGCHAF

SEQ ID NO: 6569 - protein, 10 aa, Artificial Sequence
  Description of Artificial Sequence: Synthetic peptide
  Seed: KPIIIGCHAY (IDH1 R132C)
KMIIIGCHAH

SEQ ID NO: 6570 - protein, 10 aa, Artificial Sequence
  Description of Artificial Sequence: Synthetic peptide
  Seed: KPIIIGCHAY (IDH1 R132C)
KMIIIGCHAI

SEQ ID NO: 6571 - protein, 10 aa, Artificial Sequence
  Description of Artificial Sequence: Synthetic peptide
  Seed: KPIIIGCHAY (IDH1 R132C)
KMIIIGCHAL

SEQ ID NO: 6572 - protein, 10 aa, Artificial Sequence
  Description of Artificial Sequence: Synthetic peptide
  Seed: KPIIIGCHAY (IDH1 R132C)
KMIIIGCHAM

SEQ ID NO: 6573 - protein, 10 aa, Artificial Sequence
  Description of Artificial Sequence: Synthetic peptide
  Seed: KPIIIGCHAY (IDH1 R132C)
KMIIIGCHAW

SEQ ID NO: 6574 - protein, 10 aa, Artificial Sequence
  Description of Artificial Sequence: Synthetic peptide
  Seed: KPIIIGCHAY (IDH1 R132C)
KNIIIGCHAF

SEQ ID NO: 6575 - protein, 10 aa, Artificial Sequence
  Description of Artificial Sequence: Synthetic peptide
  Seed: KPIIIGCHAY (IDH1 R132C)
KNIIIGCHAY

SEQ ID NO: 6576 - protein, 10 aa, Artificial Sequence
  Description of Artificial Sequence: Synthetic peptide
  Seed: KPIIIGCHAY (IDH1 R132C)
KPIIIGCHAF

SEQ ID NO: 6577 - protein, 9 aa, Artificial Sequence
  Description of Artificial Sequence: Synthetic peptide
  Seed: KPIIIGCHA (IDH1 R132C)
KPIIIGCHF

SEQ ID NO: 6578 - protein, 9 aa, Artificial Sequence
  Description of Artificial Sequence: Synthetic peptide
  Seed: KPIIIGCHA (IDH1 R132C)
KPIIIGCHI

SEQ ID NO: 6579 - protein, 9 aa, Artificial Sequence
  Description of Artificial Sequence: Synthetic peptide
  Seed: KPIIIGCHA (IDH1 R132C)
KPIIIGCHM

SEQ ID NO: 6580 - protein, 9 aa, Artificial Sequence
  Description of Artificial Sequence: Synthetic peptide
  Seed: KPIIIGCHA (IDH1 R132C)
KPIIIGCHV

SEQ ID NO: 6581 - protein, 10 aa, Artificial Sequence
  Description of Artificial Sequence: Synthetic peptide
  Seed: KPIIIGCHAY (IDH1 R132C)
KQIIIGCHAF

SEQ ID NO: 6582 - protein, 10 aa, Artificial Sequence
  Description of Artificial Sequence: Synthetic peptide
  Seed: KPIIIGCHAY (IDH1 R132C)
KQIIIGCHAI

SEQ ID NO: 6583 - protein, 10 aa, Artificial Sequence
  Description of Artificial Sequence: Synthetic peptide
  Seed: KPIIIGCHAY (IDH1 R132C)
KQIIIGCHAL

SEQ ID NO: 6584 - protein, 10 aa, Artificial Sequence
  Description of Artificial Sequence: Synthetic peptide
  Seed: KPIIIGCHAY (IDH1 R132C)
KQIIIGCHAM

SEQ ID NO: 6585 - protein, 10 aa, Artificial Sequence
  Description of Artificial Sequence: Synthetic peptide
  Seed: KPIIIGCHAY (IDH1 R132C)
KQIIIGCHAV

SEQ ID NO: 6586 - protein, 10 aa, Artificial Sequence
  Description of Artificial Sequence: Synthetic peptide
  Seed: KPIIIGCHAY (IDH1 R132C)
KQIIIGCHAW

SEQ ID NO: 6587 - protein, 10 aa, Artificial Sequence
  Description of Artificial Sequence: Synthetic peptide
  Seed: KPIIIGCHAY (IDH1 R132C)
KRIIIGCHAF

SEQ ID NO: 6588 - protein, 10 aa, Artificial Sequence
  Description of Artificial Sequence: Synthetic peptide
  Seed: KPIIIGCHAY (IDH1 R132C)
KRIIIGCHAY

SEQ ID NO: 6589 - protein, 10 aa, Artificial Sequence
  Description of Artificial Sequence: Synthetic peptide
  Seed: KPIIIGCHAY (IDH1 R132C)
KSIIIGCHAF

SEQ ID NO: 6590 - protein, 10 aa, Artificial Sequence
  Description of Artificial Sequence: Synthetic peptide
  Seed: KPIIIGCHAY (IDH1 R132C)
KSIIIGCHAM

SEQ ID NO: 6591 - protein, 10 aa, Artificial Sequence
  Description of Artificial Sequence: Synthetic peptide
  Seed: KPIIIGCHAY (IDH1 R132C)
KSIIIGCHAY

SEQ ID NO: 6592 - protein, 10 aa, Artificial Sequence
  Description of Artificial Sequence: Synthetic peptide
  Seed: KPIIIGCHAY (IDH1 R132C)
KTIIIGCHAF

SEQ ID NO: 6593 - protein, 10 aa, Artificial Sequence
  Description of Artificial Sequence: Synthetic peptide
  Seed: KPIIIGCHAY (IDH1 R132C)
KTIIIGCHAM

SEQ ID NO: 6594 - protein, 10 aa, Artificial Sequence
  Description of Artificial Sequence: Synthetic peptide
  Seed: KPIIIGCHAY (IDH1 R132C)
KTIIIGCHAY

SEQ ID NO: 6595 - protein, 10 aa, Artificial Sequence
  Description of Artificial Sequence: Synthetic peptide
  Seed: KPIIIGCHAY (IDH1 R132C)
KVIIIGCHAF

SEQ ID NO: 6596 - protein, 10 aa, Artificial Sequence
  Description of Artificial Sequence: Synthetic peptide
  Seed: KPIIIGCHAY (IDH1 R132C)
KVIIIGCHAM

SEQ ID NO: 6597 - protein, 10 aa, Artificial Sequence
  Description of Artificial Sequence: Synthetic peptide
  Seed: KPIIIGCHAY (IDH1 R132C)
KVIIIGCHAY

SEQ ID NO: 6598 - protein, 10 aa, Artificial Sequence
  Description of Artificial Sequence: Synthetic peptide
  Seed: KPIIIGCHAY (IDH1 R132C)
KWIIIGCHAF

SEQ ID NO: 6599 - protein, 10 aa, Artificial Sequence
  Description of Artificial Sequence: Synthetic peptide
  Seed: KPIIIGCHAY (IDH1 R132C)
KWIIIGCHAY

SEQ ID NO: 6600 - protein, 10 aa, Artificial Sequence
  Description of Artificial Sequence: Synthetic peptide
  Seed: KPIIIGCHAY (IDH1 R132C)
KYIIIGCHAF

SEQ ID NO: 6601 - protein, 10 aa, Artificial Sequence
  Description of Artificial Sequence: Synthetic peptide
  Seed: KPIIIGCHAY (IDH1 R132C)
KYIIIGCHAY

SEQ ID NO: 6602 - protein, 10 aa, Artificial Sequence
  Description of Artificial Sequence: Synthetic peptide
  Seed: VKPIIIGCHA (IDH1 R132C)
VAPIIIGCHA

SEQ ID NO: 6603 - protein, 10 aa, Artificial Sequence
  Description of Artificial Sequence: Synthetic peptide
  Seed: VKPIIIGCHA (IDH1 R132C)
VCPIIIGCHA

SEQ ID NO: 6604 - protein, 10 aa, Artificial Sequence
  Description of Artificial Sequence: Synthetic peptide
  Seed: VKPIIIGCHA (IDH1 R132C)
VDPIIIGCHA

SEQ ID NO: 6605 - protein, 10 aa, Artificial Sequence
  Description of Artificial Sequence: Synthetic peptide
  Seed: VKPIIIGCHA (IDH1 R132C)
VEPIIIGCHA

SEQ ID NO: 6606 - protein, 10 aa, Artificial Sequence
  Description of Artificial Sequence: Synthetic peptide
  Seed: VKPIIIGCHA (IDH1 R132C)
VFPIIIGCHA

SEQ ID NO: 6607 - protein, 10 aa, Artificial Sequence
  Description of Artificial Sequence: Synthetic peptide
  Seed: VKPIIIGCHA (IDH1 R132C)
VFPIIIGCHV

SEQ ID NO: 6608 - protein, 10 aa, Artificial Sequence
  Description of Artificial Sequence: Synthetic peptide
  Seed: VKPIIIGCHA (IDH1 R132C)
VGPIIIGCHA

SEQ ID NO: 6609 - protein, 10 aa, Artificial Sequence
  Description of Artificial Sequence: Synthetic peptide
  Seed: VKPIIIGCHA (IDH1 R132C)
VHPIIIGCHA

SEQ ID NO: 6610 - protein, 10 aa, Artificial Sequence
  Description of Artificial Sequence: Synthetic peptide
  Seed: VKPIIIGCHA (IDH1 R132C)
VIPIIIGCHA

SEQ ID NO: 6611 - protein, 11 aa, Artificial Sequence
  Description of Artificial Sequence: Synthetic peptide
  Seed: VKPIIIGCHAY (IDH1 R132C)
VKPIIIGCHAF

SEQ ID NO: 6612 - protein, 10 aa, Artificial Sequence
  Description of Artificial Sequence: Synthetic peptide
  Seed: VKPIIIGCHA (IDH1 R132C)
VLPIIIGCHA

SEQ ID NO: 6613 - protein, 10 aa, Artificial Sequence
  Description of Artificial Sequence: Synthetic peptide
  Seed: VKPIIIGCHA (IDH1 R132C)
VMPIIIGCHA

SEQ ID NO: 6614 - protein, 10 aa, Artificial Sequence
  Description of Artificial Sequence: Synthetic peptide
  Seed: VKPIIIGCHA (IDH1 R132C)
VMPIIIGCHV

SEQ ID NO: 6615 - protein, 10 aa, Artificial Sequence
  Description of Artificial Sequence: Synthetic peptide
  Seed: VKPIIIGCHA (IDH1 R132C)
VNPIIIGCHA

SEQ ID NO: 6616 - protein, 10 aa, Artificial Sequence
  Description of Artificial Sequence: Synthetic peptide
  Seed: VKPIIIGCHA (IDH1 R132C)
VPPIIIGCHA

SEQ ID NO: 6617 - protein, 10 aa, Artificial Sequence
  Description of Artificial Sequence: Synthetic peptide
  Seed: VKPIIIGCHA (IDH1 R132C)
VQPIIIGCHA

SEQ ID NO: 6618 - protein, 11 aa, Artificial Sequence
  Description of Artificial Sequence: Synthetic peptide
  Seed: VKPIIIGCHAY (IDH1 R132C)
VQPIIIGCHAF

SEQ ID NO: 6619 - protein, 11 aa, Artificial Sequence
  Description of Artificial Sequence: Synthetic peptide
  Seed: VKPIIIGCHAY (IDH1 R132C)
VQPIIIGCHAM

SEQ ID NO: 6620 - protein, 11 aa, Artificial Sequence
  Description of Artificial Sequence: Synthetic peptide
  Seed: VKPIIIGCHAY (IDH1 R132C)
VQPIIIGCHAY

SEQ ID NO: 6621 - protein, 10 aa, Artificial Sequence
  Description of Artificial Sequence: Synthetic peptide
  Seed: VKPIIIGCHA (IDH1 R132C)
VRPIIIGCHA

SEQ ID NO: 6622 - protein, 10 aa, Artificial Sequence
  Description of Artificial Sequence: Synthetic peptide
  Seed: VKPIIIGCHA (IDH1 R132C)
VSPIIIGCHA

SEQ ID NO: 6623 - protein, 10 aa, Artificial Sequence
  Description of Artificial Sequence: Synthetic peptide
  Seed: VKPIIIGCHA (IDH1 R132C)
VTPIIIGCHA

SEQ ID NO: 6624 - protein, 10 aa, Artificial Sequence
  Description of Artificial Sequence: Synthetic peptide
  Seed: VKPIIIGCHA (IDH1 R132C)
VVPIIIGCHA

SEQ ID NO: 6625 - protein, 10 aa, Artificial Sequence
  Description of Artificial Sequence: Synthetic peptide
  Seed: VKPIIIGCHA (IDH1 R132C)
VWPIIIGCHA

SEQ ID NO: 6626 - protein, 10 aa, Artificial Sequence
  Description of Artificial Sequence: Synthetic peptide
  Seed: VKPIIIGCHA (IDH1 R132C)
VYPIIIGCHA

SEQ ID NO: 6627 - protein, 10 aa, Artificial Sequence
  Description of Artificial Sequence: Synthetic peptide
  Seed: IGCHAYGDQY (IDH1 R132C)
IACHAYGDQK

SEQ ID NO: 6628 - protein, 11 aa, Artificial Sequence
  Description of Artificial Sequence: Synthetic peptide
  Seed: IIGCHAYGDQY (IDH1 R132C)
IAGCHAYGDQY

SEQ ID NO: 6629 - protein, 8 aa, Artificial Sequence
  Description of Artificial Sequence: Synthetic peptide
  Seed: IIIGCHAY (IDH1 R132C)
IAIGCHAF

SEQ ID NO: 6630 - protein, 8 aa, Artificial Sequence
  Description of Artificial Sequence: Synthetic peptide
  Seed: IIIGCHAY (IDH1 R132C)
IAIGCHAH

SEQ ID NO: 6631 - protein, 8 aa, Artificial Sequence
  Description of Artificial Sequence: Synthetic peptide
  Seed: IIIGCHAY (IDH1 R132C)
IAIGCHAI

SEQ ID NO: 6632 - protein, 8 aa, Artificial Sequence
  Description of Artificial Sequence: Synthetic peptide
  Seed: IIIGCHAY (IDH1 R132C)
IAIGCHAL

SEQ ID NO: 6633 - protein, 8 aa, Artificial Sequence
  Description of Artificial Sequence: Synthetic peptide
  Seed: IIIGCHAY (IDH1 R132C)
IAIGCHAM

SEQ ID NO: 6634 - protein, 8 aa, Artificial Sequence
  Description of Artificial Sequence: Synthetic peptide
  Seed: IIIGCHAY (IDH1 R132C)
IAIGCHAV

SEQ ID NO: 6635 - protein, 10 aa, Artificial Sequence
  Description of Artificial Sequence: Synthetic peptide
  Seed: IGCHAYGDQY (IDH1 R132C)
ICCHAYGDQY

SEQ ID NO: 6636 - protein, 10 aa, Artificial Sequence
  Description of Artificial Sequence: Synthetic peptide
  Seed: IGCHAYGDQY (IDH1 R132C)
IDCHAYGDQY

SEQ ID NO: 6637 - protein, 8 aa, Artificial Sequence
  Description of Artificial Sequence: Synthetic peptide
  Seed: IIIGCHAY (IDH1 R132C)
IDIGCHAF

SEQ ID NO: 6638 - protein, 8 aa, Artificial Sequence
  Description of Artificial Sequence: Synthetic peptide
  Seed: IIIGCHAY (IDH1 R132C)
IDIGCHAY

SEQ ID NO: 6639 - protein, 10 aa, Artificial Sequence
  Description of Artificial Sequence: Synthetic peptide
  Seed: IGCHAYGDQY (IDH1 R132C)
IECHAYGDQY

SEQ ID NO: 6640 - protein, 8 aa, Artificial Sequence
  Description of Artificial Sequence: Synthetic peptide
  Seed: IIIGCHAY (IDH1 R132C)
IEIGCHAF

SEQ ID NO: 6641 - protein, 8 aa, Artificial Sequence
  Description of Artificial Sequence: Synthetic peptide
  Seed: IIIGCHAY (IDH1 R132C)
IEIGCHAY

SEQ ID NO: 6642 - protein, 8 aa, Artificial Sequence
  Description of Artificial Sequence: Synthetic peptide
  Seed: IIIGCHAY (IDH1 R132C)
IFIGCHAY

SEQ ID NO: 6643 - protein, 10 aa, Artificial Sequence
  Description of Artificial Sequence: Synthetic peptide
  Seed: IGCHAYGDQY (IDH1 R132C)
IGCHAYGDQK

SEQ ID NO: 6644 - protein, 8 aa, Artificial Sequence
  Description of Artificial Sequence: Synthetic peptide
  Seed: IIIGCHAY (IDH1 R132C)
IGIGCHAF

SEQ ID NO: 6645 - protein, 8 aa, Artificial Sequence
  Description of Artificial Sequence: Synthetic peptide
  Seed: IIIGCHAY (IDH1 R132C)
IGIGCHAY

SEQ ID NO: 6646 - protein, 8 aa, Artificial Sequence
  Description of Artificial Sequence: Synthetic peptide
  Seed: IIIGCHAY (IDH1 R132C)
IHIGCHAY

SEQ ID NO: 6647 - protein, 10 aa, Artificial Sequence
  Description of Artificial Sequence: Synthetic peptide
  Seed: IGCHAYGDQY (IDH1 R132C)
IICHAYGDQK

SEQ ID NO: 6648 - protein, 8 aa, Artificial Sequence
  Description of Artificial Sequence: Synthetic peptide
  Seed: IIIGCHAY (IDH1 R132C)
IIIGCHAF

SEQ ID NO: 6649 - protein, 8 aa, Artificial Sequence
  Description of Artificial Sequence: Synthetic peptide
  Seed: IIIGCHAY (IDH1 R132C)
IKIGCHAY

SEQ ID NO: 6650 - protein, 10 aa, Artificial Sequence
  Description of Artificial Sequence: Synthetic peptide
  Seed: IGCHAYGDQY (IDH1 R132C)
ILCHAYGDQK

SEQ ID NO: 6651 - protein, 11 aa, Artificial Sequence
  Description of Artificial Sequence: Synthetic peptide
  Seed: IIGCHAYGDQY (IDH1 R132C)
ILGCHAYGDQY

SEQ ID NO: 6652 - protein, 10 aa, Artificial Sequence
  Description of Artificial Sequence: Synthetic peptide
  Seed: IGCHAYGDQY (IDH1 R132C)
IMCHAYGDQK

SEQ ID NO: 6653 - protein, 11 aa, Artificial Sequence
  Description of Artificial Sequence: Synthetic peptide
  Seed: IIGCHAYGDQY (IDH1 R132C)
IMGCHAYGDQY

SEQ ID NO: 6654 - protein, 8 aa, Artificial Sequence
  Description of Artificial Sequence: Synthetic peptide
  Seed: IIIGCHAY (IDH1 R132C)
IMIGCHAL

SEQ ID NO: 6655 - protein, 8 aa, Artificial Sequence
  Description of Artificial Sequence: Synthetic peptide
  Seed: IIIGCHAY (IDH1 R132C)
INIGCHAY

SEQ ID NO: 6656 - protein, 8 aa, Artificial Sequence
  Description of Artificial Sequence: Synthetic peptide
  Seed: IIIGCHAY (IDH1 R132C)
IPIGCHAF

SEQ ID NO: 6657 - protein, 8 aa, Artificial Sequence
  Description of Artificial Sequence: Synthetic peptide
  Seed: IIIGCHAY (IDH1 R132C)
IPIGCHAY

SEQ ID NO: 6658 - protein, 8 aa, Artificial Sequence
  Description of Artificial Sequence: Synthetic peptide
  Seed: IIIGCHAY (IDH1 R132C)
IQIGCHAL

SEQ ID NO: 6659 - protein, 8 aa, Artificial Sequence
  Description of Artificial Sequence: Synthetic peptide
  Seed: IIIGCHAY (IDH1 R132C)
IRIGCHAY

SEQ ID NO: 6660 - protein, 10 aa, Artificial Sequence
  Description of Artificial Sequence: Synthetic peptide
  Seed: IGCHAYGDQY (IDH1 R132C)
ISCHAYGDQK

SEQ ID NO: 6661 - protein, 11 aa, Artificial Sequence
  Description of Artificial Sequence: Synthetic peptide
  Seed: IIGCHAYGDQY (IDH1 R132C)
ISGCHAYGDQY

SEQ ID NO: 6662 - protein, 8 aa, Artificial Sequence
  Description of Artificial Sequence: Synthetic peptide
  Seed: IIIGCHAY (IDH1 R132C)
ISIGCHAL

SEQ ID NO: 6663 - protein, 8 aa, Artificial Sequence
  Description of Artificial Sequence: Synthetic peptide
  Seed: IIIGCHAY (IDH1 R132C)
ISIGCHAM

SEQ ID NO: 6664 - protein, 10 aa, Artificial Sequence
  Description of Artificial Sequence: Synthetic peptide
  Seed: IGCHAYGDQY (IDH1 R132C)
ITCHAYGDQK

SEQ ID NO: 6665 - protein, 11 aa, Artificial Sequence
  Description of Artificial Sequence: Synthetic peptide
  Seed: IIGCHAYGDQY (IDH1 R132C)
ITGCHAYGDQY

SEQ ID NO: 6666 - protein, 8 aa, Artificial Sequence
  Description of Artificial Sequence: Synthetic peptide
  Seed: IIIGCHAY (IDH1 R132C)
ITIGCHAL

SEQ ID NO: 6667 - protein, 8 aa, Artificial Sequence
  Description of Artificial Sequence: Synthetic peptide
  Seed: IIIGCHAY (IDH1 R132C)
ITIGCHAM

SEQ ID NO: 6668 - protein, 10 aa, Artificial Sequence
  Description of Artificial Sequence: Synthetic peptide
  Seed: IGCHAYGDQY (IDH1 R132C)
IVCHAYGDQK

SEQ ID NO: 6669 - protein, 11 aa, Artificial Sequence
  Description of Artificial Sequence: Synthetic peptide
  Seed: IIGCHAYGDQY (IDH1 R132C)
IVGCHAYGDQY

SEQ ID NO: 6670 - protein, 8 aa, Artificial Sequence
  Description of Artificial Sequence: Synthetic peptide
  Seed: IIIGCHAY (IDH1 R132C)
IVIGCHAL

SEQ ID NO: 6671 - protein, 8 aa, Artificial Sequence
  Description of Artificial Sequence: Synthetic peptide
  Seed: IIIGCHAY (IDH1 R132C)
IWIGCHAY

SEQ ID NO: 6672 - protein, 8 aa, Artificial Sequence
  Description of Artificial Sequence: Synthetic peptide
  Seed: IIIGCHAY (IDH1 R132C)
IYIGCHAY

SEQ ID NO: 6673 - protein, 10 aa, Artificial Sequence
  Description of Artificial Sequence: Synthetic peptide
  Seed: KPIIIGCHAY (IDH1 R132C)
KAIIIGCHAW

SEQ ID NO: 6674 - protein, 10 aa, Artificial Sequence
  Description of Artificial Sequence: Synthetic peptide
  Seed: KPIIIGCHAY (IDH1 R132C)
KLIIIGCHAL

SEQ ID NO: 6675 - protein, 10 aa, Artificial Sequence
  Description of Artificial Sequence: Synthetic peptide
  Seed: KPIIIGCHAY (IDH1 R132C)
KPIIIGCHAC

SEQ ID NO: 6676 - protein, 10 aa, Artificial Sequence
  Description of Artificial Sequence: Synthetic peptide
  Seed: KPIIIGCHAY (IDH1 R132C)
KPIIIGCHAG

SEQ ID NO: 6677 - protein, 10 aa, Artificial Sequence
  Description of Artificial Sequence: Synthetic peptide
  Seed: KPIIIGCHAY (IDH1 R132C)
KPIIIGCHAI

SEQ ID NO: 6678 - protein, 10 aa, Artificial Sequence
  Description of Artificial Sequence: Synthetic peptide
  Seed: KPIIIGCHAY (IDH1 R132C)
KPIIIGCHAP

SEQ ID NO: 6679 - protein, 10 aa, Artificial Sequence
  Description of Artificial Sequence: Synthetic peptide
  Seed: KPIIIGCHAY (IDH1 R132C)
KPIIIGCHAS

SEQ ID NO: 6680 - protein, 10 aa, Artificial Sequence
  Description of Artificial Sequence: Synthetic peptide
  Seed: KPIIIGCHAY (IDH1 R132C)
KPIIIGCHAT

SEQ ID NO: 6681 - protein, 10 aa, Artificial Sequence
  Description of Artificial Sequence: Synthetic peptide
  Seed: KPIIIGCHAY (IDH1 R132C)
KPIIIGCHAV

SEQ ID NO: 6682 - protein, 10 aa, Artificial Sequence
  Description of Artificial Sequence: Synthetic peptide
  Seed: KPIIIGCHAY (IDH1 R132C)
KPIIIGCHAW

SEQ ID NO: 6683 - protein, 9 aa, Artificial Sequence
  Description of Artificial Sequence: Synthetic peptide
  Seed: KPIIIGCHA (IDH1 R132C)
KPIIIGCHC

SEQ ID NO: 6684 - protein, 9 aa, Artificial Sequence
  Description of Artificial Sequence: Synthetic peptide
  Seed: KPIIIGCHA (IDH1 R132C)
KPIIIGCHG

SEQ ID NO: 6685 - protein, 9 aa, Artificial Sequence
  Description of Artificial Sequence: Synthetic peptide
  Seed: KPIIIGCHA (IDH1 R132C)
KPIIIGCHP

SEQ ID NO: 6686 - protein, 9 aa, Artificial Sequence
  Description of Artificial Sequence: Synthetic peptide
  Seed: KPIIIGCHA (IDH1 R132C)
KPIIIGCHS

SEQ ID NO: 6687 - protein, 9 aa, Artificial Sequence
  Description of Artificial Sequence: Synthetic peptide
  Seed: KPIIIGCHA (IDH1 R132C)
KPIIIGCHT

SEQ ID NO: 6688 - protein, 9 aa, Artificial Sequence
  Description of Artificial Sequence: Synthetic peptide
  Seed: KPIIIGCHA (IDH1 R132C)
KPIIIGCHY

SEQ ID NO: 6689 - protein, 10 aa, Artificial Sequence
  Description of Artificial Sequence: Synthetic peptide
  Seed: KPIIIGCHAY (IDH1 R132C)
KQIIIGCHAH

SEQ ID NO: 6690 - protein, 9 aa, Artificial Sequence
  Description of Artificial Sequence: Synthetic peptide
  Seed: PIIIGCHAY (IDH1 R132C)
PAIIGCHAF

SEQ ID NO: 6691 - protein, 9 aa, Artificial Sequence
  Description of Artificial Sequence: Synthetic peptide
  Seed: PIIIGCHAY (IDH1 R132C)
PAIIGCHAM

SEQ ID NO: 6692 - protein, 9 aa, Artificial Sequence
  Description of Artificial Sequence: Synthetic peptide
  Seed: PIIIGCHAY (IDH1 R132C)
PAIIGCHAY

SEQ ID NO: 6693 - protein, 9 aa, Artificial Sequence
  Description of Artificial Sequence: Synthetic peptide
  Seed: PIIIGCHAY (IDH1 R132C)
PCIIGCHAY

SEQ ID NO: 6694 - protein, 9 aa, Artificial Sequence
  Description of Artificial Sequence: Synthetic peptide
  Seed: PIIIGCHAY (IDH1 R132C)
PDIIGCHAY

SEQ ID NO: 6695 - protein, 9 aa, Artificial Sequence
  Description of Artificial Sequence: Synthetic peptide
  Seed: PIIIGCHAY (IDH1 R132C)
PEIIGCHAF

SEQ ID NO: 6696 - protein, 9 aa, Artificial Sequence
  Description of Artificial Sequence: Synthetic peptide
  Seed: PIIIGCHAY (IDH1 R132C)
PEIIGCHAY

SEQ ID NO: 6697 - protein, 9 aa, Artificial Sequence
  Description of Artificial Sequence: Synthetic peptide
  Seed: PIIIGCHAY (IDH1 R132C)
PFIIGCHAF

SEQ ID NO: 6698 - protein, 9 aa, Artificial Sequence
  Description of Artificial Sequence: Synthetic peptide
  Seed: PIIIGCHAY (IDH1 R132C)
PFIIGCHAY

SEQ ID NO: 6699 - protein, 9 aa, Artificial Sequence
  Description of Artificial Sequence: Synthetic peptide
  Seed: PIIIGCHAY (IDH1 R132C)
PGIIGCHAF

SEQ ID NO: 6700 - protein, 9 aa, Artificial Sequence
  Description of Artificial Sequence: Synthetic peptide
  Seed: PIIIGCHAY (IDH1 R132C)
PGIIGCHAY

SEQ ID NO: 6701 - protein, 9 aa, Artificial Sequence
  Description of Artificial Sequence: Synthetic peptide
  Seed: PIIIGCHAY (IDH1 R132C)
PHIIGCHAY

SEQ ID NO: 6702 - protein, 9 aa, Artificial Sequence
  Description of Artificial Sequence: Synthetic peptide
  Seed: PIIIGCHAY (IDH1 R132C)
PIIIGCHAF

SEQ ID NO: 6703 - protein, 9 aa, Artificial Sequence
  Description of Artificial Sequence: Synthetic peptide
  Seed: PIIIGCHAY (IDH1 R132C)
PKIIGCHAY

SEQ ID NO: 6704 - protein, 9 aa, Artificial Sequence
  Description of Artificial Sequence: Synthetic peptide
  Seed: PIIIGCHAY (IDH1 R132C)
PLIIGCHAF

SEQ ID NO: 6705 - protein, 9 aa, Artificial Sequence
  Description of Artificial Sequence: Synthetic peptide
  Seed: PIIIGCHAY (IDH1 R132C)
PLIIGCHAM

SEQ ID NO: 6706 - protein, 9 aa, Artificial Sequence
  Description of Artificial Sequence: Synthetic peptide
  Seed: PIIIGCHAY (IDH1 R132C)
PLIIGCHAY

SEQ ID NO: 6707 - protein, 9 aa, Artificial Sequence
  Description of Artificial Sequence: Synthetic peptide
  Seed: PIIIGCHAY (IDH1 R132C)
PMIIGCHAF

SEQ ID NO: 6708 - protein, 9 aa, Artificial Sequence
  Description of Artificial Sequence: Synthetic peptide
  Seed: PIIIGCHAY (IDH1 R132C)
PMIIGCHAM

SEQ ID NO: 6709 - protein, 9 aa, Artificial Sequence
  Description of Artificial Sequence: Synthetic peptide
  Seed: PIIIGCHAY (IDH1 R132C)
PMIIGCHAY

SEQ ID NO: 6710 - protein, 9 aa, Artificial Sequence
  Description of Artificial Sequence: Synthetic peptide
  Seed: PIIIGCHAY (IDH1 R132C)
PNIIGCHAF

SEQ ID NO: 6711 - protein, 9 aa, Artificial Sequence
  Description of Artificial Sequence: Synthetic peptide
  Seed: PIIIGCHAY (IDH1 R132C)
PNIIGCHAY

SEQ ID NO: 6712 - protein, 9 aa, Artificial Sequence
  Description of Artificial Sequence: Synthetic peptide
  Seed: PIIIGCHAY (IDH1 R132C)
PPIIGCHAF

SEQ ID NO: 6713 - protein, 9 aa, Artificial Sequence
  Description of Artificial Sequence: Synthetic peptide
  Seed: PIIIGCHAY (IDH1 R132C)
PPIIGCHAM

SEQ ID NO: 6714 - protein, 9 aa, Artificial Sequence
  Description of Artificial Sequence: Synthetic peptide
  Seed: PIIIGCHAY (IDH1 R132C)
PPIIGCHAY

SEQ ID NO: 6715 - protein, 9 aa, Artificial Sequence
  Description of Artificial Sequence: Synthetic peptide
  Seed: PIIIGCHAY (IDH1 R132C)
PQIIGCHAF

SEQ ID NO: 6716 - protein, 9 aa, Artificial Sequence
  Description of Artificial Sequence: Synthetic peptide
  Seed: PIIIGCHAY (IDH1 R132C)
PQIIGCHAM

SEQ ID NO: 6717 - protein, 9 aa, Artificial Sequence
  Description of Artificial Sequence: Synthetic peptide
  Seed: PIIIGCHAY (IDH1 R132C)
PQIIGCHAY

SEQ ID NO: 6718 - protein, 9 aa, Artificial Sequence
  Description of Artificial Sequence: Synthetic peptide
  Seed: PIIIGCHAY (IDH1 R132C)
PRIIGCHAY

SEQ ID NO: 6719 - protein, 9 aa, Artificial Sequence
  Description of Artificial Sequence: Synthetic peptide
  Seed: PIIIGCHAY (IDH1 R132C)
PSIIGCHAF

SEQ ID NO: 6720 - protein, 9 aa, Artificial Sequence
  Description of Artificial Sequence: Synthetic peptide
  Seed: PIIIGCHAY (IDH1 R132C)
PSIIGCHAM

SEQ ID NO: 6721 - protein, 9 aa, Artificial Sequence
  Description of Artificial Sequence: Synthetic peptide
  Seed: PIIIGCHAY (IDH1 R132C)
PSIIGCHAY

SEQ ID NO: 6722 - protein, 9 aa, Artificial Sequence
  Description of Artificial Sequence: Synthetic peptide
  Seed: PIIIGCHAY (IDH1 R132C)
PTIIGCHAF

SEQ ID NO: 6723 - protein, 9 aa, Artificial Sequence
  Description of Artificial Sequence: Synthetic peptide
  Seed: PIIIGCHAY (IDH1 R132C)
PTIIGCHAY

SEQ ID NO: 6724 - protein, 9 aa, Artificial Sequence
  Description of Artificial Sequence: Synthetic peptide
  Seed: PIIIGCHAY (IDH1 R132C)
PVIIGCHAF

SEQ ID NO: 6725 - protein, 9 aa, Artificial Sequence
  Description of Artificial Sequence: Synthetic peptide
  Seed: PIIIGCHAY (IDH1 R132C)
PVIIGCHAM

SEQ ID NO: 6726 - protein, 9 aa, Artificial Sequence
  Description of Artificial Sequence: Synthetic peptide
  Seed: PIIIGCHAY (IDH1 R132C)
PVIIGCHAY

SEQ ID NO: 6727 - protein, 9 aa, Artificial Sequence
  Description of Artificial Sequence: Synthetic peptide
  Seed: PIIIGCHAY (IDH1 R132C)
PWIIGCHAY

SEQ ID NO: 6728 - protein, 9 aa, Artificial Sequence
  Description of Artificial Sequence: Synthetic peptide
  Seed: PIIIGCHAY (IDH1 R132C)
PYIIGCHAY

SEQ ID NO: 6729 - protein, 10 aa, Homo sapiens
  Native (IDH1 R132C)
IGCHAYGDQY

SEQ ID NO: 6730 - protein, 11 aa, Homo sapiens
  Native (IDH1 R132C)
IGCHAYGDQYR

SEQ ID NO: 6731 - protein, 8 aa, Homo sapiens
  Native (IDH1 R132C)
IIIGCHAY

SEQ ID NO: 6732 - protein, 10 aa, Homo sapiens
  Native (IDH1 R132C)
KPIIIGCHAY

SEQ ID NO: 6733 - protein, 10 aa, Homo sapiens
  Native (IDH1 R132C)
VKPIIIGCHA

SEQ ID NO: 6734 - protein, 11 aa, Homo sapiens
  Native (IDH1 R132C)
VKPIIIGCHAY

SEQ ID NO: 6735 - protein, 10 aa, Homo sapiens
  Native (IDH1 R132C)
CHAYGDQYRA

SEQ ID NO: 6736 - protein, 11 aa, Homo sapiens
  Native (IDH1 R132C)
IIGCHAYGDQY

SEQ ID NO: 6737 - protein, 9 aa, Homo sapiens
  Native (IDH1 R132C)
PIIIGCHAY

SEQ ID NO: 6738 - protein, 10 aa, Artificial Sequence
  Description of Artificial Sequence: Synthetic peptide
  Seed: IGHHAYGDQY (IDH1 R132H)
IAHHAYGDQF

SEQ ID NO: 6739 - protein, 10 aa, Artificial Sequence
  Description of Artificial Sequence: Synthetic peptide
  Seed: IGHHAYGDQY (IDH1 R132H)
IAHHAYGDQY

SEQ ID NO: 6740 - protein, 11 aa, Artificial Sequence
  Description of Artificial Sequence: Synthetic peptide
  Seed: IGHHAYGDQYR (IDH1 R132H)
IAHHAYGDQYR

SEQ ID NO: 6741 - protein, 8 aa, Artificial Sequence
  Description of Artificial Sequence: Synthetic peptide
  Seed: IIIGHHAY (IDH1 R132H)
IAIGHHAF

SEQ ID NO: 6742 - protein, 8 aa, Artificial Sequence
  Description of Artificial Sequence: Synthetic peptide
  Seed: IIIGHHAY (IDH1 R132H)
IAIGHHAY

SEQ ID NO: 6743 - protein, 10 aa, Artificial Sequence
  Description of Artificial Sequence: Synthetic peptide
  Seed: IGHHAYGDQY (IDH1 R132H)
ICHHAYGDQY

SEQ ID NO: 6744 - protein, 10 aa, Artificial Sequence
  Description of Artificial Sequence: Synthetic peptide
  Seed: IGHHAYGDQY (IDH1 R132H)
IEHHAYGDQF

SEQ ID NO: 6745 - protein, 10 aa, Artificial Sequence
  Description of Artificial Sequence: Synthetic peptide
  Seed: IGHHAYGDQY (IDH1 R132H)
IEHHAYGDQY

SEQ ID NO: 6746 - protein, 8 aa, Artificial Sequence
  Description of Artificial Sequence: Synthetic peptide
  Seed: IIIGHHAY (IDH1 R132H)
IEIGHHAF

SEQ ID NO: 6747 - protein, 8 aa, Artificial Sequence
  Description of Artificial Sequence: Synthetic peptide
  Seed: IIIGHHAY (IDH1 R132H)
IEIGHHAY

SEQ ID NO: 6748 - protein, 10 aa, Artificial Sequence
  Description of Artificial Sequence: Synthetic peptide
  Seed: IGHHAYGDQY (IDH1 R132H)
IFHHAYGDQY

SEQ ID NO: 6749 - protein, 11 aa, Artificial Sequence
  Description of Artificial Sequence: Synthetic peptide
  Seed: IGHHAYGDQYR (IDH1 R132H)
IFHHAYGDQYK

SEQ ID NO: 6750 - protein, 11 aa, Artificial Sequence
  Description of Artificial Sequence: Synthetic peptide
  Seed: IGHHAYGDQYR (IDH1 R132H)
IFHHAYGDQYR

SEQ ID NO: 6751 - protein, 10 aa, Artificial Sequence
  Description of Artificial Sequence: Synthetic peptide
  Seed: IGHHAYGDQY (IDH1 R132H)
IHHHAYGDQF

SEQ ID NO: 6752 - protein, 10 aa, Artificial Sequence
  Description of Artificial Sequence: Synthetic peptide
  Seed: IGHHAYGDQY (IDH1 R132H)
IHHHAYGDQY

SEQ ID NO: 6753 - protein, 8 aa, Artificial Sequence
  Description of Artificial Sequence: Synthetic peptide
  Seed: IIIGHHAY (IDH1 R132H)
IHIGHHAF

SEQ ID NO: 6754 - protein, 8 aa, Artificial Sequence
  Description of Artificial Sequence: Synthetic peptide
  Seed: IIIGHHAY (IDH1 R132H)
IHIGHHAY

SEQ ID NO: 6755 - protein, 10 aa, Artificial Sequence
  Description of Artificial Sequence: Synthetic peptide
  Seed: IGHHAYGDQY (IDH1 R132H)
IIHHAYGDQF

SEQ ID NO: 6756 - protein, 10 aa, Artificial Sequence
  Description of Artificial Sequence: Synthetic peptide
  Seed: IGHHAYGDQY (IDH1 R132H)
IIHHAYGDQY

SEQ ID NO: 6757 - protein, 11 aa, Artificial Sequence
  Description of Artificial Sequence: Synthetic peptide
  Seed: IGHHAYGDQYR (IDH1 R132H)
IIHHAYGDQYR

SEQ ID NO: 6758 - protein, 8 aa, Artificial Sequence
  Description of Artificial Sequence: Synthetic peptide
  Seed: IIIGHHAY (IDH1 R132H)
IIIGHHAF

SEQ ID NO: 6759 - protein, 10 aa, Artificial Sequence
  Description of Artificial Sequence: Synthetic peptide
  Seed: IGHHAYGDQY (IDH1 R132H)
IKHHAYGDQF

SEQ ID NO: 6760 - protein, 10 aa, Artificial Sequence
  Description of Artificial Sequence: Synthetic peptide
  Seed: IGHHAYGDQY (IDH1 R132H)
IKHHAYGDQM

SEQ ID NO: 6761 - protein, 10 aa, Artificial Sequence
  Description of Artificial Sequence: Synthetic peptide
  Seed: IGHHAYGDQY (IDH1 R132H)
IKHHAYGDQY

SEQ ID NO: 6762 - protein, 8 aa, Artificial Sequence
  Description of Artificial Sequence: Synthetic peptide
  Seed: IIIGHHAY (IDH1 R132H)
IKIGHHAF

SEQ ID NO: 6763 - protein, 8 aa, Artificial Sequence
  Description of Artificial Sequence: Synthetic peptide
  Seed: IIIGHHAY (IDH1 R132H)
IKIGHHAL

SEQ ID NO: 6764 - protein, 8 aa, Artificial Sequence
  Description of Artificial Sequence: Synthetic peptide
  Seed: IIIGHHAY (IDH1 R132H)
IKIGHHAM

SEQ ID NO: 6765 - protein, 8 aa, Artificial Sequence
  Description of Artificial Sequence: Synthetic peptide
  Seed: IIIGHHAY (IDH1 R132H)
IKIGHHAY

SEQ ID NO: 6766 - protein, 10 aa, Artificial Sequence
  Description of Artificial Sequence: Synthetic peptide
  Seed: IGHHAYGDQY (IDH1 R132H)
ILHHAYGDQF

SEQ ID NO: 6767 - protein, 10 aa, Artificial Sequence
  Description of Artificial Sequence: Synthetic peptide
  Seed: IGHHAYGDQY (IDH1 R132H)
ILHHAYGDQY

SEQ ID NO: 6768 - protein, 11 aa, Artificial Sequence
  Description of Artificial Sequence: Synthetic peptide
  Seed: IGHHAYGDQYR (IDH1 R132H)
ILHHAYGDQYR

SEQ ID NO: 6769 - protein, 8 aa, Artificial Sequence
  Description of Artificial Sequence: Synthetic peptide
  Seed: IIIGHHAY (IDH1 R132H)
ILIGHHAF

SEQ ID NO: 6770 - protein, 8 aa, Artificial Sequence
  Description of Artificial Sequence: Synthetic peptide
  Seed: IIIGHHAY (IDH1 R132H)
ILIGHHAM

SEQ ID NO: 6771 - protein, 8 aa, Artificial Sequence
  Description of Artificial Sequence: Synthetic peptide
  Seed: IIIGHHAY (IDH1 R132H)
ILIGHHAY

SEQ ID NO: 6772 - protein, 10 aa, Artificial Sequence
  Description of Artificial Sequence: Synthetic peptide
  Seed: IGHHAYGDQY (IDH1 R132H)
IMHHAYGDQF

SEQ ID NO: 6773 - protein, 10 aa, Artificial Sequence
  Description of Artificial Sequence: Synthetic peptide
  Seed: IGHHAYGDQY (IDH1 R132H)
IMHHAYGDQM

SEQ ID NO: 6774 - protein, 11 aa, Artificial Sequence
  Description of Artificial Sequence: Synthetic peptide
  Seed: IGHHAYGDQYR (IDH1 R132H)
IMHHAYGDQYK

SEQ ID NO: 6775 - protein, 8 aa, Artificial Sequence
  Description of Artificial Sequence: Synthetic peptide
  Seed: IIIGHHAY (IDH1 R132H)
IMIGHHAF

SEQ ID NO: 6776 - protein, 8 aa, Artificial Sequence
  Description of Artificial Sequence: Synthetic peptide
  Seed: IIIGHHAY (IDH1 R132H)
IMIGHHAL

SEQ ID NO: 6777 - protein, 8 aa, Artificial Sequence
  Description of Artificial Sequence: Synthetic peptide
  Seed: IIIGHHAY (IDH1 R132H)
IMIGHHAM

SEQ ID NO: 6778 - protein, 8 aa, Artificial Sequence
  Description of Artificial Sequence: Synthetic peptide
  Seed: IIIGHHAY (IDH1 R132H)
IMIGHHAY

SEQ ID NO: 6779 - protein, 10 aa, Artificial Sequence
  Description of Artificial Sequence: Synthetic peptide
  Seed: IGHHAYGDQY (IDH1 R132H)
INHHAYGDQY

SEQ ID NO: 6780 - protein, 10 aa, Artificial Sequence
  Description of Artificial Sequence: Synthetic peptide
  Seed: IGHHAYGDQY (IDH1 R132H)
IPHHAYGDQY

SEQ ID NO: 6781 - protein, 8 aa, Artificial Sequence
  Description of Artificial Sequence: Synthetic peptide
  Seed: IIIGHHAY (IDH1 R132H)
IPIGHHAY

SEQ ID NO: 6782 - protein, 10 aa, Artificial Sequence
  Description of Artificial Sequence: Synthetic peptide
  Seed: IGHHAYGDQY (IDH1 R132H)
IQHHAYGDQF

SEQ ID NO: 6783 - protein, 10 aa, Artificial Sequence
  Description of Artificial Sequence: Synthetic peptide
  Seed: IGHHAYGDQY (IDH1 R132H)
IQHHAYGDQL

SEQ ID NO: 6784 - protein, 10 aa, Artificial Sequence
  Description of Artificial Sequence: Synthetic peptide
  Seed: IGHHAYGDQY (IDH1 R132H)
IQHHAYGDQM

SEQ ID NO: 6785 - protein, 10 aa, Artificial Sequence
  Description of Artificial Sequence: Synthetic peptide
  Seed: IGHHAYGDQY (IDH1 R132H)
IQHHAYGDQY

SEQ ID NO: 6786 - protein, 11 aa, Artificial Sequence
  Description of Artificial Sequence: Synthetic peptide
  Seed: IGHHAYGDQYR (IDH1 R132H)
IQHHAYGDQYR

SEQ ID NO: 6787 - protein, 8 aa, Artificial Sequence
  Description of Artificial Sequence: Synthetic peptide
  Seed: IIIGHHAY (IDH1 R132H)
IQIGHHAF

SEQ ID NO: 6788 - protein, 8 aa, Artificial Sequence
  Description of Artificial Sequence: Synthetic peptide
  Seed: IIIGHHAY (IDH1 R132H)
IQIGHHAI

SEQ ID NO: 6789 - protein, 8 aa, Artificial Sequence
  Description of Artificial Sequence: Synthetic peptide
  Seed: IIIGHHAY (IDH1 R132H)
IQIGHHAL

SEQ ID NO: 6790 - protein, 8 aa, Artificial Sequence
  Description of Artificial Sequence: Synthetic peptide
  Seed: IIIGHHAY (IDH1 R132H)
IQIGHHAM

SEQ ID NO: 6791 - protein, 8 aa, Artificial Sequence
  Description of Artificial Sequence: Synthetic peptide
  Seed: IIIGHHAY (IDH1 R132H)
IQIGHHAV

SEQ ID NO: 6792 - protein, 8 aa, Artificial Sequence
  Description of Artificial Sequence: Synthetic peptide
  Seed: IIIGHHAY (IDH1 R132H)
IQIGHHAW

SEQ ID NO: 6793 - protein, 10 aa, Artificial Sequence
  Description of Artificial Sequence: Synthetic peptide
  Seed: IGHHAYGDQY (IDH1 R132H)
IRHHAYGDQF

SEQ ID NO: 6794 - protein, 10 aa, Artificial Sequence
  Description of Artificial Sequence: Synthetic peptide
  Seed: IGHHAYGDQY (IDH1 R132H)
IRHHAYGDQY

SEQ ID NO: 6795 - protein, 8 aa, Artificial Sequence
  Description of Artificial Sequence: Synthetic peptide
  Seed: IIIGHHAY (IDH1 R132H)
IRIGHHAF

SEQ ID NO: 6796 - protein, 8 aa, Artificial Sequence
  Description of Artificial Sequence: Synthetic peptide
  Seed: IIIGHHAY (IDH1 R132H)
IRIGHHAY

SEQ ID NO: 6797 - protein, 10 aa, Artificial Sequence
  Description of Artificial Sequence: Synthetic peptide
  Seed: IGHHAYGDQY (IDH1 R132H)
ISHHAYGDQF

SEQ ID NO: 6798 - protein, 10 aa, Artificial Sequence
  Description of Artificial Sequence: Synthetic peptide
  Seed: IGHHAYGDQY (IDH1 R132H)
ISHHAYGDQY

SEQ ID NO: 6799 - protein, 11 aa, Artificial Sequence
  Description of Artificial Sequence: Synthetic peptide
  Seed: IGHHAYGDQYR (IDH1 R132H)
ISHHAYGDQYR

SEQ ID NO: 6800 - protein, 8 aa, Artificial Sequence
  Description of Artificial Sequence: Synthetic peptide
  Seed: IIIGHHAY (IDH1 R132H)
ISIGHHAF

SEQ ID NO: 6801 - protein, 8 aa, Artificial Sequence
  Description of Artificial Sequence: Synthetic peptide
  Seed: IIIGHHAY (IDH1 R132H)
ISIGHHAY

SEQ ID NO: 6802 - protein, 10 aa, Artificial Sequence
  Description of Artificial Sequence: Synthetic peptide
  Seed: IGHHAYGDQY (IDH1 R132H)
ITHHAYGDQF

SEQ ID NO: 6803 - protein, 10 aa, Artificial Sequence
  Description of Artificial Sequence: Synthetic peptide
  Seed: IGHHAYGDQY (IDH1 R132H)
ITHHAYGDQY

SEQ ID NO: 6804 - protein, 11 aa, Artificial Sequence
  Description of Artificial Sequence: Synthetic peptide
  Seed: IGHHAYGDQYR (IDH1 R132H)
ITHHAYGDQYR

SEQ ID NO: 6805 - protein, 8 aa, Artificial Sequence
  Description of Artificial Sequence: Synthetic peptide
  Seed: IIIGHHAY (IDH1 R132H)
ITIGHHAF

SEQ ID NO: 6806 - protein, 8 aa, Artificial Sequence
  Description of Artificial Sequence: Synthetic peptide
  Seed: IIIGHHAY (IDH1 R132H)
ITIGHHAY

SEQ ID NO: 6807 - protein, 10 aa, Artificial Sequence
  Description of Artificial Sequence: Synthetic peptide
  Seed: IGHHAYGDQY (IDH1 R132H)
IVHHAYGDQF

SEQ ID NO: 6808 - protein, 10 aa, Artificial Sequence
  Description of Artificial Sequence: Synthetic peptide
  Seed: IGHHAYGDQY (IDH1 R132H)
IVHHAYGDQY

SEQ ID NO: 6809 - protein, 11 aa, Artificial Sequence
  Description of Artificial Sequence: Synthetic peptide
  Seed: IGHHAYGDQYR (IDH1 R132H)
IVHHAYGDQYR

SEQ ID NO: 6810 - protein, 8 aa, Artificial Sequence
  Description of Artificial Sequence: Synthetic peptide
  Seed: IIIGHHAY (IDH1 R132H)
IVIGHHAF

SEQ ID NO: 6811 - protein, 8 aa, Artificial Sequence
  Description of Artificial Sequence: Synthetic peptide
  Seed: IIIGHHAY (IDH1 R132H)
IVIGHHAY

SEQ ID NO: 6812 - protein, 10 aa, Artificial Sequence
  Description of Artificial Sequence: Synthetic peptide
  Seed: IGHHAYGDQY (IDH1 R132H)
IWHHAYGDQY

SEQ ID NO: 6813 - protein, 11 aa, Artificial Sequence
  Description of Artificial Sequence: Synthetic peptide
  Seed: IGHHAYGDQYR (IDH1 R132H)
IWHHAYGDQYR

SEQ ID NO: 6814 - protein, 10 aa, Artificial Sequence
  Description of Artificial Sequence: Synthetic peptide
  Seed: IGHHAYGDQY (IDH1 R132H)
IYHHAYGDQY

SEQ ID NO: 6815 - protein, 11 aa, Artificial Sequence
  Description of Artificial Sequence: Synthetic peptide
  Seed: IGHHAYGDQYR (IDH1 R132H)
IYHHAYGDQYK

SEQ ID NO: 6816 - protein, 11 aa, Artificial Sequence
  Description of Artificial Sequence: Synthetic peptide
  Seed: IGHHAYGDQYR (IDH1 R132H)
IYHHAYGDQYR

SEQ ID NO: 6817 - protein, 10 aa, Artificial Sequence
  Description of Artificial Sequence: Synthetic peptide
  Seed: KPIIIGHHAY (IDH1 R132H)
KAIIIGHHAF

SEQ ID NO: 6818 - protein, 10 aa, Artificial Sequence
  Description of Artificial Sequence: Synthetic peptide
  Seed: KPIIIGHHAY (IDH1 R132H)
KAIIIGHHAM

SEQ ID NO: 6819 - protein, 10 aa, Artificial Sequence
  Description of Artificial Sequence: Synthetic peptide
  Seed: KPIIIGHHAY (IDH1 R132H)
KAIIIGHHAY

SEQ ID NO: 6820 - protein, 10 aa, Artificial Sequence
  Description of Artificial Sequence: Synthetic peptide
  Seed: KPIIIGHHAY (IDH1 R132H)
KCIIIGHHAF

SEQ ID NO: 6821 - protein, 10 aa, Artificial Sequence
  Description of Artificial Sequence: Synthetic peptide
  Seed: KPIIIGHHAY (IDH1 R132H)
KCIIIGHHAY

SEQ ID NO: 6822 - protein, 10 aa, Artificial Sequence
  Description of Artificial Sequence: Synthetic peptide
  Seed: KPIIIGHHAY (IDH1 R132H)
KDIIIGHHAF

SEQ ID NO: 6823 - protein, 10 aa, Artificial Sequence
  Description of Artificial Sequence: Synthetic peptide
  Seed: KPIIIGHHAY (IDH1 R132H)
KDIIIGHHAY

SEQ ID NO: 6824 - protein, 10 aa, Artificial Sequence
  Description of Artificial Sequence: Synthetic peptide
  Seed: KPIIIGHHAY (IDH1 R132H)
KEIIIGHHAF

SEQ ID NO: 6825 - protein, 10 aa, Artificial Sequence
  Description of Artificial Sequence: Synthetic peptide
  Seed: KPIIIGHHAY (IDH1 R132H)
KEIIIGHHAY

SEQ ID NO: 6826 - protein, 10 aa, Artificial Sequence
  Description of Artificial Sequence: Synthetic peptide
  Seed: KPIIIGHHAY (IDH1 R132H)
KFIIIGHHAF

SEQ ID NO: 6827 - protein, 10 aa, Artificial Sequence
  Description of Artificial Sequence: Synthetic peptide
  Seed: KPIIIGHHAY (IDH1 R132H)
KFIIIGHHAY

SEQ ID NO: 6828 - protein, 10 aa, Artificial Sequence
  Description of Artificial Sequence: Synthetic peptide
  Seed: KPIIIGHHAY (IDH1 R132H)
KGIIIGHHAF

SEQ ID NO: 6829 - protein, 10 aa, Artificial Sequence
  Description of Artificial Sequence: Synthetic peptide
  Seed: KPIIIGHHAY (IDH1 R132H)
KGIIIGHHAY

SEQ ID NO: 6830 - protein, 10 aa, Artificial Sequence
  Description of Artificial Sequence: Synthetic peptide
  Seed: KPIIIGHHAY (IDH1 R132H)
KHIIIGHHAF

SEQ ID NO: 6831 - protein, 10 aa, Artificial Sequence
  Description of Artificial Sequence: Synthetic peptide
  Seed: KPIIIGHHAY (IDH1 R132H)
KHIIIGHHAY

SEQ ID NO: 6832 - protein, 10 aa, Artificial Sequence
  Description of Artificial Sequence: Synthetic peptide
  Seed: KPIIIGHHAY (IDH1 R132H)
KIIIIGHHAF

SEQ ID NO: 6833 - protein, 10 aa, Artificial Sequence
  Description of Artificial Sequence: Synthetic peptide
  Seed: KPIIIGHHAY (IDH1 R132H)
KIIIIGHHAM

SEQ ID NO: 6834 - protein, 10 aa, Artificial Sequence
  Description of Artificial Sequence: Synthetic peptide
  Seed: KPIIIGHHAY (IDH1 R132H)
KIIIIGHHAY

SEQ ID NO: 6835 - protein, 10 aa, Artificial Sequence
  Description of Artificial Sequence: Synthetic peptide
  Seed: KPIIIGHHAY (IDH1 R132H)
KKIIIGHHAF

SEQ ID NO: 6836 - protein, 10 aa, Artificial Sequence
  Description of Artificial Sequence: Synthetic peptide
  Seed: KPIIIGHHAY (IDH1 R132H)
KKIIIGHHAY

SEQ ID NO: 6837 - protein, 10 aa, Artificial Sequence
  Description of Artificial Sequence: Synthetic peptide
  Seed: KPIIIGHHAY (IDH1 R132H)
KLIIIGHHAF

SEQ ID NO: 6838 - protein, 10 aa, Artificial Sequence
  Description of Artificial Sequence: Synthetic peptide
  Seed: KPIIIGHHAY (IDH1 R132H)
KLIIIGHHAM

SEQ ID NO: 6839 - protein, 10 aa, Artificial Sequence
  Description of Artificial Sequence: Synthetic peptide
  Seed: KPIIIGHHAY (IDH1 R132H)
KLIIIGHHAY

SEQ ID NO: 6840 - protein, 10 aa, Artificial Sequence
  Description of Artificial Sequence: Synthetic peptide
  Seed: KPIIIGHHAY (IDH1 R132H)
KMIIIGHHAF

SEQ ID NO: 6841 - protein, 10 aa, Artificial Sequence
  Description of Artificial Sequence: Synthetic peptide
  Seed: KPIIIGHHAY (IDH1 R132H)
KMIIIGHHAL

SEQ ID NO: 6842 - protein, 10 aa, Artificial Sequence
  Description of Artificial Sequence: Synthetic peptide
  Seed: KPIIIGHHAY (IDH1 R132H)
KMIIIGHHAM

SEQ ID NO: 6843 - protein, 10 aa, Artificial Sequence
  Description of Artificial Sequence: Synthetic peptide
  Seed: KPIIIGHHAY (IDH1 R132H)
KNIIIGHHAF

SEQ ID NO: 6844 - protein, 10 aa, Artificial Sequence
  Description of Artificial Sequence: Synthetic peptide
  Seed: KPIIIGHHAY (IDH1 R132H)
KNIIIGHHAY

SEQ ID NO: 6845 - protein, 10 aa, Artificial Sequence
  Description of Artificial Sequence: Synthetic peptide
  Seed: KPIIIGHHAY (IDH1 R132H)
KPIIIGHHAF

SEQ ID NO: 6846 - protein, 10 aa, Artificial Sequence
  Description of Artificial Sequence: Synthetic peptide
  Seed: KPIIIGHHAY (IDH1 R132H)
KPIIIGHHAM

SEQ ID NO: 6847 - protein, 9 aa, Artificial Sequence
  Description of Artificial Sequence: Synthetic peptide
  Seed: KPIIIGHHA (IDH1 R132H)
KPIIIGHHF

SEQ ID NO: 6848 - protein, 9 aa, Artificial Sequence
  Description of Artificial Sequence: Synthetic peptide
  Seed: KPIIIGHHA (IDH1 R132H)
KPIIIGHHI

SEQ ID NO: 6849 - protein, 9 aa, Artificial Sequence
  Description of Artificial Sequence: Synthetic peptide
  Seed: KPIIIGHHA (IDH1 R132H)
KPIIIGHHV

SEQ ID NO: 6850 - protein, 10 aa, Artificial Sequence
  Description of Artificial Sequence: Synthetic peptide
  Seed: KPIIIGHHAY (IDH1 R132H)
KQIIIGHHAF

SEQ ID NO: 6851 - protein, 10 aa, Artificial Sequence
  Description of Artificial Sequence: Synthetic peptide
  Seed: KPIIIGHHAY (IDH1 R132H)
KQIIIGHHAL

SEQ ID NO: 6852 - protein, 10 aa, Artificial Sequence
  Description of Artificial Sequence: Synthetic peptide
  Seed: KPIIIGHHAY (IDH1 R132H)
KQIIIGHHAY

SEQ ID NO: 6853 - protein, 10 aa, Artificial Sequence
  Description of Artificial Sequence: Synthetic peptide
  Seed: KPIIIGHHAY (IDH1 R132H)
KRIIIGHHAF

SEQ ID NO: 6854 - protein, 10 aa, Artificial Sequence
  Description of Artificial Sequence: Synthetic peptide
  Seed: KPIIIGHHAY (IDH1 R132H)
KRIIIGHHAY

SEQ ID NO: 6855 - protein, 10 aa, Artificial Sequence
  Description of Artificial Sequence: Synthetic peptide
  Seed: KPIIIGHHAY (IDH1 R132H)
KSIIIGHHAF

SEQ ID NO: 6856 - protein, 10 aa, Artificial Sequence
  Description of Artificial Sequence: Synthetic peptide
  Seed: KPIIIGHHAY (IDH1 R132H)
KSIIIGHHAM

SEQ ID NO: 6857 - protein, 10 aa, Artificial Sequence
  Description of Artificial Sequence: Synthetic peptide
  Seed: KPIIIGHHAY (IDH1 R132H)
KSIIIGHHAY

SEQ ID NO: 6858 - protein, 10 aa, Artificial Sequence
  Description of Artificial Sequence: Synthetic peptide
  Seed: KPIIIGHHAY (IDH1 R132H)
KTIIIGHHAF

SEQ ID NO: 6859 - protein, 10 aa, Artificial Sequence
  Description of Artificial Sequence: Synthetic peptide
  Seed: KPIIIGHHAY (IDH1 R132H)
KTIIIGHHAM

SEQ ID NO: 6860 - protein, 10 aa, Artificial Sequence
  Description of Artificial Sequence: Synthetic peptide
  Seed: KPIIIGHHAY (IDH1 R132H)
KTIIIGHHAY

SEQ ID NO: 6861 - protein, 10 aa, Artificial Sequence
  Description of Artificial Sequence: Synthetic peptide
  Seed: KPIIIGHHAY (IDH1 R132H)
KVIIIGHHAF

SEQ ID NO: 6862 - protein, 10 aa, Artificial Sequence
  Description of Artificial Sequence: Synthetic peptide
  Seed: KPIIIGHHAY (IDH1 R132H)
KVIIIGHHAM

SEQ ID NO: 6863 - protein, 10 aa, Artificial Sequence
  Description of Artificial Sequence: Synthetic peptide
  Seed: KPIIIGHHAY (IDH1 R132H)
KVIIIGHHAY

SEQ ID NO: 6864 - protein, 10 aa, Artificial Sequence
  Description of Artificial Sequence: Synthetic peptide
  Seed: KPIIIGHHAY (IDH1 R132H)
KWIIIGHHAF

SEQ ID NO: 6865 - protein, 10 aa, Artificial Sequence
  Description of Artificial Sequence: Synthetic peptide
  Seed: KPIIIGHHAY (IDH1 R132H)
KWIIIGHHAY

SEQ ID NO: 6866 - protein, 10 aa, Artificial Sequence
  Description of Artificial Sequence: Synthetic peptide
  Seed: KPIIIGHHAY (IDH1 R132H)
KYIIIGHHAF

SEQ ID NO: 6867 - protein, 10 aa, Artificial Sequence
  Description of Artificial Sequence: Synthetic peptide
  Seed: KPIIIGHHAY (IDH1 R132H)
KYIIIGHHAY

SEQ ID NO: 6868 - protein, 9 aa, Artificial Sequence
  Description of Artificial Sequence: Synthetic peptide
  Seed: PIIIGHHAY (IDH1 R132H)
PFIIGHHAY

SEQ ID NO: 6869 - protein, 9 aa, Artificial Sequence
  Description of Artificial Sequence: Synthetic peptide
  Seed: PIIIGHHAY (IDH1 R132H)
PLIIGHHAY

SEQ ID NO: 6870 - protein, 9 aa, Artificial Sequence
  Description of Artificial Sequence: Synthetic peptide
  Seed: PIIIGHHAY (IDH1 R132H)
PMIIGHHAY

SEQ ID NO: 6871 - protein, 9 aa, Artificial Sequence
  Description of Artificial Sequence: Synthetic peptide
  Seed: PIIIGHHAY (IDH1 R132H)
PTIIGHHAY

SEQ ID NO: 6872 - protein, 9 aa, Artificial Sequence
  Description of Artificial Sequence: Synthetic peptide
  Seed: PIIIGHHAY (IDH1 R132H)
PVIIGHHAY

SEQ ID NO: 6873 - protein, 9 aa, Artificial Sequence
  Description of Artificial Sequence: Synthetic peptide
  Seed: PIIIGHHAY (IDH1 R132H)
PYIIGHHAY

SEQ ID NO: 6874 - protein, 10 aa, Artificial Sequence
  Description of Artificial Sequence: Synthetic peptide
  Seed: VKPIIIGHHA (IDH1 R132H)
VAPIIIGHHA

SEQ ID NO: 6875 - protein, 10 aa, Artificial Sequence
  Description of Artificial Sequence: Synthetic peptide
  Seed: VKPIIIGHHA (IDH1 R132H)
VCPIIIGHHA

SEQ ID NO: 6876 - protein, 10 aa, Artificial Sequence
  Description of Artificial Sequence: Synthetic peptide
  Seed: VKPIIIGHHA (IDH1 R132H)
VDPIIIGHHA

SEQ ID NO: 6877 - protein, 10 aa, Artificial Sequence
  Description of Artificial Sequence: Synthetic peptide
  Seed: VKPIIIGHHA (IDH1 R132H)
VEPIIIGHHA

SEQ ID NO: 6878 - protein, 10 aa, Artificial Sequence
  Description of Artificial Sequence: Synthetic peptide
  Seed: VKPIIIGHHA (IDH1 R132H)
VFPIIIGHHA

SEQ ID NO: 6879 - protein, 10 aa, Artificial Sequence
  Description of Artificial Sequence: Synthetic peptide
  Seed: VKPIIIGHHA (IDH1 R132H)
VFPIIIGHHV

SEQ ID NO: 6880 - protein, 10 aa, Artificial Sequence
  Description of Artificial Sequence: Synthetic peptide
  Seed: VKPIIIGHHA (IDH1 R132H)
VGPIIIGHHA

SEQ ID NO: 6881 - protein, 10 aa, Artificial Sequence
  Description of Artificial Sequence: Synthetic peptide
  Seed: VKPIIIGHHA (IDH1 R132H)
VHPIIIGHHA

SEQ ID NO: 6882 - protein, 11 aa, Artificial Sequence
  Description of Artificial Sequence: Synthetic peptide
  Seed: VKPIIIGHHAY (IDH1 R132H)
VHPIIIGHHAY

SEQ ID NO: 6883 - protein, 10 aa, Artificial Sequence
  Description of Artificial Sequence: Synthetic peptide
  Seed: VKPIIIGHHA (IDH1 R132H)
VIPIIIGHHA

SEQ ID NO: 6884 - protein, 11 aa, Artificial Sequence
  Description of Artificial Sequence: Synthetic peptide
  Seed: VKPIIIGHHAY (IDH1 R132H)
VKPIIIGHHAF

SEQ ID NO: 6885 - protein, 10 aa, Artificial Sequence
  Description of Artificial Sequence: Synthetic peptide
  Seed: VKPIIIGHHA (IDH1 R132H)
VLPIIIGHHA

SEQ ID NO: 6886 - protein, 11 aa, Artificial Sequence
  Description of Artificial Sequence: Synthetic peptide
  Seed: VKPIIIGHHAY (IDH1 R132H)
VMPIIIGHHAF

SEQ ID NO: 6887 - protein, 11 aa, Artificial Sequence
  Description of Artificial Sequence: Synthetic peptide
  Seed: VKPIIIGHHAY (IDH1 R132H)
VMPIIIGHHAY

SEQ ID NO: 6888 - protein, 10 aa, Artificial Sequence
  Description of Artificial Sequence: Synthetic peptide
  Seed: VKPIIIGHHA (IDH1 R132H)
VMPIIIGHHV

SEQ ID NO: 6889 - protein, 10 aa, Artificial Sequence
  Description of Artificial Sequence: Synthetic peptide
  Seed: VKPIIIGHHA (IDH1 R132H)
VNPIIIGHHA

SEQ ID NO: 6890 - protein, 10 aa, Artificial Sequence
  Description of Artificial Sequence: Synthetic peptide
  Seed: VKPIIIGHHA (IDH1 R132H)
VPPIIIGHHA

SEQ ID NO: 6891 - protein, 10 aa, Artificial Sequence
  Description of Artificial Sequence: Synthetic peptide
  Seed: VKPIIIGHHA (IDH1 R132H)
VQPIIIGHHA

SEQ ID NO: 6892 - protein, 11 aa, Artificial Sequence
  Description of Artificial Sequence: Synthetic peptide
  Seed: VKPIIIGHHAY (IDH1 R132H)
VQPIIIGHHAF

SEQ ID NO: 6893 - protein, 11 aa, Artificial Sequence
  Description of Artificial Sequence: Synthetic peptide
  Seed: VKPIIIGHHAY (IDH1 R132H)
VQPIIIGHHAM

SEQ ID NO: 6894 - protein, 11 aa, Artificial Sequence
  Description of Artificial Sequence: Synthetic peptide
  Seed: VKPIIIGHHAY (IDH1 R132H)
VQPIIIGHHAY

SEQ ID NO: 6895 - protein, 10 aa, Artificial Sequence
  Description of Artificial Sequence: Synthetic peptide
  Seed: VKPIIIGHHA (IDH1 R132H)
VRPIIIGHHA

SEQ ID NO: 6896 - protein, 10 aa, Artificial Sequence
  Description of Artificial Sequence: Synthetic peptide
  Seed: VKPIIIGHHA (IDH1 R132H)
VSPIIIGHHA

SEQ ID NO: 6897 - protein, 10 aa, Artificial Sequence
  Description of Artificial Sequence: Synthetic peptide
  Seed: VKPIIIGHHA (IDH1 R132H)
VTPIIIGHHA

SEQ ID NO: 6898 - protein, 10 aa, Artificial Sequence
  Description of Artificial Sequence: Synthetic peptide
  Seed: VKPIIIGHHA (IDH1 R132H)
VVPIIIGHHA

SEQ ID NO: 6899 - protein, 10 aa, Artificial Sequence
  Description of Artificial Sequence: Synthetic peptide
  Seed: VKPIIIGHHA (IDH1 R132H)
VWPIIIGHHA

SEQ ID NO: 6900 - protein, 10 aa, Artificial Sequence
  Description of Artificial Sequence: Synthetic peptide
  Seed: VKPIIIGHHA (IDH1 R132H)
VYPIIIGHHA

SEQ ID NO: 6901 - protein, 10 aa, Artificial Sequence
  Description of Artificial Sequence: Synthetic peptide
  Seed: VKPIIIGHHA (IDH1 R132H)
VYPIIIGHHV

SEQ ID NO: 6902 - protein, 9 aa, Artificial Sequence
  Description of Artificial Sequence: Synthetic peptide
  Seed: HHAYGDQYR (IDH1 R132H)
HAAYGDQYR

SEQ ID NO: 6903 - protein, 9 aa, Artificial Sequence
  Description of Artificial Sequence: Synthetic peptide
  Seed: HHAYGDQYR (IDH1 R132H)
HCAYGDQYR

SEQ ID NO: 6904 - protein, 9 aa, Artificial Sequence
  Description of Artificial Sequence: Synthetic peptide
  Seed: HHAYGDQYR (IDH1 R132H)
HDAYGDQYR

SEQ ID NO: 6905 - protein, 9 aa, Artificial Sequence
  Description of Artificial Sequence: Synthetic peptide
  Seed: HHAYGDQYR (IDH1 R132H)
HEAYGDQYR

SEQ ID NO: 6906 - protein, 9 aa, Artificial Sequence
  Description of Artificial Sequence: Synthetic peptide
  Seed: HHAYGDQYR (IDH1 R132H)
HFAYGDQYK

SEQ ID NO: 6907 - protein, 9 aa, Artificial Sequence
  Description of Artificial Sequence: Synthetic peptide
  Seed: HHAYGDQYR (IDH1 R132H)
HFAYGDQYR

SEQ ID NO: 6908 - protein, 9 aa, Artificial Sequence
  Description of Artificial Sequence: Synthetic peptide
  Seed: HHAYGDQYR (IDH1 R132H)
HGAYGDQYR

SEQ ID NO: 6909 - protein, 8 aa, Artificial Sequence
  Description of Artificial Sequence: Synthetic peptide
  Seed: HHAYGDQY (IDH1 R132H)
HHAYGDQI

SEQ ID NO: 6910 - protein, 8 aa, Artificial Sequence
  Description of Artificial Sequence: Synthetic peptide
  Seed: HHAYGDQY (IDH1 R132H)
HHAYGDQM

SEQ ID NO: 6911 - protein, 8 aa, Artificial Sequence
  Description of Artificial Sequence: Synthetic peptide
  Seed: HHAYGDQY (IDH1 R132H)
HHAYGDQV

SEQ ID NO: 6912 - protein, 8 aa, Artificial Sequence
  Description of Artificial Sequence: Synthetic peptide
  Seed: HHAYGDQY (IDH1 R132H)
HHAYGDQW

SEQ ID NO: 6913 - protein, 10 aa, Artificial Sequence
  Description of Artificial Sequence: Synthetic peptide
  Seed: HHAYGDQYRA (IDH1 R132H)
HHAYGDQYRC

SEQ ID NO: 6914 - protein, 10 aa, Artificial Sequence
  Description of Artificial Sequence: Synthetic peptide
  Seed: HHAYGDQYRA (IDH1 R132H)
HHAYGDQYRI

SEQ ID NO: 6915 - protein, 10 aa, Artificial Sequence
  Description of Artificial Sequence: Synthetic peptide
  Seed: HHAYGDQYRA (IDH1 R132H)
HHAYGDQYRL

SEQ ID NO: 6916 - protein, 10 aa, Artificial Sequence
  Description of Artificial Sequence: Synthetic peptide
  Seed: HHAYGDQYRA (IDH1 R132H)
HHAYGDQYRV

SEQ ID NO: 6917 - protein, 9 aa, Artificial Sequence
  Description of Artificial Sequence: Synthetic peptide
  Seed: HHAYGDQYR (IDH1 R132H)
HIAYGDQYR

SEQ ID NO: 6918 - protein, 9 aa, Artificial Sequence
  Description of Artificial Sequence: Synthetic peptide
  Seed: HHAYGDQYR (IDH1 R132H)
HLAYGDQYR

SEQ ID NO: 6919 - protein, 9 aa, Artificial Sequence
  Description of Artificial Sequence: Synthetic peptide
  Seed: HHAYGDQYR (IDH1 R132H)
HMAYGDQYR

SEQ ID NO: 6920 - protein, 9 aa, Artificial Sequence
  Description of Artificial Sequence: Synthetic peptide
  Seed: HHAYGDQYR (IDH1 R132H)
HNAYGDQYR

SEQ ID NO: 6921 - protein, 9 aa, Artificial Sequence
  Description of Artificial Sequence: Synthetic peptide
  Seed: HHAYGDQYR (IDH1 R132H)
HPAYGDQYR

SEQ ID NO: 6922 - protein, 8 aa, Artificial Sequence
  Description of Artificial Sequence: Synthetic peptide
  Seed: HHAYGDQY (IDH1 R132H)
HQAYGDQF

SEQ ID NO: 6923 - protein, 8 aa, Artificial Sequence
  Description of Artificial Sequence: Synthetic peptide
  Seed: HHAYGDQY (IDH1 R132H)
HQAYGDQI

SEQ ID NO: 6924 - protein, 8 aa, Artificial Sequence
  Description of Artificial Sequence: Synthetic peptide
  Seed: HHAYGDQY (IDH1 R132H)
HQAYGDQL

SEQ ID NO: 6925 - protein, 8 aa, Artificial Sequence
  Description of Artificial Sequence: Synthetic peptide
  Seed: HHAYGDQY (IDH1 R132H)
HQAYGDQY

SEQ ID NO: 6926 - protein, 9 aa, Artificial Sequence
  Description of Artificial Sequence: Synthetic peptide
  Seed: HHAYGDQYR (IDH1 R132H)
HQAYGDQYR

SEQ ID NO: 6927 - protein, 8 aa, Artificial Sequence
  Description of Artificial Sequence: Synthetic peptide
  Seed: HHAYGDQY (IDH1 R132H)
HRAYGDQF

SEQ ID NO: 6928 - protein, 8 aa, Artificial Sequence
  Description of Artificial Sequence: Synthetic peptide
  Seed: HHAYGDQY (IDH1 R132H)
HRAYGDQL

SEQ ID NO: 6929 - protein, 8 aa, Artificial Sequence
  Description of Artificial Sequence: Synthetic peptide
  Seed: HHAYGDQY (IDH1 R132H)
HRAYGDQY

SEQ ID NO: 6930 - protein, 9 aa, Artificial Sequence
  Description of Artificial Sequence: Synthetic peptide
  Seed: HHAYGDQYR (IDH1 R132H)
HSAYGDQYR

SEQ ID NO: 6931 - protein, 9 aa, Artificial Sequence
  Description of Artificial Sequence: Synthetic peptide
  Seed: HHAYGDQYR (IDH1 R132H)
HTAYGDQYK

SEQ ID NO: 6932 - protein, 9 aa, Artificial Sequence
  Description of Artificial Sequence: Synthetic peptide
  Seed: HHAYGDQYR (IDH1 R132H)
HVAYGDQYK

SEQ ID NO: 6933 - protein, 9 aa, Artificial Sequence
  Description of Artificial Sequence: Synthetic peptide
  Seed: HHAYGDQYR (IDH1 R132H)
HVAYGDQYR

SEQ ID NO: 6934 - protein, 9 aa, Artificial Sequence
  Description of Artificial Sequence: Synthetic peptide
  Seed: HHAYGDQYR (IDH1 R132H)
HWAYGDQYR

SEQ ID NO: 6935 - protein, 9 aa, Artificial Sequence
  Description of Artificial Sequence: Synthetic peptide
  Seed: HHAYGDQYR (IDH1 R132H)
HYAYGDQYK

SEQ ID NO: 6936 - protein, 11 aa, Artificial Sequence
  Description of Artificial Sequence: Synthetic peptide
  Seed: IIGHHAYGDQY (IDH1 R132H)
IAGHHAYGDQY

SEQ ID NO: 6937 - protein, 10 aa, Artificial Sequence
  Description of Artificial Sequence: Synthetic peptide
  Seed: IGHHAYGDQY (IDH1 R132H)
IAHHAYGDQL

SEQ ID NO: 6938 - protein, 10 aa, Artificial Sequence
  Description of Artificial Sequence: Synthetic peptide
  Seed: IGHHAYGDQY (IDH1 R132H)
IAHHAYGDQM

SEQ ID NO: 6939 - protein, 8 aa, Artificial Sequence
  Description of Artificial Sequence: Synthetic peptide
  Seed: IIIGHHAY (IDH1 R132H)
IAIGHHAH

SEQ ID NO: 6940 - protein, 8 aa, Artificial Sequence
  Description of Artificial Sequence: Synthetic peptide
  Seed: IIIGHHAY (IDH1 R132H)
IAIGHHAI

SEQ ID NO: 6941 - protein, 8 aa, Artificial Sequence
  Description of Artificial Sequence: Synthetic peptide
  Seed: IIIGHHAY (IDH1 R132H)
IAIGHHAK

SEQ ID NO: 6942 - protein, 8 aa, Artificial Sequence
  Description of Artificial Sequence: Synthetic peptide
  Seed: IIIGHHAY (IDH1 R132H)
IAIGHHAM

SEQ ID NO: 6943 - protein, 8 aa, Artificial Sequence
  Description of Artificial Sequence: Synthetic peptide
  Seed: IIIGHHAY (IDH1 R132H)
IAIGHHAV

SEQ ID NO: 6944 - protein, 8 aa, Artificial Sequence
  Description of Artificial Sequence: Synthetic peptide
  Seed: IIIGHHAY (IDH1 R132H)
IAIGHHAW

SEQ ID NO: 6945 - protein, 8 aa, Artificial Sequence
  Description of Artificial Sequence: Synthetic peptide
  Seed: IIIGHHAY (IDH1 R132H)
ICIGHHAF

SEQ ID NO: 6946 - protein, 8 aa, Artificial Sequence
  Description of Artificial Sequence: Synthetic peptide
  Seed: IIIGHHAY (IDH1 R132H)
ICIGHHAL

SEQ ID NO: 6947 - protein, 8 aa, Artificial Sequence
  Description of Artificial Sequence: Synthetic peptide
  Seed: IIIGHHAY (IDH1 R132H)
ICIGHHAM

SEQ ID NO: 6948 - protein, 8 aa, Artificial Sequence
  Description of Artificial Sequence: Synthetic peptide
  Seed: IIIGHHAY (IDH1 R132H)
ICIGHHAY

SEQ ID NO: 6949 - protein, 8 aa, Artificial Sequence
  Description of Artificial Sequence: Synthetic peptide
  Seed: IIIGHHAY (IDH1 R132H)
IDIGHHAF

SEQ ID NO: 6950 - protein, 8 aa, Artificial Sequence
  Description of Artificial Sequence: Synthetic peptide
  Seed: IIIGHHAY (IDH1 R132H)
IDIGHHAY

SEQ ID NO: 6951 - protein, 8 aa, Artificial Sequence
  Description of Artificial Sequence: Synthetic peptide
  Seed: IIIGHHAY (IDH1 R132H)
IEIGHHAL

SEQ ID NO: 6952 - protein, 8 aa, Artificial Sequence
  Description of Artificial Sequence: Synthetic peptide
  Seed: IIIGHHAY (IDH1 R132H)
IEIGHHAM

SEQ ID NO: 6953 - protein, 8 aa, Artificial Sequence
  Description of Artificial Sequence: Synthetic peptide
  Seed: IIIGHHAY (IDH1 R132H)
IFIGHHAF

SEQ ID NO: 6954 - protein, 8 aa, Artificial Sequence
  Description of Artificial Sequence: Synthetic peptide
  Seed: IIIGHHAY (IDH1 R132H)
IFIGHHAL

SEQ ID NO: 6955 - protein, 8 aa, Artificial Sequence
  Description of Artificial Sequence: Synthetic peptide
  Seed: IIIGHHAY (IDH1 R132H)
IFIGHHAM

SEQ ID NO: 6956 - protein, 8 aa, Artificial Sequence
  Description of Artificial Sequence: Synthetic peptide
  Seed: IIIGHHAY (IDH1 R132H)
IFIGHHAY

SEQ ID NO: 6957 - protein, 8 aa, Artificial Sequence
  Description of Artificial Sequence: Synthetic peptide
  Seed: IIIGHHAY (IDH1 R132H)
IGIGHHAF

SEQ ID NO: 6958 - protein, 8 aa, Artificial Sequence
  Description of Artificial Sequence: Synthetic peptide
  Seed: IIIGHHAY (IDH1 R132H)
IGIGHHAI

SEQ ID NO: 6959 - protein, 8 aa, Artificial Sequence
  Description of Artificial Sequence: Synthetic peptide
  Seed: IIIGHHAY (IDH1 R132H)
IGIGHHAK

SEQ ID NO: 6960 - protein, 8 aa, Artificial Sequence
  Description of Artificial Sequence: Synthetic peptide
  Seed: IIIGHHAY (IDH1 R132H)
IGIGHHAL

SEQ ID NO: 6961 - protein, 8 aa, Artificial Sequence
  Description of Artificial Sequence: Synthetic peptide
  Seed: IIIGHHAY (IDH1 R132H)
IGIGHHAM

SEQ ID NO: 6962 - protein, 8 aa, Artificial Sequence
  Description of Artificial Sequence: Synthetic peptide
  Seed: IIIGHHAY (IDH1 R132H)
IGIGHHAR

SEQ ID NO: 6963 - protein, 8 aa, Artificial Sequence
  Description of Artificial Sequence: Synthetic peptide
  Seed: IIIGHHAY (IDH1 R132H)
IGIGHHAY

SEQ ID NO: 6964 - protein, 8 aa, Artificial Sequence
  Description of Artificial Sequence: Synthetic peptide
  Seed: IIIGHHAY (IDH1 R132H)
IIIGHHAK

SEQ ID NO: 6965 - protein, 8 aa, Artificial Sequence
  Description of Artificial Sequence: Synthetic peptide
  Seed: IIIGHHAY (IDH1 R132H)
IIIGHHAL

SEQ ID NO: 6966 - protein, 8 aa, Artificial Sequence
  Description of Artificial Sequence: Synthetic peptide
  Seed: IIIGHHAY (IDH1 R132H)
IIIGHHAM

SEQ ID NO: 6967 - protein, 8 aa, Artificial Sequence
  Description of Artificial Sequence: Synthetic peptide
  Seed: IIIGHHAY (IDH1 R132H)
ILIGHHAL

SEQ ID NO: 6968 - protein, 11 aa, Artificial Sequence
  Description of Artificial Sequence: Synthetic peptide
  Seed: IIGHHAYGDQY (IDH1 R132H)
IMGHHAYGDQY

SEQ ID NO: 6969 - protein, 8 aa, Artificial Sequence
  Description of Artificial Sequence: Synthetic peptide
  Seed: IIIGHHAY (IDH1 R132H)
INIGHHAF

SEQ ID NO: 6970 - protein, 8 aa, Artificial Sequence
  Description of Artificial Sequence: Synthetic peptide
  Seed: IIIGHHAY (IDH1 R132H)
INIGHHAK

SEQ ID NO: 6971 - protein, 8 aa, Artificial Sequence
  Description of Artificial Sequence: Synthetic peptide
  Seed: IIIGHHAY (IDH1 R132H)
INIGHHAL

SEQ ID NO: 6972 - protein, 8 aa, Artificial Sequence
  Description of Artificial Sequence: Synthetic peptide
  Seed: IIIGHHAY (IDH1 R132H)
INIGHHAM

SEQ ID NO: 6973 - protein, 8 aa, Artificial Sequence
  Description of Artificial Sequence: Synthetic peptide
  Seed: IIIGHHAY (IDH1 R132H)
INIGHHAY

SEQ ID NO: 6974 - protein, 10 aa, Artificial Sequence
  Description of Artificial Sequence: Synthetic peptide
  Seed: IGHHAYGDQY (IDH1 R132H)
IPHHAYGDQF

SEQ ID NO: 6975 - protein, 8 aa, Artificial Sequence
  Description of Artificial Sequence: Synthetic peptide
  Seed: IIIGHHAY (IDH1 R132H)
IPIGHHAF

SEQ ID NO: 6976 - protein, 11 aa, Artificial Sequence
  Description of Artificial Sequence: Synthetic peptide
  Seed: IIGHHAYGDQY (IDH1 R132H)
ISGHHAYGDQK

SEQ ID NO: 6977 - protein, 11 aa, Artificial Sequence
  Description of Artificial Sequence: Synthetic peptide
  Seed: IIGHHAYGDQY (IDH1 R132H)
ISGHHAYGDQY

SEQ ID NO: 6978 - protein, 8 aa, Artificial Sequence
  Description of Artificial Sequence: Synthetic peptide
  Seed: IIIGHHAY (IDH1 R132H)
ISIGHHAH

SEQ ID NO: 6979 - protein, 8 aa, Artificial Sequence
  Description of Artificial Sequence: Synthetic peptide
  Seed: IIIGHHAY (IDH1 R132H)
ISIGHHAI

SEQ ID NO: 6980 - protein, 8 aa, Artificial Sequence
  Description of Artificial Sequence: Synthetic peptide
  Seed: IIIGHHAY (IDH1 R132H)
ISIGHHAK

SEQ ID NO: 6981 - protein, 8 aa, Artificial Sequence
  Description of Artificial Sequence: Synthetic peptide
  Seed: IIIGHHAY (IDH1 R132H)
ISIGHHAL

SEQ ID NO: 6982 - protein, 8 aa, Artificial Sequence
  Description of Artificial Sequence: Synthetic peptide
  Seed: IIIGHHAY (IDH1 R132H)
ISIGHHAM

SEQ ID NO: 6983 - protein, 8 aa, Artificial Sequence
  Description of Artificial Sequence: Synthetic peptide
  Seed: IIIGHHAY (IDH1 R132H)
ISIGHHAV

SEQ ID NO: 6984 - protein, 8 aa, Artificial Sequence
  Description of Artificial Sequence: Synthetic peptide
  Seed: IIIGHHAY (IDH1 R132H)
ISIGHHAW

SEQ ID NO: 6985 - protein, 11 aa, Artificial Sequence
  Description of Artificial Sequence: Synthetic peptide
  Seed: IIGHHAYGDQY (IDH1 R132H)
ITGHHAYGDQK

SEQ ID NO: 6986 - protein, 11 aa, Artificial Sequence
  Description of Artificial Sequence: Synthetic peptide
  Seed: IIGHHAYGDQY (IDH1 R132H)
ITGHHAYGDQY

SEQ ID NO: 6987 - protein, 8 aa, Artificial Sequence
  Description of Artificial Sequence: Synthetic peptide
  Seed: IIIGHHAY (IDH1 R132H)
ITIGHHAI

SEQ ID NO: 6988 - protein, 8 aa, Artificial Sequence
  Description of Artificial Sequence: Synthetic peptide
  Seed: IIIGHHAY (IDH1 R132H)
ITIGHHAK

SEQ ID NO: 6989 - protein, 8 aa, Artificial Sequence
  Description of Artificial Sequence: Synthetic peptide
  Seed: IIIGHHAY (IDH1 R132H)
ITIGHHAL

SEQ ID NO: 6990 - protein, 8 aa, Artificial Sequence
  Description of Artificial Sequence: Synthetic peptide
  Seed: IIIGHHAY (IDH1 R132H)
ITIGHHAM

SEQ ID NO: 6991 - protein, 8 aa, Artificial Sequence
  Description of Artificial Sequence: Synthetic peptide
  Seed: IIIGHHAY (IDH1 R132H)
ITIGHHAV

SEQ ID NO: 6992 - protein, 8 aa, Artificial Sequence
  Description of Artificial Sequence: Synthetic peptide
  Seed: IIIGHHAY (IDH1 R132H)
ITIGHHAW

SEQ ID NO: 6993 - protein, 11 aa, Artificial Sequence
  Description of Artificial Sequence: Synthetic peptide
  Seed: IIGHHAYGDQY (IDH1 R132H)
IVGHHAYGDQY

SEQ ID NO: 6994 - protein, 8 aa, Artificial Sequence
  Description of Artificial Sequence: Synthetic peptide
  Seed: IIIGHHAY (IDH1 R132H)
IVIGHHAI

SEQ ID NO: 6995 - protein, 8 aa, Artificial Sequence
  Description of Artificial Sequence: Synthetic peptide
  Seed: IIIGHHAY (IDH1 R132H)
IVIGHHAK

SEQ ID NO: 6996 - protein, 8 aa, Artificial Sequence
  Description of Artificial Sequence: Synthetic peptide
  Seed: IIIGHHAY (IDH1 R132H)
IVIGHHAL

SEQ ID NO: 6997 - protein, 8 aa, Artificial Sequence
  Description of Artificial Sequence: Synthetic peptide
  Seed: IIIGHHAY (IDH1 R132H)
IVIGHHAM

SEQ ID NO: 6998 - protein, 8 aa, Artificial Sequence
  Description of Artificial Sequence: Synthetic peptide
  Seed: IIIGHHAY (IDH1 R132H)
IWIGHHAF

SEQ ID NO: 6999 - protein, 8 aa, Artificial Sequence
  Description of Artificial Sequence: Synthetic peptide
  Seed: IIIGHHAY (IDH1 R132H)
IWIGHHAL

SEQ ID NO: 7000 - protein, 8 aa, Artificial Sequence
  Description of Artificial Sequence: Synthetic peptide
  Seed: IIIGHHAY (IDH1 R132H)
IWIGHHAY

SEQ ID NO: 7001 - protein, 8 aa, Artificial Sequence
  Description of Artificial Sequence: Synthetic peptide
  Seed: IIIGHHAY (IDH1 R132H)
IYIGHHAF

SEQ ID NO: 7002 - protein, 8 aa, Artificial Sequence
  Description of Artificial Sequence: Synthetic peptide
  Seed: IIIGHHAY (IDH1 R132H)
IYIGHHAL

SEQ ID NO: 7003 - protein, 8 aa, Artificial Sequence
  Description of Artificial Sequence: Synthetic peptide
  Seed: IIIGHHAY (IDH1 R132H)
IYIGHHAM

SEQ ID NO: 7004 - protein, 8 aa, Artificial Sequence
  Description of Artificial Sequence: Synthetic peptide
  Seed: IIIGHHAY (IDH1 R132H)
IYIGHHAY

SEQ ID NO: 7005 - protein, 9 aa, Artificial Sequence
  Description of Artificial Sequence: Synthetic peptide
  Seed: KPIIIGHHA (IDH1 R132H)
KAIIIGHHA

SEQ ID NO: 7006 - protein, 10 aa, Artificial Sequence
  Description of Artificial Sequence: Synthetic peptide
  Seed: KPIIIGHHAY (IDH1 R132H)
KAIIIGHHAW

SEQ ID NO: 7007 - protein, 9 aa, Artificial Sequence
  Description of Artificial Sequence: Synthetic peptide
  Seed: KPIIIGHHA (IDH1 R132H)
KAIIIGHHL

SEQ ID NO: 7008 - protein, 9 aa, Artificial Sequence
  Description of Artificial Sequence: Synthetic peptide
  Seed: KPIIIGHHA (IDH1 R132H)
KAIIIGHHM

SEQ ID NO: 7009 - protein, 9 aa, Artificial Sequence
  Description of Artificial Sequence: Synthetic peptide
  Seed: KPIIIGHHA (IDH1 R132H)
KHIIIGHHC

SEQ ID NO: 7010 - protein, 9 aa, Artificial Sequence
  Description of Artificial Sequence: Synthetic peptide
  Seed: KPIIIGHHA (IDH1 R132H)
KHIIIGHHF

SEQ ID NO: 7011 - protein, 9 aa, Artificial Sequence
  Description of Artificial Sequence: Synthetic peptide
  Seed: KPIIIGHHA (IDH1 R132H)
KHIIIGHHG

SEQ ID NO: 7012 - protein, 9 aa, Artificial Sequence
  Description of Artificial Sequence: Synthetic peptide
  Seed: KPIIIGHHA (IDH1 R132H)
KHIIIGHHI

SEQ ID NO: 7013 - protein, 9 aa, Artificial Sequence
  Description of Artificial Sequence: Synthetic peptide
  Seed: KPIIIGHHA (IDH1 R132H)
KHIIIGHHL

SEQ ID NO: 7014 - protein, 9 aa, Artificial Sequence
  Description of Artificial Sequence: Synthetic peptide
  Seed: KPIIIGHHA (IDH1 R132H)
KHIIIGHHM

SEQ ID NO: 7015 - protein, 9 aa, Artificial Sequence
  Description of Artificial Sequence: Synthetic peptide
  Seed: KPIIIGHHA (IDH1 R132H)
KHIIIGHHP

SEQ ID NO: 7016 - protein, 9 aa, Artificial Sequence
  Description of Artificial Sequence: Synthetic peptide
  Seed: KPIIIGHHA (IDH1 R132H)
KHIIIGHHS

SEQ ID NO: 7017 - protein, 9 aa, Artificial Sequence
  Description of Artificial Sequence: Synthetic peptide
  Seed: KPIIIGHHA (IDH1 R132H)
KHIIIGHHT

SEQ ID NO: 7018 - protein, 9 aa, Artificial Sequence
  Description of Artificial Sequence: Synthetic peptide
  Seed: KPIIIGHHA (IDH1 R132H)
KHIIIGHHV

SEQ ID NO: 7019 - protein, 10 aa, Artificial Sequence
  Description of Artificial Sequence: Synthetic peptide
  Seed: KPIIIGHHAY (IDH1 R132H)
KLIIIGHHAL

SEQ ID NO: 7020 - protein, 10 aa, Artificial Sequence
  Description of Artificial Sequence: Synthetic peptide
  Seed: KPIIIGHHAY (IDH1 R132H)
KMIIIGHHAW

SEQ ID NO: 7021 - protein, 10 aa, Artificial Sequence
  Description of Artificial Sequence: Synthetic peptide
  Seed: KPIIIGHHAY (IDH1 R132H)
KPIIIGHHAA

SEQ ID NO: 7022 - protein, 10 aa, Artificial Sequence
  Description of Artificial Sequence: Synthetic peptide
  Seed: KPIIIGHHAY (IDH1 R132H)
KPIIIGHHAC

SEQ ID NO: 7023 - protein, 10 aa, Artificial Sequence
  Description of Artificial Sequence: Synthetic peptide
  Seed: KPIIIGHHAY (IDH1 R132H)
KPIIIGHHAG

SEQ ID NO: 7024 - protein, 10 aa, Artificial Sequence
  Description of Artificial Sequence: Synthetic peptide
  Seed: KPIIIGHHAY (IDH1 R132H)
KPIIIGHHAI

SEQ ID NO: 7025 - protein, 10 aa, Artificial Sequence
  Description of Artificial Sequence: Synthetic peptide
  Seed: KPIIIGHHAY (IDH1 R132H)
KPIIIGHHAL

SEQ ID NO: 7026 - protein, 10 aa, Artificial Sequence
  Description of Artificial Sequence: Synthetic peptide
  Seed: KPIIIGHHAY (IDH1 R132H)
KPIIIGHHAP

SEQ ID NO: 7027 - protein, 10 aa, Artificial Sequence
  Description of Artificial Sequence: Synthetic peptide
  Seed: KPIIIGHHAY (IDH1 R132H)
KPIIIGHHAS

SEQ ID NO: 7028 - protein, 10 aa, Artificial Sequence
  Description of Artificial Sequence: Synthetic peptide
  Seed: KPIIIGHHAY (IDH1 R132H)
KPIIIGHHAT

SEQ ID NO: 7029 - protein, 10 aa, Artificial Sequence
  Description of Artificial Sequence: Synthetic peptide
  Seed: KPIIIGHHAY (IDH1 R132H)
KPIIIGHHAV

SEQ ID NO: 7030 - protein, 10 aa, Artificial Sequence
  Description of Artificial Sequence: Synthetic peptide
  Seed: KPIIIGHHAY (IDH1 R132H)
KPIIIGHHAW

SEQ ID NO: 7031 - protein, 9 aa, Artificial Sequence
  Description of Artificial Sequence: Synthetic peptide
  Seed: KPIIIGHHA (IDH1 R132H)
KPIIIGHHC

SEQ ID NO: 7032 - protein, 9 aa, Artificial Sequence
  Description of Artificial Sequence: Synthetic peptide
  Seed: KPIIIGHHA (IDH1 R132H)
KPIIIGHHG

SEQ ID NO: 7033 - protein, 9 aa, Artificial Sequence
  Description of Artificial Sequence: Synthetic peptide
  Seed: KPIIIGHHA (IDH1 R132H)
KPIIIGHHP

SEQ ID NO: 7034 - protein, 9 aa, Artificial Sequence
  Description of Artificial Sequence: Synthetic peptide
  Seed: KPIIIGHHA (IDH1 R132H)
KPIIIGHHS

SEQ ID NO: 7035 - protein, 9 aa, Artificial Sequence
  Description of Artificial Sequence: Synthetic peptide
  Seed: KPIIIGHHA (IDH1 R132H)
KPIIIGHHT

SEQ ID NO: 7036 - protein, 9 aa, Artificial Sequence
  Description of Artificial Sequence: Synthetic peptide
  Seed: KPIIIGHHA (IDH1 R132H)
KPIIIGHHW

SEQ ID NO: 7037 - protein, 9 aa, Artificial Sequence
  Description of Artificial Sequence: Synthetic peptide
  Seed: KPIIIGHHA (IDH1 R132H)
KPIIIGHHY

SEQ ID NO: 7038 - protein, 9 aa, Artificial Sequence
  Description of Artificial Sequence: Synthetic peptide
  Seed: KPIIIGHHA (IDH1 R132H)
KQIIIGHHA

SEQ ID NO: 7039 - protein, 10 aa, Artificial Sequence
  Description of Artificial Sequence: Synthetic peptide
  Seed: KPIIIGHHAY (IDH1 R132H)
KQIIIGHHAH

SEQ ID NO: 7040 - protein, 10 aa, Artificial Sequence
  Description of Artificial Sequence: Synthetic peptide
  Seed: KPIIIGHHAY (IDH1 R132H)
KQIIIGHHAI

SEQ ID NO: 7041 - protein, 10 aa, Artificial Sequence
  Description of Artificial Sequence: Synthetic peptide
  Seed: KPIIIGHHAY (IDH1 R132H)
KQIIIGHHAV

SEQ ID NO: 7042 - protein, 10 aa, Artificial Sequence
  Description of Artificial Sequence: Synthetic peptide
  Seed: KPIIIGHHAY (IDH1 R132H)
KQIIIGHHAW

SEQ ID NO: 7043 - protein, 9 aa, Artificial Sequence
  Description of Artificial Sequence: Synthetic peptide
  Seed: KPIIIGHHA (IDH1 R132H)
KQIIIGHHI

SEQ ID NO: 7044 - protein, 9 aa, Artificial Sequence
  Description of Artificial Sequence: Synthetic peptide
  Seed: KPIIIGHHA (IDH1 R132H)
KQIIIGHHL

SEQ ID NO: 7045 - protein, 9 aa, Artificial Sequence
  Description of Artificial Sequence: Synthetic peptide
  Seed: KPIIIGHHA (IDH1 R132H)
KQIIIGHHV

SEQ ID NO: 7046 - protein, 9 aa, Artificial Sequence
  Description of Artificial Sequence: Synthetic peptide
  Seed: KPIIIGHHA (IDH1 R132H)
KRIIIGHHA

SEQ ID NO: 7047 - protein, 9 aa, Artificial Sequence
  Description of Artificial Sequence: Synthetic peptide
  Seed: KPIIIGHHA (IDH1 R132H)
KRIIIGHHC

SEQ ID NO: 7048 - protein, 9 aa, Artificial Sequence
  Description of Artificial Sequence: Synthetic peptide
  Seed: KPIIIGHHA (IDH1 R132H)
KRIIIGHHI

SEQ ID NO: 7049 - protein, 9 aa, Artificial Sequence
  Description of Artificial Sequence: Synthetic peptide
  Seed: KPIIIGHHA (IDH1 R132H)
KRIIIGHHL

SEQ ID NO: 7050 - protein, 9 aa, Artificial Sequence
  Description of Artificial Sequence: Synthetic peptide
  Seed: KPIIIGHHA (IDH1 R132H)
KRIIIGHHV

SEQ ID NO: 7051 - protein, 9 aa, Artificial Sequence
  Description of Artificial Sequence: Synthetic peptide
  Seed: PIIIGHHAY (IDH1 R132H)
PAIIGHHAF

SEQ ID NO: 7052 - protein, 9 aa, Artificial Sequence
  Description of Artificial Sequence: Synthetic peptide
  Seed: PIIIGHHAY (IDH1 R132H)
PAIIGHHAL

SEQ ID NO: 7053 - protein, 9 aa, Artificial Sequence
  Description of Artificial Sequence: Synthetic peptide
  Seed: PIIIGHHAY (IDH1 R132H)
PAIIGHHAM

SEQ ID NO: 7054 - protein, 9 aa, Artificial Sequence
  Description of Artificial Sequence: Synthetic peptide
  Seed: PIIIGHHAY (IDH1 R132H)
PCIIGHHAY

SEQ ID NO: 7055 - protein, 9 aa, Artificial Sequence
  Description of Artificial Sequence: Synthetic peptide
  Seed: PIIIGHHAY (IDH1 R132H)
PDIIGHHAF

SEQ ID NO: 7056 - protein, 9 aa, Artificial Sequence
  Description of Artificial Sequence: Synthetic peptide
  Seed: PIIIGHHAY (IDH1 R132H)
PDIIGHHAY

SEQ ID NO: 7057 - protein, 9 aa, Artificial Sequence
  Description of Artificial Sequence: Synthetic peptide
  Seed: PIIIGHHAY (IDH1 R132H)
PEIIGHHAF

SEQ ID NO: 7058 - protein, 9 aa, Artificial Sequence
  Description of Artificial Sequence: Synthetic peptide
  Seed: PIIIGHHAY (IDH1 R132H)
PEIIGHHAM

SEQ ID NO: 7059 - protein, 9 aa, Artificial Sequence
  Description of Artificial Sequence: Synthetic peptide
  Seed: PIIIGHHAY (IDH1 R132H)
PEIIGHHAY

SEQ ID NO: 7060 - protein, 9 aa, Artificial Sequence
  Description of Artificial Sequence: Synthetic peptide
  Seed: PIIIGHHAY (IDH1 R132H)
PFIIGHHAF

SEQ ID NO: 7061 - protein, 9 aa, Artificial Sequence
  Description of Artificial Sequence: Synthetic peptide
  Seed: PIIIGHHAY (IDH1 R132H)
PGIIGHHAF

SEQ ID NO: 7062 - protein, 9 aa, Artificial Sequence
  Description of Artificial Sequence: Synthetic peptide
  Seed: PIIIGHHAY (IDH1 R132H)
PGIIGHHAY

SEQ ID NO: 7063 - protein, 9 aa, Artificial Sequence
  Description of Artificial Sequence: Synthetic peptide
  Seed: PIIIGHHAY (IDH1 R132H)
PHIIGHHAY

SEQ ID NO: 7064 - protein, 9 aa, Artificial Sequence
  Description of Artificial Sequence: Synthetic peptide
  Seed: PIIIGHHAY (IDH1 R132H)
PIIIGHHAF

SEQ ID NO: 7065 - protein, 9 aa, Artificial Sequence
  Description of Artificial Sequence: Synthetic peptide
  Seed: PIIIGHHAY (IDH1 R132H)
PIIIGHHAM

SEQ ID NO: 7066 - protein, 9 aa, Artificial Sequence
  Description of Artificial Sequence: Synthetic peptide
  Seed: PIIIGHHAY (IDH1 R132H)
PKIIGHHAY

SEQ ID NO: 7067 - protein, 9 aa, Artificial Sequence
  Description of Artificial Sequence: Synthetic peptide
  Seed: PIIIGHHAY (IDH1 R132H)
PLIIGHHAF

SEQ ID NO: 7068 - protein, 9 aa, Artificial Sequence
  Description of Artificial Sequence: Synthetic peptide
  Seed: PIIIGHHAY (IDH1 R132H)
PLIIGHHAM

SEQ ID NO: 7069 - protein, 9 aa, Artificial Sequence
  Description of Artificial Sequence: Synthetic peptide
  Seed: PIIIGHHAY (IDH1 R132H)
PMIIGHHAF

SEQ ID NO: 7070 - protein, 9 aa, Artificial Sequence
  Description of Artificial Sequence: Synthetic peptide
  Seed: PIIIGHHAY (IDH1 R132H)
PMIIGHHAM

SEQ ID NO: 7071 - protein, 9 aa, Artificial Sequence
  Description of Artificial Sequence: Synthetic peptide
  Seed: PIIIGHHAY (IDH1 R132H)
PNIIGHHAF

SEQ ID NO: 7072 - protein, 9 aa, Artificial Sequence
  Description of Artificial Sequence: Synthetic peptide
  Seed: PIIIGHHAY (IDH1 R132H)
PNIIGHHAY

SEQ ID NO: 7073 - protein, 9 aa, Artificial Sequence
  Description of Artificial Sequence: Synthetic peptide
  Seed: PIIIGHHAY (IDH1 R132H)
PPIIGHHAF

SEQ ID NO: 7074 - protein, 9 aa, Artificial Sequence
  Description of Artificial Sequence: Synthetic peptide
  Seed: PIIIGHHAY (IDH1 R132H)
PPIIGHHAM

SEQ ID NO: 7075 - protein, 9 aa, Artificial Sequence
  Description of Artificial Sequence: Synthetic peptide
  Seed: PIIIGHHAY (IDH1 R132H)
PQIIGHHAF

SEQ ID NO: 7076 - protein, 9 aa, Artificial Sequence
  Description of Artificial Sequence: Synthetic peptide
  Seed: PIIIGHHAY (IDH1 R132H)
PQIIGHHAL

SEQ ID NO: 7077 - protein, 9 aa, Artificial Sequence
  Description of Artificial Sequence: Synthetic peptide
  Seed: PIIIGHHAY (IDH1 R132H)
PQIIGHHAM

SEQ ID NO: 7078 - protein, 9 aa, Artificial Sequence
  Description of Artificial Sequence: Synthetic peptide
  Seed: PIIIGHHAY (IDH1 R132H)
PQIIGHHAW

SEQ ID NO: 7079 - protein, 9 aa, Artificial Sequence
  Description of Artificial Sequence: Synthetic peptide
  Seed: PIIIGHHAY (IDH1 R132H)
PQIIGHHAY

SEQ ID NO: 7080 - protein, 9 aa, Artificial Sequence
  Description of Artificial Sequence: Synthetic peptide
  Seed: PIIIGHHAY (IDH1 R132H)
PRIIGHHAY

SEQ ID NO: 7081 - protein, 9 aa, Artificial Sequence
  Description of Artificial Sequence: Synthetic peptide
  Seed: PIIIGHHAY (IDH1 R132H)
PSIIGHHAF

SEQ ID NO: 7082 - protein, 9 aa, Artificial Sequence
  Description of Artificial Sequence: Synthetic peptide
  Seed: PIIIGHHAY (IDH1 R132H)
PSIIGHHAM

SEQ ID NO: 7083 - protein, 9 aa, Artificial Sequence
  Description of Artificial Sequence: Synthetic peptide
  Seed: PIIIGHHAY (IDH1 R132H)
PSIIGHHAY

SEQ ID NO: 7084 - protein, 9 aa, Artificial Sequence
  Description of Artificial Sequence: Synthetic peptide
  Seed: PIIIGHHAY (IDH1 R132H)
PTIIGHHAF

SEQ ID NO: 7085 - protein, 9 aa, Artificial Sequence
  Description of Artificial Sequence: Synthetic peptide
  Seed: PIIIGHHAY (IDH1 R132H)
PVIIGHHAF

SEQ ID NO: 7086 - protein, 9 aa, Artificial Sequence
  Description of Artificial Sequence: Synthetic peptide
  Seed: PIIIGHHAY (IDH1 R132H)
PVIIGHHAM

SEQ ID NO: 7087 - protein, 9 aa, Artificial Sequence
  Description of Artificial Sequence: Synthetic peptide
  Seed: PIIIGHHAY (IDH1 R132H)
PWIIGHHAY

SEQ ID NO: 7088 - protein, 10 aa, Homo sapiens
  Native (IDH1 R132H)
HHAYGDQYRA

SEQ ID NO: 7089 - protein, 10 aa, Homo sapiens
  Native (IDH1 R132H)
IGHHAYGDQY

SEQ ID NO: 7090 - protein, 11 aa, Homo sapiens
  Native (IDH1 R132H)
IGHHAYGDQYR

SEQ ID NO: 7091 - protein, 8 aa, Homo sapiens
  Native (IDH1 R132H)
IIIGHHAY

SEQ ID NO: 7092 - protein, 10 aa, Homo sapiens
  Native (IDH1 R132H)
KPIIIGHHAY

SEQ ID NO: 7093 - protein, 9 aa, Homo sapiens
  Native (IDH1 R132H)
PIIIGHHAY

SEQ ID NO: 7094 - protein, 10 aa, Homo sapiens
  Native (IDH1 R132H)
VKPIIIGHHA

SEQ ID NO: 7095 - protein, 11 aa, Homo sapiens
  Native (IDH1 R132H)
VKPIIIGHHAY

SEQ ID NO: 7096 - protein, 8 aa, Homo sapiens
  Native (IDH1 R132H)
HHAYGDQY

SEQ ID NO: 7097 - protein, 9 aa, Homo sapiens
  Native (IDH1 R132H)
HHAYGDQYR

SEQ ID NO: 7098 - protein, 11 aa, Homo sapiens
  Native (IDH1 R132H)
IIGHHAYGDQY

SEQ ID NO: 7099 - protein, 10 aa, Artificial Sequence
  Description of Artificial Sequence: Synthetic peptide
  Seed: KLVVVGAAGV (KRAS G12A)
KAVVVGAAGV

SEQ ID NO: 7100 - protein, 10 aa, Artificial Sequence
  Description of Artificial Sequence: Synthetic peptide
  Seed: KLVVVGAAGV (KRAS G12A)
KCVVVGAAGV

SEQ ID NO: 7101 - protein, 10 aa, Artificial Sequence
  Description of Artificial Sequence: Synthetic peptide
  Seed: KLVVVGAAGV (KRAS G12A)
KDVVVGAAGV

SEQ ID NO: 7102 - protein, 10 aa, Artificial Sequence
  Description of Artificial Sequence: Synthetic peptide
  Seed: KLVVVGAAGV (KRAS G12A)
KEVVVGAAGV

SEQ ID NO: 7103 - protein, 10 aa, Artificial Sequence
  Description of Artificial Sequence: Synthetic peptide
  Seed: KLVVVGAAGV (KRAS G12A)
KFVVVGAAGV

SEQ ID NO: 7104 - protein, 10 aa, Artificial Sequence
  Description of Artificial Sequence: Synthetic peptide
  Seed: KLVVVGAAGV (KRAS G12A)
KGVVVGAAGV

SEQ ID NO: 7105 - protein, 10 aa, Artificial Sequence
  Description of Artificial Sequence: Synthetic peptide
  Seed: KLVVVGAAGV (KRAS G12A)
KHVVVGAAGV

SEQ ID NO: 7106 - protein, 10 aa, Artificial Sequence
  Description of Artificial Sequence: Synthetic peptide
  Seed: KLVVVGAAGV (KRAS G12A)
KIVVVGAAGV

SEQ ID NO: 7107 - protein, 10 aa, Artificial Sequence
  Description of Artificial Sequence: Synthetic peptide
  Seed: KLVVVGAAGV (KRAS G12A)
KKVVVGAAGV

SEQ ID NO: 7108 - protein, 10 aa, Artificial Sequence
  Description of Artificial Sequence: Synthetic peptide
  Seed: KLVVVGAAGV (KRAS G12A)
KLVVVGAAGA

SEQ ID NO: 7109 - protein, 10 aa, Artificial Sequence
  Description of Artificial Sequence: Synthetic peptide
  Seed: KLVVVGAAGV (KRAS G12A)
KLVVVGAAGI

SEQ ID NO: 7110 - protein, 10 aa, Artificial Sequence
  Description of Artificial Sequence: Synthetic peptide
  Seed: KLVVVGAAGV (KRAS G12A)
KLVVVGAAGL

SEQ ID NO: 7111 - protein, 10 aa, Artificial Sequence
  Description of Artificial Sequence: Synthetic peptide
  Seed: KLVVVGAAGV (KRAS G12A)
KLVVVGAAGM

SEQ ID NO: 7112 - protein, 10 aa, Artificial Sequence
  Description of Artificial Sequence: Synthetic peptide
  Seed: KLVVVGAAGV (KRAS G12A)
KMVVVGAAGA

SEQ ID NO: 7113 - protein, 10 aa, Artificial Sequence
  Description of Artificial Sequence: Synthetic peptide
  Seed: KLVVVGAAGV (KRAS G12A)
KMVVVGAAGI

SEQ ID NO: 7114 - protein, 10 aa, Artificial Sequence
  Description of Artificial Sequence: Synthetic peptide
  Seed: KLVVVGAAGV (KRAS G12A)
KMVVVGAAGL

SEQ ID NO: 7115 - protein, 10 aa, Artificial Sequence
  Description of Artificial Sequence: Synthetic peptide
  Seed: KLVVVGAAGV (KRAS G12A)
KMVVVGAAGM

SEQ ID NO: 7116 - protein, 10 aa, Artificial Sequence
  Description of Artificial Sequence: Synthetic peptide
  Seed: KLVVVGAAGV (KRAS G12A)
KMVVVGAAGV

SEQ ID NO: 7117 - protein, 10 aa, Artificial Sequence
  Description of Artificial Sequence: Synthetic peptide
  Seed: KLVVVGAAGV (KRAS G12A)
KNVVVGAAGV

SEQ ID NO: 7118 - protein, 10 aa, Artificial Sequence
  Description of Artificial Sequence: Synthetic peptide
  Seed: KLVVVGAAGV (KRAS G12A)
KPVVVGAAGV

SEQ ID NO: 7119 - protein, 10 aa, Artificial Sequence
  Description of Artificial Sequence: Synthetic peptide
  Seed: KLVVVGAAGV (KRAS G12A)
KQVVVGAAGI

SEQ ID NO: 7120 - protein, 10 aa, Artificial Sequence
  Description of Artificial Sequence: Synthetic peptide
  Seed: KLVVVGAAGV (KRAS G12A)
KQVVVGAAGL

SEQ ID NO: 7121 - protein, 10 aa, Artificial Sequence
  Description of Artificial Sequence: Synthetic peptide
  Seed: KLVVVGAAGV (KRAS G12A)
KQVVVGAAGV

SEQ ID NO: 7122 - protein, 10 aa, Artificial Sequence
  Description of Artificial Sequence: Synthetic peptide
  Seed: KLVVVGAAGV (KRAS G12A)
KRVVVGAAGV

SEQ ID NO: 7123 - protein, 10 aa, Artificial Sequence
  Description of Artificial Sequence: Synthetic peptide
  Seed: KLVVVGAAGV (KRAS G12A)
KSVVVGAAGV

SEQ ID NO: 7124 - protein, 10 aa, Artificial Sequence
  Description of Artificial Sequence: Synthetic peptide
  Seed: KLVVVGAAGV (KRAS G12A)
KTVVVGAAGV

SEQ ID NO: 7125 - protein, 10 aa, Artificial Sequence
  Description of Artificial Sequence: Synthetic peptide
  Seed: KLVVVGAAGV (KRAS G12A)
KVVVVGAAGV

SEQ ID NO: 7126 - protein, 10 aa, Artificial Sequence
  Description of Artificial Sequence: Synthetic peptide
  Seed: KLVVVGAAGV (KRAS G12A)
KWVVVGAAGV

SEQ ID NO: 7127 - protein, 10 aa, Artificial Sequence
  Description of Artificial Sequence: Synthetic peptide
  Seed: KLVVVGAAGV (KRAS G12A)
KYVVVGAAGV

SEQ ID NO: 7128 - protein, 9 aa, Artificial Sequence
  Description of Artificial Sequence: Synthetic peptide
  Seed: LVVVGAAGV (KRAS G12A)
LAVVGAAGI

SEQ ID NO: 7129 - protein, 9 aa, Artificial Sequence
  Description of Artificial Sequence: Synthetic peptide
  Seed: LVVVGAAGV (KRAS G12A)
LAVVGAAGV

SEQ ID NO: 7130 - protein, 9 aa, Artificial Sequence
  Description of Artificial Sequence: Synthetic peptide
  Seed: LVVVGAAGV (KRAS G12A)
LIVVGAAGA

SEQ ID NO: 7131 - protein, 9 aa, Artificial Sequence
  Description of Artificial Sequence: Synthetic peptide
  Seed: LVVVGAAGV (KRAS G12A)
LIVVGAAGI

SEQ ID NO: 7132 - protein, 9 aa, Artificial Sequence
  Description of Artificial Sequence: Synthetic peptide
  Seed: LVVVGAAGV (KRAS G12A)
LIVVGAAGL

SEQ ID NO: 7133 - protein, 9 aa, Artificial Sequence
  Description of Artificial Sequence: Synthetic peptide
  Seed: LVVVGAAGV (KRAS G12A)
LIVVGAAGV

SEQ ID NO: 7134 - protein, 9 aa, Artificial Sequence
  Description of Artificial Sequence: Synthetic peptide
  Seed: LVVVGAAGV (KRAS G12A)
LLVVGAAGA

SEQ ID NO: 7135 - protein, 9 aa, Artificial Sequence
  Description of Artificial Sequence: Synthetic peptide
  Seed: LVVVGAAGV (KRAS G12A)
LLVVGAAGI

SEQ ID NO: 7136 - protein, 9 aa, Artificial Sequence
  Description of Artificial Sequence: Synthetic peptide
  Seed: LVVVGAAGV (KRAS G12A)
LLVVGAAGL

SEQ ID NO: 7137 - protein, 9 aa, Artificial Sequence
  Description of Artificial Sequence: Synthetic peptide
  Seed: LVVVGAAGV (KRAS G12A)
LLVVGAAGM

SEQ ID NO: 7138 - protein, 9 aa, Artificial Sequence
  Description of Artificial Sequence: Synthetic peptide
  Seed: LVVVGAAGV (KRAS G12A)
LLVVGAAGT

SEQ ID NO: 7139 - protein, 9 aa, Artificial Sequence
  Description of Artificial Sequence: Synthetic peptide
  Seed: LVVVGAAGV (KRAS G12A)
LMVVGAAGA

SEQ ID NO: 7140 - protein, 9 aa, Artificial Sequence
  Description of Artificial Sequence: Synthetic peptide
  Seed: LVVVGAAGV (KRAS G12A)
LMVVGAAGI

SEQ ID NO: 7141 - protein, 9 aa, Artificial Sequence
  Description of Artificial Sequence: Synthetic peptide
  Seed: LVVVGAAGV (KRAS G12A)
LMVVGAAGL

SEQ ID NO: 7142 - protein, 9 aa, Artificial Sequence
  Description of Artificial Sequence: Synthetic peptide
  Seed: LVVVGAAGV (KRAS G12A)
LMVVGAAGM

SEQ ID NO: 7143 - protein, 9 aa, Artificial Sequence
  Description of Artificial Sequence: Synthetic peptide
  Seed: LVVVGAAGV (KRAS G12A)
LMVVGAAGT

SEQ ID NO: 7144 - protein, 9 aa, Artificial Sequence
  Description of Artificial Sequence: Synthetic peptide
  Seed: LVVVGAAGV (KRAS G12A)
LQVVGAAGA

SEQ ID NO: 7145 - protein, 9 aa, Artificial Sequence
  Description of Artificial Sequence: Synthetic peptide
  Seed: LVVVGAAGV (KRAS G12A)
LQVVGAAGI

SEQ ID NO: 7146 - protein, 9 aa, Artificial Sequence
  Description of Artificial Sequence: Synthetic peptide
  Seed: LVVVGAAGV (KRAS G12A)
LQVVGAAGL

SEQ ID NO: 7147 - protein, 9 aa, Artificial Sequence
  Description of Artificial Sequence: Synthetic peptide
  Seed: LVVVGAAGV (KRAS G12A)
LQVVGAAGM

SEQ ID NO: 7148 - protein, 9 aa, Artificial Sequence
  Description of Artificial Sequence: Synthetic peptide
  Seed: LVVVGAAGV (KRAS G12A)
LSVVGAAGI

SEQ ID NO: 7149 - protein, 9 aa, Artificial Sequence
  Description of Artificial Sequence: Synthetic peptide
  Seed: LVVVGAAGV (KRAS G12A)
LSVVGAAGV

SEQ ID NO: 7150 - protein, 9 aa, Artificial Sequence
  Description of Artificial Sequence: Synthetic peptide
  Seed: LVVVGAAGV (KRAS G12A)
LTVVGAAGA

SEQ ID NO: 7151 - protein, 9 aa, Artificial Sequence
  Description of Artificial Sequence: Synthetic peptide
  Seed: LVVVGAAGV (KRAS G12A)
LTVVGAAGI

SEQ ID NO: 7152 - protein, 9 aa, Artificial Sequence
  Description of Artificial Sequence: Synthetic peptide
  Seed: LVVVGAAGV (KRAS G12A)
LTVVGAAGL

SEQ ID NO: 7153 - protein, 9 aa, Artificial Sequence
  Description of Artificial Sequence: Synthetic peptide
  Seed: LVVVGAAGV (KRAS G12A)
LTVVGAAGM

SEQ ID NO: 7154 - protein, 9 aa, Artificial Sequence
  Description of Artificial Sequence: Synthetic peptide
  Seed: LVVVGAAGV (KRAS G12A)
LVVVGAAGI

SEQ ID NO: 7155 - protein, 9 aa, Artificial Sequence
  Description of Artificial Sequence: Synthetic peptide
  Seed: LVVVGAAGV (KRAS G12A)
LVVVGAAGL

SEQ ID NO: 7156 - protein, 9 aa, Artificial Sequence
  Description of Artificial Sequence: Synthetic peptide
  Seed: VVGAAGVGK (KRAS G12A)
VAGAAGVGK

SEQ ID NO: 7157 - protein, 10 aa, Artificial Sequence
  Description of Artificial Sequence: Synthetic peptide
  Seed: VVVGAAGVGK (KRAS G12A)
VAVGAAGVGK

SEQ ID NO: 7158 - protein, 10 aa, Artificial Sequence
  Description of Artificial Sequence: Synthetic peptide
  Seed: VVVGAAGVGK (KRAS G12A)
VAVGAAGVGR

SEQ ID NO: 7159 - protein, 10 aa, Artificial Sequence
  Description of Artificial Sequence: Synthetic peptide
  Seed: VVVGAAGVGK (KRAS G12A)
VCVGAAGVGK

SEQ ID NO: 7160 - protein, 10 aa, Artificial Sequence
  Description of Artificial Sequence: Synthetic peptide
  Seed: VVVGAAGVGK (KRAS G12A)
VDVGAAGVGK

SEQ ID NO: 7161 - protein, 10 aa, Artificial Sequence
  Description of Artificial Sequence: Synthetic peptide
  Seed: VVVGAAGVGK (KRAS G12A)
VDVGAAGVGR

SEQ ID NO: 7162 - protein, 10 aa, Artificial Sequence
  Description of Artificial Sequence: Synthetic peptide
  Seed: VVVGAAGVGK (KRAS G12A)
VEVGAAGVGK

SEQ ID NO: 7163 - protein, 10 aa, Artificial Sequence
  Description of Artificial Sequence: Synthetic peptide
  Seed: VVVGAAGVGK (KRAS G12A)
VEVGAAGVGR

SEQ ID NO: 7164 - protein, 10 aa, Artificial Sequence
  Description of Artificial Sequence: Synthetic peptide
  Seed: VVVGAAGVGK (KRAS G12A)
VFVGAAGVGK

SEQ ID NO: 7165 - protein, 10 aa, Artificial Sequence
  Description of Artificial Sequence: Synthetic peptide
  Seed: VVVGAAGVGK (KRAS G12A)
VFVGAAGVGR

SEQ ID NO: 7166 - protein, 10 aa, Artificial Sequence
  Description of Artificial Sequence: Synthetic peptide
  Seed: VVVGAAGVGK (KRAS G12A)
VGVGAAGVGK

SEQ ID NO: 7167 - protein, 10 aa, Artificial Sequence
  Description of Artificial Sequence: Synthetic peptide
  Seed: VVVGAAGVGK (KRAS G12A)
VHVGAAGVGK

SEQ ID NO: 7168 - protein, 10 aa, Artificial Sequence
  Description of Artificial Sequence: Synthetic peptide
  Seed: VVVGAAGVGK (KRAS G12A)
VHVGAAGVGR

SEQ ID NO: 7169 - protein, 9 aa, Artificial Sequence
  Description of Artificial Sequence: Synthetic peptide
  Seed: VVGAAGVGK (KRAS G12A)
VIGAAGVGK

SEQ ID NO: 7170 - protein, 10 aa, Artificial Sequence
  Description of Artificial Sequence: Synthetic peptide
  Seed: VVVGAAGVGK (KRAS G12A)
VIVGAAGVGK

SEQ ID NO: 7171 - protein, 10 aa, Artificial Sequence
  Description of Artificial Sequence: Synthetic peptide
  Seed: VVVGAAGVGK (KRAS G12A)
VIVGAAGVGR

SEQ ID NO: 7172 - protein, 10 aa, Artificial Sequence
  Description of Artificial Sequence: Synthetic peptide
  Seed: VVVGAAGVGK (KRAS G12A)
VKVGAAGVGK

SEQ ID NO: 7173 - protein, 9 aa, Artificial Sequence
  Description of Artificial Sequence: Synthetic peptide
  Seed: VVGAAGVGK (KRAS G12A)
VLGAAGVGK

SEQ ID NO: 7174 - protein, 10 aa, Artificial Sequence
  Description of Artificial Sequence: Synthetic peptide
  Seed: VVVGAAGVGK (KRAS G12A)
VLVGAAGVGK

SEQ ID NO: 7175 - protein, 10 aa, Artificial Sequence
  Description of Artificial Sequence: Synthetic peptide
  Seed: VVVGAAGVGK (KRAS G12A)
VLVGAAGVGR

SEQ ID NO: 7176 - protein, 9 aa, Artificial Sequence
  Description of Artificial Sequence: Synthetic peptide
  Seed: VVGAAGVGK (KRAS G12A)
VMGAAGVGK

SEQ ID NO: 7177 - protein, 9 aa, Artificial Sequence
  Description of Artificial Sequence: Synthetic peptide
  Seed: VVGAAGVGK (KRAS G12A)
VMGAAGVGR

SEQ ID NO: 7178 - protein, 10 aa, Artificial Sequence
  Description of Artificial Sequence: Synthetic peptide
  Seed: VVVGAAGVGK (KRAS G12A)
VMVGAAGVGR

SEQ ID NO: 7179 - protein, 10 aa, Artificial Sequence
  Description of Artificial Sequence: Synthetic peptide
  Seed: VVVGAAGVGK (KRAS G12A)
VNVGAAGVGK

SEQ ID NO: 7180 - protein, 10 aa, Artificial Sequence
  Description of Artificial Sequence: Synthetic peptide
  Seed: VVVGAAGVGK (KRAS G12A)
VNVGAAGVGR

SEQ ID NO: 7181 - protein, 10 aa, Artificial Sequence
  Description of Artificial Sequence: Synthetic peptide
  Seed: VVVGAAGVGK (KRAS G12A)
VPVGAAGVGK

SEQ ID NO: 7182 - protein, 10 aa, Artificial Sequence
  Description of Artificial Sequence: Synthetic peptide
  Seed: VVVGAAGVGK (KRAS G12A)
VPVGAAGVGR

SEQ ID NO: 7183 - protein, 9 aa, Artificial Sequence
  Description of Artificial Sequence: Synthetic peptide
  Seed: VVGAAGVGK (KRAS G12A)
VQGAAGVGK

SEQ ID NO: 7184 - protein, 10 aa, Artificial Sequence
  Description of Artificial Sequence: Synthetic peptide
  Seed: VVVGAAGVGK (KRAS G12A)
VQVGAAGVGK

SEQ ID NO: 7185 - protein, 10 aa, Artificial Sequence
  Description of Artificial Sequence: Synthetic peptide
  Seed: VVVGAAGVGK (KRAS G12A)
VRVGAAGVGK

SEQ ID NO: 7186 - protein, 9 aa, Artificial Sequence
  Description of Artificial Sequence: Synthetic peptide
  Seed: VVGAAGVGK (KRAS G12A)
VSGAAGVGK

SEQ ID NO: 7187 - protein, 10 aa, Artificial Sequence
  Description of Artificial Sequence: Synthetic peptide
  Seed: VVVGAAGVGK (KRAS G12A)
VSVGAAGVGK

SEQ ID NO: 7188 - protein, 10 aa, Artificial Sequence
  Description of Artificial Sequence: Synthetic peptide
  Seed: VVVGAAGVGK (KRAS G12A)
VSVGAAGVGR

SEQ ID NO: 7189 - protein, 9 aa, Artificial Sequence
  Description of Artificial Sequence: Synthetic peptide
  Seed: VVGAAGVGK (KRAS G12A)
VTGAAGVGK

SEQ ID NO: 7190 - protein, 9 aa, Artificial Sequence
  Description of Artificial Sequence: Synthetic peptide
  Seed: VVGAAGVGK (KRAS G12A)
VVGAAGVGR

SEQ ID NO: 7191 - protein, 10 aa, Artificial Sequence
  Description of Artificial Sequence: Synthetic peptide
  Seed: VVVGAAGVGK (KRAS G12A)
VWVGAAGVGK

SEQ ID NO: 7192 - protein, 10 aa, Artificial Sequence
  Description of Artificial Sequence: Synthetic peptide
  Seed: VVVGAAGVGK (KRAS G12A)
VWVGAAGVGR

SEQ ID NO: 7193 - protein, 10 aa, Artificial Sequence
  Description of Artificial Sequence: Synthetic peptide
  Seed: VVVGAAGVGK (KRAS G12A)
VYVGAAGVGK

SEQ ID NO: 7194 - protein, 10 aa, Artificial Sequence
  Description of Artificial Sequence: Synthetic peptide
  Seed: VVVGAAGVGK (KRAS G12A)
VYVGAAGVGR

SEQ ID NO: 7195 - protein, 10 aa, Artificial Sequence
  Description of Artificial Sequence: Synthetic peptide
  Seed: GAAGVGKSAL (KRAS G12A)
GAAGVGKSAA

SEQ ID NO: 7196 - protein, 10 aa, Artificial Sequence
  Description of Artificial Sequence: Synthetic peptide
  Seed: GAAGVGKSAL (KRAS G12A)
GAAGVGKSAC

SEQ ID NO: 7197 - protein, 10 aa, Artificial Sequence
  Description of Artificial Sequence: Synthetic peptide
  Seed: GAAGVGKSAL (KRAS G12A)
GAAGVGKSAF

SEQ ID NO: 7198 - protein, 10 aa, Artificial Sequence
  Description of Artificial Sequence: Synthetic peptide
  Seed: GAAGVGKSAL (KRAS G12A)
GAAGVGKSAH

SEQ ID NO: 7199 - protein, 10 aa, Artificial Sequence
  Description of Artificial Sequence: Synthetic peptide
  Seed: GAAGVGKSAL (KRAS G12A)
GAAGVGKSAI

SEQ ID NO: 7200 - protein, 10 aa, Artificial Sequence
  Description of Artificial Sequence: Synthetic peptide
  Seed: GAAGVGKSAL (KRAS G12A)
GAAGVGKSAK

SEQ ID NO: 7201 - protein, 10 aa, Artificial Sequence
  Description of Artificial Sequence: Synthetic peptide
  Seed: GAAGVGKSAL (KRAS G12A)
GAAGVGKSAM

SEQ ID NO: 7202 - protein, 10 aa, Artificial Sequence
  Description of Artificial Sequence: Synthetic peptide
  Seed: GAAGVGKSAL (KRAS G12A)
GAAGVGKSAR

SEQ ID NO: 7203 - protein, 10 aa, Artificial Sequence
  Description of Artificial Sequence: Synthetic peptide
  Seed: GAAGVGKSAL (KRAS G12A)
GAAGVGKSAV

SEQ ID NO: 7204 - protein, 10 aa, Artificial Sequence
  Description of Artificial Sequence: Synthetic peptide
  Seed: GAAGVGKSAL (KRAS G12A)
GAAGVGKSAW

SEQ ID NO: 7205 - protein, 10 aa, Artificial Sequence
  Description of Artificial Sequence: Synthetic peptide
  Seed: GAAGVGKSAL (KRAS G12A)
GAAGVGKSAY

SEQ ID NO: 7206 - protein, 9 aa, Artificial Sequence
  Description of Artificial Sequence: Synthetic peptide
  Seed: GAAGVGKSA (KRAS G12A)
GAAGVGKSC

SEQ ID NO: 7207 - protein, 9 aa, Artificial Sequence
  Description of Artificial Sequence: Synthetic peptide
  Seed: GAAGVGKSA (KRAS G12A)
GAAGVGKSF

SEQ ID NO: 7208 - protein, 9 aa, Artificial Sequence
  Description of Artificial Sequence: Synthetic peptide
  Seed: GAAGVGKSA (KRAS G12A)
GAAGVGKSG

SEQ ID NO: 7209 - protein, 9 aa, Artificial Sequence
  Description of Artificial Sequence: Synthetic peptide
  Seed: GAAGVGKSA (KRAS G12A)
GAAGVGKSH

SEQ ID NO: 7210 - protein, 9 aa, Artificial Sequence
  Description of Artificial Sequence: Synthetic peptide
  Seed: GAAGVGKSA (KRAS G12A)
GAAGVGKSI

SEQ ID NO: 7211 - protein, 9 aa, Artificial Sequence
  Description of Artificial Sequence: Synthetic peptide
  Seed: GAAGVGKSA (KRAS G12A)
GAAGVGKSK

SEQ ID NO: 7212 - protein, 9 aa, Artificial Sequence
  Description of Artificial Sequence: Synthetic peptide
  Seed: GAAGVGKSA (KRAS G12A)
GAAGVGKSP

SEQ ID NO: 7213 - protein, 9 aa, Artificial Sequence
  Description of Artificial Sequence: Synthetic peptide
  Seed: GAAGVGKSA (KRAS G12A)
GAAGVGKSQ

SEQ ID NO: 7214 - protein, 9 aa, Artificial Sequence
  Description of Artificial Sequence: Synthetic peptide
  Seed: GAAGVGKSA (KRAS G12A)
GAAGVGKSR

SEQ ID NO: 7215 - protein, 9 aa, Artificial Sequence
  Description of Artificial Sequence: Synthetic peptide
  Seed: GAAGVGKSA (KRAS G12A)
GAAGVGKSS

SEQ ID NO: 7216 - protein, 9 aa, Artificial Sequence
  Description of Artificial Sequence: Synthetic peptide
  Seed: GAAGVGKSA (KRAS G12A)
GAAGVGKST

SEQ ID NO: 7217 - protein, 9 aa, Artificial Sequence
  Description of Artificial Sequence: Synthetic peptide
  Seed: GAAGVGKSA (KRAS G12A)
GAAGVGKSV

SEQ ID NO: 7218 - protein, 9 aa, Artificial Sequence
  Description of Artificial Sequence: Synthetic peptide
  Seed: GAAGVGKSA (KRAS G12A)
GAAGVGKSW

SEQ ID NO: 7219 - protein, 9 aa, Artificial Sequence
  Description of Artificial Sequence: Synthetic peptide
  Seed: GAAGVGKSA (KRAS G12A)
GAAGVGKSY

SEQ ID NO: 7220 - protein, 10 aa, Artificial Sequence
  Description of Artificial Sequence: Synthetic peptide
  Seed: GAAGVGKSAL (KRAS G12A)
GCAGVGKSAF

SEQ ID NO: 7221 - protein, 10 aa, Artificial Sequence
  Description of Artificial Sequence: Synthetic peptide
  Seed: GAAGVGKSAL (KRAS G12A)
GCAGVGKSAK

SEQ ID NO: 7222 - protein, 10 aa, Artificial Sequence
  Description of Artificial Sequence: Synthetic peptide
  Seed: GAAGVGKSAL (KRAS G12A)
GCAGVGKSAR

SEQ ID NO: 7223 - protein, 10 aa, Artificial Sequence
  Description of Artificial Sequence: Synthetic peptide
  Seed: GAAGVGKSAL (KRAS G12A)
GCAGVGKSAY

SEQ ID NO: 7224 - protein, 9 aa, Artificial Sequence
  Description of Artificial Sequence: Synthetic peptide
  Seed: GAAGVGKSA (KRAS G12A)
GCAGVGKSF

SEQ ID NO: 7225 - protein, 9 aa, Artificial Sequence
  Description of Artificial Sequence: Synthetic peptide
  Seed: GAAGVGKSA (KRAS G12A)
GCAGVGKSK

SEQ ID NO: 7226 - protein, 9 aa, Artificial Sequence
  Description of Artificial Sequence: Synthetic peptide
  Seed: GAAGVGKSA (KRAS G12A)
GCAGVGKSL

SEQ ID NO: 7227 - protein, 9 aa, Artificial Sequence
  Description of Artificial Sequence: Synthetic peptide
  Seed: GAAGVGKSA (KRAS G12A)
GCAGVGKSM

SEQ ID NO: 7228 - protein, 9 aa, Artificial Sequence
  Description of Artificial Sequence: Synthetic peptide
  Seed: GAAGVGKSA (KRAS G12A)
GCAGVGKSR

SEQ ID NO: 7229 - protein, 9 aa, Artificial Sequence
  Description of Artificial Sequence: Synthetic peptide
  Seed: GAAGVGKSA (KRAS G12A)
GCAGVGKSY

SEQ ID NO: 7230 - protein, 10 aa, Artificial Sequence
  Description of Artificial Sequence: Synthetic peptide
  Seed: GAAGVGKSAL (KRAS G12A)
GDAGVGKSAK

SEQ ID NO: 7231 - protein, 10 aa, Artificial Sequence
  Description of Artificial Sequence: Synthetic peptide
  Seed: GAAGVGKSAL (KRAS G12A)
GDAGVGKSAR

SEQ ID NO: 7232 - protein, 10 aa, Artificial Sequence
  Description of Artificial Sequence: Synthetic peptide
  Seed: GAAGVGKSAL (KRAS G12A)
GDAGVGKSAY

SEQ ID NO: 7233 - protein, 9 aa, Artificial Sequence
  Description of Artificial Sequence: Synthetic peptide
  Seed: GAAGVGKSA (KRAS G12A)
GDAGVGKSF

SEQ ID NO: 7234 - protein, 9 aa, Artificial Sequence
  Description of Artificial Sequence: Synthetic peptide
  Seed: GAAGVGKSA (KRAS G12A)
GDAGVGKSK

SEQ ID NO: 7235 - protein, 9 aa, Artificial Sequence
  Description of Artificial Sequence: Synthetic peptide
  Seed: GAAGVGKSA (KRAS G12A)
GDAGVGKSR

SEQ ID NO: 7236 - protein, 9 aa, Artificial Sequence
  Description of Artificial Sequence: Synthetic peptide
  Seed: GAAGVGKSA (KRAS G12A)
GDAGVGKSY

SEQ ID NO: 7237 - protein, 10 aa, Artificial Sequence
  Description of Artificial Sequence: Synthetic peptide
  Seed: GAAGVGKSAL (KRAS G12A)
GEAGVGKSAF

SEQ ID NO: 7238 - protein, 10 aa, Artificial Sequence
  Description of Artificial Sequence: Synthetic peptide
  Seed: GAAGVGKSAL (KRAS G12A)
GEAGVGKSAK

SEQ ID NO: 7239 - protein, 10 aa, Artificial Sequence
  Description of Artificial Sequence: Synthetic peptide
  Seed: GAAGVGKSAL (KRAS G12A)
GEAGVGKSAL

SEQ ID NO: 7240 - protein, 10 aa, Artificial Sequence
  Description of Artificial Sequence: Synthetic peptide
  Seed: GAAGVGKSAL (KRAS G12A)
GEAGVGKSAM

SEQ ID NO: 7241 - protein, 10 aa, Artificial Sequence
  Description of Artificial Sequence: Synthetic peptide
  Seed: GAAGVGKSAL (KRAS G12A)
GEAGVGKSAR

SEQ ID NO: 7242 - protein, 10 aa, Artificial Sequence
  Description of Artificial Sequence: Synthetic peptide
  Seed: GAAGVGKSAL (KRAS G12A)
GEAGVGKSAY

SEQ ID NO: 7243 - protein, 9 aa, Artificial Sequence
  Description of Artificial Sequence: Synthetic peptide
  Seed: GAAGVGKSA (KRAS G12A)
GEAGVGKSF

SEQ ID NO: 7244 - protein, 9 aa, Artificial Sequence
  Description of Artificial Sequence: Synthetic peptide
  Seed: GAAGVGKSA (KRAS G12A)
GEAGVGKSK

SEQ ID NO: 7245 - protein, 9 aa, Artificial Sequence
  Description of Artificial Sequence: Synthetic peptide
  Seed: GAAGVGKSA (KRAS G12A)
GEAGVGKSL

SEQ ID NO: 7246 - protein, 9 aa, Artificial Sequence
  Description of Artificial Sequence: Synthetic peptide
  Seed: GAAGVGKSA (KRAS G12A)
GEAGVGKSM

SEQ ID NO: 7247 - protein, 9 aa, Artificial Sequence
  Description of Artificial Sequence: Synthetic peptide
  Seed: GAAGVGKSA (KRAS G12A)
GEAGVGKSR

SEQ ID NO: 7248 - protein, 9 aa, Artificial Sequence
  Description of Artificial Sequence: Synthetic peptide
  Seed: GAAGVGKSA (KRAS G12A)
GEAGVGKSW

SEQ ID NO: 7249 - protein, 9 aa, Artificial Sequence
  Description of Artificial Sequence: Synthetic peptide
  Seed: GAAGVGKSA (KRAS G12A)
GEAGVGKSY

SEQ ID NO: 7250 - protein, 10 aa, Artificial Sequence
  Description of Artificial Sequence: Synthetic peptide
  Seed: GAAGVGKSAL (KRAS G12A)
GFAGVGKSAF

SEQ ID NO: 7251 - protein, 10 aa, Artificial Sequence
  Description of Artificial Sequence: Synthetic peptide
  Seed: GAAGVGKSAL (KRAS G12A)
GFAGVGKSAK

SEQ ID NO: 7252 - protein, 10 aa, Artificial Sequence
  Description of Artificial Sequence: Synthetic peptide
  Seed: GAAGVGKSAL (KRAS G12A)
GFAGVGKSAL

SEQ ID NO: 7253 - protein, 10 aa, Artificial Sequence
  Description of Artificial Sequence: Synthetic peptide
  Seed: GAAGVGKSAL (KRAS G12A)
GFAGVGKSAY

SEQ ID NO: 7254 - protein, 9 aa, Artificial Sequence
  Description of Artificial Sequence: Synthetic peptide
  Seed: GAAGVGKSA (KRAS G12A)
GFAGVGKSF

SEQ ID NO: 7255 - protein, 9 aa, Artificial Sequence
  Description of Artificial Sequence: Synthetic peptide
  Seed: GAAGVGKSA (KRAS G12A)
GFAGVGKSK

SEQ ID NO: 7256 - protein, 9 aa, Artificial Sequence
  Description of Artificial Sequence: Synthetic peptide
  Seed: GAAGVGKSA (KRAS G12A)
GFAGVGKSM

SEQ ID NO: 7257 - protein, 9 aa, Artificial Sequence
  Description of Artificial Sequence: Synthetic peptide
  Seed: GAAGVGKSA (KRAS G12A)
GFAGVGKSR

SEQ ID NO: 7258 - protein, 9 aa, Artificial Sequence
  Description of Artificial Sequence: Synthetic peptide
  Seed: GAAGVGKSA (KRAS G12A)
GFAGVGKSY

SEQ ID NO: 7259 - protein, 9 aa, Artificial Sequence
  Description of Artificial Sequence: Synthetic peptide
  Seed: GAAGVGKSA (KRAS G12A)
GGAGVGKSA

SEQ ID NO: 7260 - protein, 10 aa, Artificial Sequence
  Description of Artificial Sequence: Synthetic peptide
  Seed: GAAGVGKSAL (KRAS G12A)
GGAGVGKSAF

SEQ ID NO: 7261 - protein, 10 aa, Artificial Sequence
  Description of Artificial Sequence: Synthetic peptide
  Seed: GAAGVGKSAL (KRAS G12A)
GGAGVGKSAH

SEQ ID NO: 7262 - protein, 10 aa, Artificial Sequence
  Description of Artificial Sequence: Synthetic peptide
  Seed: GAAGVGKSAL (KRAS G12A)
GGAGVGKSAK

SEQ ID NO: 7263 - protein, 10 aa, Artificial Sequence
  Description of Artificial Sequence: Synthetic peptide
  Seed: GAAGVGKSAL (KRAS G12A)
GGAGVGKSAL

SEQ ID NO: 7264 - protein, 10 aa, Artificial Sequence
  Description of Artificial Sequence: Synthetic peptide
  Seed: GAAGVGKSAL (KRAS G12A)
GGAGVGKSAM

SEQ ID NO: 7265 - protein, 10 aa, Artificial Sequence
  Description of Artificial Sequence: Synthetic peptide
  Seed: GAAGVGKSAL (KRAS G12A)
GGAGVGKSAR

SEQ ID NO: 7266 - protein, 10 aa, Artificial Sequence
  Description of Artificial Sequence: Synthetic peptide
  Seed: GAAGVGKSAL (KRAS G12A)
GGAGVGKSAY

SEQ ID NO: 7267 - protein, 9 aa, Artificial Sequence
  Description of Artificial Sequence: Synthetic peptide
  Seed: GAAGVGKSA (KRAS G12A)
GGAGVGKSF

SEQ ID NO: 7268 - protein, 9 aa, Artificial Sequence
  Description of Artificial Sequence: Synthetic peptide
  Seed: GAAGVGKSA (KRAS G12A)
GGAGVGKSH

SEQ ID NO: 7269 - protein, 9 aa, Artificial Sequence
  Description of Artificial Sequence: Synthetic peptide
  Seed: GAAGVGKSA (KRAS G12A)
GGAGVGKSI

SEQ ID NO: 7270 - protein, 9 aa, Artificial Sequence
  Description of Artificial Sequence: Synthetic peptide
  Seed: GAAGVGKSA (KRAS G12A)
GGAGVGKSK

SEQ ID NO: 7271 - protein, 9 aa, Artificial Sequence
  Description of Artificial Sequence: Synthetic peptide
  Seed: GAAGVGKSA (KRAS G12A)
GGAGVGKSL

SEQ ID NO: 7272 - protein, 9 aa, Artificial Sequence
  Description of Artificial Sequence: Synthetic peptide
  Seed: GAAGVGKSA (KRAS G12A)
GGAGVGKSM

SEQ ID NO: 7273 - protein, 9 aa, Artificial Sequence
  Description of Artificial Sequence: Synthetic peptide
  Seed: GAAGVGKSA (KRAS G12A)
GGAGVGKSR

SEQ ID NO: 7274 - protein, 9 aa, Artificial Sequence
  Description of Artificial Sequence: Synthetic peptide
  Seed: GAAGVGKSA (KRAS G12A)
GGAGVGKSV

SEQ ID NO: 7275 - protein, 9 aa, Artificial Sequence
  Description of Artificial Sequence: Synthetic peptide
  Seed: GAAGVGKSA (KRAS G12A)
GGAGVGKSY

SEQ ID NO: 7276 - protein, 10 aa, Artificial Sequence
  Description of Artificial Sequence: Synthetic peptide
  Seed: GAAGVGKSAL (KRAS G12A)
GHAGVGKSAF

SEQ ID NO: 7277 - protein, 10 aa, Artificial Sequence
  Description of Artificial Sequence: Synthetic peptide
  Seed: GAAGVGKSAL (KRAS G12A)
GHAGVGKSAL

SEQ ID NO: 7278 - protein, 10 aa, Artificial Sequence
  Description of Artificial Sequence: Synthetic peptide
  Seed: GAAGVGKSAL (KRAS G12A)
GHAGVGKSAM

SEQ ID NO: 7279 - protein, 10 aa, Artificial Sequence
  Description of Artificial Sequence: Synthetic peptide
  Seed: GAAGVGKSAL (KRAS G12A)
GHAGVGKSAY

SEQ ID NO: 7280 - protein, 9 aa, Artificial Sequence
  Description of Artificial Sequence: Synthetic peptide
  Seed: GAAGVGKSA (KRAS G12A)
GIAGVGKSA

SEQ ID NO: 7281 - protein, 10 aa, Artificial Sequence
  Description of Artificial Sequence: Synthetic peptide
  Seed: GAAGVGKSAL (KRAS G12A)
GIAGVGKSAF

SEQ ID NO: 7282 - protein, 10 aa, Artificial Sequence
  Description of Artificial Sequence: Synthetic peptide
  Seed: GAAGVGKSAL (KRAS G12A)
GIAGVGKSAH

SEQ ID NO: 7283 - protein, 10 aa, Artificial Sequence
  Description of Artificial Sequence: Synthetic peptide
  Seed: GAAGVGKSAL (KRAS G12A)
GIAGVGKSAK

SEQ ID NO: 7284 - protein, 10 aa, Artificial Sequence
  Description of Artificial Sequence: Synthetic peptide
  Seed: GAAGVGKSAL (KRAS G12A)
GIAGVGKSAL

SEQ ID NO: 7285 - protein, 10 aa, Artificial Sequence
  Description of Artificial Sequence: Synthetic peptide
  Seed: GAAGVGKSAL (KRAS G12A)
GIAGVGKSAM

SEQ ID NO: 7286 - protein, 10 aa, Artificial Sequence
  Description of Artificial Sequence: Synthetic peptide
  Seed: GAAGVGKSAL (KRAS G12A)
GIAGVGKSAR

SEQ ID NO: 7287 - protein, 10 aa, Artificial Sequence
  Description of Artificial Sequence: Synthetic peptide
  Seed: GAAGVGKSAL (KRAS G12A)
GIAGVGKSAW

SEQ ID NO: 7288 - protein, 10 aa, Artificial Sequence
  Description of Artificial Sequence: Synthetic peptide
  Seed: GAAGVGKSAL (KRAS G12A)
GIAGVGKSAY

SEQ ID NO: 7289 - protein, 9 aa, Artificial Sequence
  Description of Artificial Sequence: Synthetic peptide
  Seed: GAAGVGKSA (KRAS G12A)
GIAGVGKSF

SEQ ID NO: 7290 - protein, 9 aa, Artificial Sequence
  Description of Artificial Sequence: Synthetic peptide
  Seed: GAAGVGKSA (KRAS G12A)
GIAGVGKSH

SEQ ID NO: 7291 - protein, 9 aa, Artificial Sequence
  Description of Artificial Sequence: Synthetic peptide
  Seed: GAAGVGKSA (KRAS G12A)
GIAGVGKSI

SEQ ID NO: 7292 - protein, 9 aa, Artificial Sequence
  Description of Artificial Sequence: Synthetic peptide
  Seed: GAAGVGKSA (KRAS G12A)
GIAGVGKSK

SEQ ID NO: 7293 - protein, 9 aa, Artificial Sequence
  Description of Artificial Sequence: Synthetic peptide
  Seed: GAAGVGKSA (KRAS G12A)
GIAGVGKSL

SEQ ID NO: 7294 - protein, 9 aa, Artificial Sequence
  Description of Artificial Sequence: Synthetic peptide
  Seed: GAAGVGKSA (KRAS G12A)
GIAGVGKSM

SEQ ID NO: 7295 - protein, 9 aa, Artificial Sequence
  Description of Artificial Sequence: Synthetic peptide
  Seed: GAAGVGKSA (KRAS G12A)
GIAGVGKSR

SEQ ID NO: 7296 - protein, 9 aa, Artificial Sequence
  Description of Artificial Sequence: Synthetic peptide
  Seed: GAAGVGKSA (KRAS G12A)
GIAGVGKSV

SEQ ID NO: 7297 - protein, 9 aa, Artificial Sequence
  Description of Artificial Sequence: Synthetic peptide
  Seed: GAAGVGKSA (KRAS G12A)
GIAGVGKSW

SEQ ID NO: 7298 - protein, 9 aa, Artificial Sequence
  Description of Artificial Sequence: Synthetic peptide
  Seed: GAAGVGKSA (KRAS G12A)
GIAGVGKSY

SEQ ID NO: 7299 - protein, 10 aa, Artificial Sequence
  Description of Artificial Sequence: Synthetic peptide
  Seed: GAAGVGKSAL (KRAS G12A)
GKAGVGKSAF

SEQ ID NO: 7300 - protein, 10 aa, Artificial Sequence
  Description of Artificial Sequence: Synthetic peptide
  Seed: GAAGVGKSAL (KRAS G12A)
GKAGVGKSAY

SEQ ID NO: 7301 - protein, 9 aa, Artificial Sequence
  Description of Artificial Sequence: Synthetic peptide
  Seed: GAAGVGKSA (KRAS G12A)
GKAGVGKSY

SEQ ID NO: 7302 - protein, 10 aa, Artificial Sequence
  Description of Artificial Sequence: Synthetic peptide
  Seed: GAAGVGKSAL (KRAS G12A)
GLAGVGKSAF

SEQ ID NO: 7303 - protein, 10 aa, Artificial Sequence
  Description of Artificial Sequence: Synthetic peptide
  Seed: GAAGVGKSAL (KRAS G12A)
GLAGVGKSAK

SEQ ID NO: 7304 - protein, 10 aa, Artificial Sequence
  Description of Artificial Sequence: Synthetic peptide
  Seed: GAAGVGKSAL (KRAS G12A)
GLAGVGKSAL

SEQ ID NO: 7305 - protein, 10 aa, Artificial Sequence
  Description of Artificial Sequence: Synthetic peptide
  Seed: GAAGVGKSAL (KRAS G12A)
GLAGVGKSAM

SEQ ID NO: 7306 - protein, 10 aa, Artificial Sequence
  Description of Artificial Sequence: Synthetic peptide
  Seed: GAAGVGKSAL (KRAS G12A)
GLAGVGKSAR

SEQ ID NO: 7307 - protein, 10 aa, Artificial Sequence
  Description of Artificial Sequence: Synthetic peptide
  Seed: GAAGVGKSAL (KRAS G12A)
GLAGVGKSAW

SEQ ID NO: 7308 - protein, 10 aa, Artificial Sequence
  Description of Artificial Sequence: Synthetic peptide
  Seed: GAAGVGKSAL (KRAS G12A)
GLAGVGKSAY

SEQ ID NO: 7309 - protein, 9 aa, Artificial Sequence
  Description of Artificial Sequence: Synthetic peptide
  Seed: GAAGVGKSA (KRAS G12A)
GLAGVGKSF

SEQ ID NO: 7310 - protein, 9 aa, Artificial Sequence
  Description of Artificial Sequence: Synthetic peptide
  Seed: GAAGVGKSA (KRAS G12A)
GLAGVGKSH

SEQ ID NO: 7311 - protein, 9 aa, Artificial Sequence
  Description of Artificial Sequence: Synthetic peptide
  Seed: GAAGVGKSA (KRAS G12A)
GLAGVGKSK

SEQ ID NO: 7312 - protein, 9 aa, Artificial Sequence
  Description of Artificial Sequence: Synthetic peptide
  Seed: GAAGVGKSA (KRAS G12A)
GLAGVGKSL

SEQ ID NO: 7313 - protein, 9 aa, Artificial Sequence
  Description of Artificial Sequence: Synthetic peptide
  Seed: GAAGVGKSA (KRAS G12A)
GLAGVGKSM

SEQ ID NO: 7314 - protein, 9 aa, Artificial Sequence
  Description of Artificial Sequence: Synthetic peptide
  Seed: GAAGVGKSA (KRAS G12A)
GLAGVGKSR

SEQ ID NO: 7315 - protein, 9 aa, Artificial Sequence
  Description of Artificial Sequence: Synthetic peptide
  Seed: GAAGVGKSA (KRAS G12A)
GLAGVGKSV

SEQ ID NO: 7316 - protein, 9 aa, Artificial Sequence
  Description of Artificial Sequence: Synthetic peptide
  Seed: GAAGVGKSA (KRAS G12A)
GLAGVGKSY

SEQ ID NO: 7317 - protein, 10 aa, Artificial Sequence
  Description of Artificial Sequence: Synthetic peptide
  Seed: GAAGVGKSAL (KRAS G12A)
GMAGVGKSAF

SEQ ID NO: 7318 - protein, 10 aa, Artificial Sequence
  Description of Artificial Sequence: Synthetic peptide
  Seed: GAAGVGKSAL (KRAS G12A)
GMAGVGKSAH

SEQ ID NO: 7319 - protein, 10 aa, Artificial Sequence
  Description of Artificial Sequence: Synthetic peptide
  Seed: GAAGVGKSAL (KRAS G12A)
GMAGVGKSAI

SEQ ID NO: 7320 - protein, 10 aa, Artificial Sequence
  Description of Artificial Sequence: Synthetic peptide
  Seed: GAAGVGKSAL (KRAS G12A)
GMAGVGKSAK

SEQ ID NO: 7321 - protein, 10 aa, Artificial Sequence
  Description of Artificial Sequence: Synthetic peptide
  Seed: GAAGVGKSAL (KRAS G12A)
GMAGVGKSAL

SEQ ID NO: 7322 - protein, 10 aa, Artificial Sequence
  Description of Artificial Sequence: Synthetic peptide
  Seed: GAAGVGKSAL (KRAS G12A)
GMAGVGKSAM

SEQ ID NO: 7323 - protein, 10 aa, Artificial Sequence
  Description of Artificial Sequence: Synthetic peptide
  Seed: GAAGVGKSAL (KRAS G12A)
GMAGVGKSAR

SEQ ID NO: 7324 - protein, 10 aa, Artificial Sequence
  Description of Artificial Sequence: Synthetic peptide
  Seed: GAAGVGKSAL (KRAS G12A)
GMAGVGKSAW

SEQ ID NO: 7325 - protein, 10 aa, Artificial Sequence
  Description of Artificial Sequence: Synthetic peptide
  Seed: GAAGVGKSAL (KRAS G12A)
GMAGVGKSAY

SEQ ID NO: 7326 - protein, 9 aa, Artificial Sequence
  Description of Artificial Sequence: Synthetic peptide
  Seed: GAAGVGKSA (KRAS G12A)
GMAGVGKSF

SEQ ID NO: 7327 - protein, 9 aa, Artificial Sequence
  Description of Artificial Sequence: Synthetic peptide
  Seed: GAAGVGKSA (KRAS G12A)
GMAGVGKSH

SEQ ID NO: 7328 - protein, 9 aa, Artificial Sequence
  Description of Artificial Sequence: Synthetic peptide
  Seed: GAAGVGKSA (KRAS G12A)
GMAGVGKSK

SEQ ID NO: 7329 - protein, 9 aa, Artificial Sequence
  Description of Artificial Sequence: Synthetic peptide
  Seed: GAAGVGKSA (KRAS G12A)
GMAGVGKSL

SEQ ID NO: 7330 - protein, 9 aa, Artificial Sequence
  Description of Artificial Sequence: Synthetic peptide
  Seed: GAAGVGKSA (KRAS G12A)
GMAGVGKSM

SEQ ID NO: 7331 - protein, 9 aa, Artificial Sequence
  Description of Artificial Sequence: Synthetic peptide
  Seed: GAAGVGKSA (KRAS G12A)
GMAGVGKSR

SEQ ID NO: 7332 - protein, 9 aa, Artificial Sequence
  Description of Artificial Sequence: Synthetic peptide
  Seed: GAAGVGKSA (KRAS G12A)
GMAGVGKSV

SEQ ID NO: 7333 - protein, 9 aa, Artificial Sequence
  Description of Artificial Sequence: Synthetic peptide
  Seed: GAAGVGKSA (KRAS G12A)
GMAGVGKSY

SEQ ID NO: 7334 - protein, 10 aa, Artificial Sequence
  Description of Artificial Sequence: Synthetic peptide
  Seed: GAAGVGKSAL (KRAS G12A)
GNAGVGKSAF

SEQ ID NO: 7335 - protein, 10 aa, Artificial Sequence
  Description of Artificial Sequence: Synthetic peptide
  Seed: GAAGVGKSAL (KRAS G12A)
GNAGVGKSAK

SEQ ID NO: 7336 - protein, 10 aa, Artificial Sequence
  Description of Artificial Sequence: Synthetic peptide
  Seed: GAAGVGKSAL (KRAS G12A)
GNAGVGKSAR

SEQ ID NO: 7337 - protein, 10 aa, Artificial Sequence
  Description of Artificial Sequence: Synthetic peptide
  Seed: GAAGVGKSAL (KRAS G12A)
GNAGVGKSAY

SEQ ID NO: 7338 - protein, 9 aa, Artificial Sequence
  Description of Artificial Sequence: Synthetic peptide
  Seed: GAAGVGKSA (KRAS G12A)
GNAGVGKSF

SEQ ID NO: 7339 - protein, 9 aa, Artificial Sequence
  Description of Artificial Sequence: Synthetic peptide
  Seed: GAAGVGKSA (KRAS G12A)
GNAGVGKSH

SEQ ID NO: 7340 - protein, 9 aa, Artificial Sequence
  Description of Artificial Sequence: Synthetic peptide
  Seed: GAAGVGKSA (KRAS G12A)
GNAGVGKSI

SEQ ID NO: 7341 - protein, 9 aa, Artificial Sequence
  Description of Artificial Sequence: Synthetic peptide
  Seed: GAAGVGKSA (KRAS G12A)
GNAGVGKSK

SEQ ID NO: 7342 - protein, 9 aa, Artificial Sequence
  Description of Artificial Sequence: Synthetic peptide
  Seed: GAAGVGKSA (KRAS G12A)
GNAGVGKSL

SEQ ID NO: 7343 - protein, 9 aa, Artificial Sequence
  Description of Artificial Sequence: Synthetic peptide
  Seed: GAAGVGKSA (KRAS G12A)
GNAGVGKSM

SEQ ID NO: 7344 - protein, 9 aa, Artificial Sequence
  Description of Artificial Sequence: Synthetic peptide
  Seed: GAAGVGKSA (KRAS G12A)
GNAGVGKSR

SEQ ID NO: 7345 - protein, 9 aa, Artificial Sequence
  Description of Artificial Sequence: Synthetic peptide
  Seed: GAAGVGKSA (KRAS G12A)
GNAGVGKSV

SEQ ID NO: 7346 - protein, 9 aa, Artificial Sequence
  Description of Artificial Sequence: Synthetic peptide
  Seed: GAAGVGKSA (KRAS G12A)
GNAGVGKSY

SEQ ID NO: 7347 - protein, 10 aa, Artificial Sequence
  Description of Artificial Sequence: Synthetic peptide
  Seed: GAAGVGKSAL (KRAS G12A)
GPAGVGKSAA

SEQ ID NO: 7348 - protein, 10 aa, Artificial Sequence
  Description of Artificial Sequence: Synthetic peptide
  Seed: GAAGVGKSAL (KRAS G12A)
GPAGVGKSAC

SEQ ID NO: 7349 - protein, 10 aa, Artificial Sequence
  Description of Artificial Sequence: Synthetic peptide
  Seed: GAAGVGKSAL (KRAS G12A)
GPAGVGKSAF

SEQ ID NO: 7350 - protein, 10 aa, Artificial Sequence
  Description of Artificial Sequence: Synthetic peptide
  Seed: GAAGVGKSAL (KRAS G12A)
GPAGVGKSAG

SEQ ID NO: 7351 - protein, 10 aa, Artificial Sequence
  Description of Artificial Sequence: Synthetic peptide
  Seed: GAAGVGKSAL (KRAS G12A)
GPAGVGKSAH

SEQ ID NO: 7352 - protein, 10 aa, Artificial Sequence
  Description of Artificial Sequence: Synthetic peptide
  Seed: GAAGVGKSAL (KRAS G12A)
GPAGVGKSAI

SEQ ID NO: 7353 - protein, 10 aa, Artificial Sequence
  Description of Artificial Sequence: Synthetic peptide
  Seed: GAAGVGKSAL (KRAS G12A)
GPAGVGKSAK

SEQ ID NO: 7354 - protein, 10 aa, Artificial Sequence
  Description of Artificial Sequence: Synthetic peptide
  Seed: GAAGVGKSAL (KRAS G12A)
GPAGVGKSAM

SEQ ID NO: 7355 - protein, 10 aa, Artificial Sequence
  Description of Artificial Sequence: Synthetic peptide
  Seed: GAAGVGKSAL (KRAS G12A)
GPAGVGKSAP

SEQ ID NO: 7356 - protein, 10 aa, Artificial Sequence
  Description of Artificial Sequence: Synthetic peptide
  Seed: GAAGVGKSAL (KRAS G12A)
GPAGVGKSAQ

SEQ ID NO: 7357 - protein, 10 aa, Artificial Sequence
  Description of Artificial Sequence: Synthetic peptide
  Seed: GAAGVGKSAL (KRAS G12A)
GPAGVGKSAR

SEQ ID NO: 7358 - protein, 10 aa, Artificial Sequence
  Description of Artificial Sequence: Synthetic peptide
  Seed: GAAGVGKSAL (KRAS G12A)
GPAGVGKSAS

SEQ ID NO: 7359 - protein, 10 aa, Artificial Sequence
  Description of Artificial Sequence: Synthetic peptide
  Seed: GAAGVGKSAL (KRAS G12A)
GPAGVGKSAT

SEQ ID NO: 7360 - protein, 10 aa, Artificial Sequence
  Description of Artificial Sequence: Synthetic peptide
  Seed: GAAGVGKSAL (KRAS G12A)
GPAGVGKSAV

SEQ ID NO: 7361 - protein, 10 aa, Artificial Sequence
  Description of Artificial Sequence: Synthetic peptide
  Seed: GAAGVGKSAL (KRAS G12A)
GPAGVGKSAW

SEQ ID NO: 7362 - protein, 10 aa, Artificial Sequence
  Description of Artificial Sequence: Synthetic peptide
  Seed: GAAGVGKSAL (KRAS G12A)
GPAGVGKSAY

SEQ ID NO: 7363 - protein, 9 aa, Artificial Sequence
  Description of Artificial Sequence: Synthetic peptide
  Seed: GAAGVGKSA (KRAS G12A)
GPAGVGKSC

SEQ ID NO: 7364 - protein, 9 aa, Artificial Sequence
  Description of Artificial Sequence: Synthetic peptide
  Seed: GAAGVGKSA (KRAS G12A)
GPAGVGKSE

SEQ ID NO: 7365 - protein, 9 aa, Artificial Sequence
  Description of Artificial Sequence: Synthetic peptide
  Seed: GAAGVGKSA (KRAS G12A)
GPAGVGKSF

SEQ ID NO: 7366 - protein, 9 aa, Artificial Sequence
  Description of Artificial Sequence: Synthetic peptide
  Seed: GAAGVGKSA (KRAS G12A)
GPAGVGKSG

SEQ ID NO: 7367 - protein, 9 aa, Artificial Sequence
  Description of Artificial Sequence: Synthetic peptide
  Seed: GAAGVGKSA (KRAS G12A)
GPAGVGKSI

SEQ ID NO: 7368 - protein, 9 aa, Artificial Sequence
  Description of Artificial Sequence: Synthetic peptide
  Seed: GAAGVGKSA (KRAS G12A)
GPAGVGKSK

SEQ ID NO: 7369 - protein, 9 aa, Artificial Sequence
  Description of Artificial Sequence: Synthetic peptide
  Seed: GAAGVGKSA (KRAS G12A)
GPAGVGKSL

SEQ ID NO: 7370 - protein, 9 aa, Artificial Sequence
  Description of Artificial Sequence: Synthetic peptide
  Seed: GAAGVGKSA (KRAS G12A)
GPAGVGKSM

SEQ ID NO: 7371 - protein, 9 aa, Artificial Sequence
  Description of Artificial Sequence: Synthetic peptide
  Seed: GAAGVGKSA (KRAS G12A)
GPAGVGKSP

SEQ ID NO: 7372 - protein, 9 aa, Artificial Sequence
  Description of Artificial Sequence: Synthetic peptide
  Seed: GAAGVGKSA (KRAS G12A)
GPAGVGKSQ

SEQ ID NO: 7373 - protein, 9 aa, Artificial Sequence
  Description of Artificial Sequence: Synthetic peptide
  Seed: GAAGVGKSA (KRAS G12A)
GPAGVGKSR

SEQ ID NO: 7374 - protein, 9 aa, Artificial Sequence
  Description of Artificial Sequence: Synthetic peptide
  Seed: GAAGVGKSA (KRAS G12A)
GPAGVGKSS

SEQ ID NO: 7375 - protein, 9 aa, Artificial Sequence
  Description of Artificial Sequence: Synthetic peptide
  Seed: GAAGVGKSA (KRAS G12A)
GPAGVGKST

SEQ ID NO: 7376 - protein, 9 aa, Artificial Sequence
  Description of Artificial Sequence: Synthetic peptide
  Seed: GAAGVGKSA (KRAS G12A)
GPAGVGKSW

SEQ ID NO: 7377 - protein, 9 aa, Artificial Sequence
  Description of Artificial Sequence: Synthetic peptide
  Seed: GAAGVGKSA (KRAS G12A)
GPAGVGKSY

SEQ ID NO: 7378 - protein, 10 aa, Artificial Sequence
  Description of Artificial Sequence: Synthetic peptide
  Seed: GAAGVGKSAL (KRAS G12A)
GQAGVGKSAF

SEQ ID NO: 7379 - protein, 10 aa, Artificial Sequence
  Description of Artificial Sequence: Synthetic peptide
  Seed: GAAGVGKSAL (KRAS G12A)
GQAGVGKSAH

SEQ ID NO: 7380 - protein, 10 aa, Artificial Sequence
  Description of Artificial Sequence: Synthetic peptide
  Seed: GAAGVGKSAL (KRAS G12A)
GQAGVGKSAI

SEQ ID NO: 7381 - protein, 10 aa, Artificial Sequence
  Description of Artificial Sequence: Synthetic peptide
  Seed: GAAGVGKSAL (KRAS G12A)
GQAGVGKSAK

SEQ ID NO: 7382 - protein, 10 aa, Artificial Sequence
  Description of Artificial Sequence: Synthetic peptide
  Seed: GAAGVGKSAL (KRAS G12A)
GQAGVGKSAL

SEQ ID NO: 7383 - protein, 10 aa, Artificial Sequence
  Description of Artificial Sequence: Synthetic peptide
  Seed: GAAGVGKSAL (KRAS G12A)
GQAGVGKSAM

SEQ ID NO: 7384 - protein, 10 aa, Artificial Sequence
  Description of Artificial Sequence: Synthetic peptide
  Seed: GAAGVGKSAL (KRAS G12A)
GQAGVGKSAR

SEQ ID NO: 7385 - protein, 10 aa, Artificial Sequence
  Description of Artificial Sequence: Synthetic peptide
  Seed: GAAGVGKSAL (KRAS G12A)
GQAGVGKSAV

SEQ ID NO: 7386 - protein, 10 aa, Artificial Sequence
  Description of Artificial Sequence: Synthetic peptide
  Seed: GAAGVGKSAL (KRAS G12A)
GQAGVGKSAW

SEQ ID NO: 7387 - protein, 10 aa, Artificial Sequence
  Description of Artificial Sequence: Synthetic peptide
  Seed: GAAGVGKSAL (KRAS G12A)
GQAGVGKSAY

SEQ ID NO: 7388 - protein, 9 aa, Artificial Sequence
  Description of Artificial Sequence: Synthetic peptide
  Seed: GAAGVGKSA (KRAS G12A)
GQAGVGKSF

SEQ ID NO: 7389 - protein, 9 aa, Artificial Sequence
  Description of Artificial Sequence: Synthetic peptide
  Seed: GAAGVGKSA (KRAS G12A)
GQAGVGKSH

SEQ ID NO: 7390 - protein, 9 aa, Artificial Sequence
  Description of Artificial Sequence: Synthetic peptide
  Seed: GAAGVGKSA (KRAS G12A)
GQAGVGKSI

SEQ ID NO: 7391 - protein, 9 aa, Artificial Sequence
  Description of Artificial Sequence: Synthetic peptide
  Seed: GAAGVGKSA (KRAS G12A)
GQAGVGKSK

SEQ ID NO: 7392 - protein, 9 aa, Artificial Sequence
  Description of Artificial Sequence: Synthetic peptide
  Seed: GAAGVGKSA (KRAS G12A)
GQAGVGKSL

SEQ ID NO: 7393 - protein, 9 aa, Artificial Sequence
  Description of Artificial Sequence: Synthetic peptide
  Seed: GAAGVGKSA (KRAS G12A)
GQAGVGKSM

SEQ ID NO: 7394 - protein, 9 aa, Artificial Sequence
  Description of Artificial Sequence: Synthetic peptide
  Seed: GAAGVGKSA (KRAS G12A)
GQAGVGKSR

SEQ ID NO: 7395 - protein, 9 aa, Artificial Sequence
  Description of Artificial Sequence: Synthetic peptide
  Seed: GAAGVGKSA (KRAS G12A)
GQAGVGKSV

SEQ ID NO: 7396 - protein, 9 aa, Artificial Sequence
  Description of Artificial Sequence: Synthetic peptide
  Seed: GAAGVGKSA (KRAS G12A)
GQAGVGKSW

SEQ ID NO: 7397 - protein, 9 aa, Artificial Sequence
  Description of Artificial Sequence: Synthetic peptide
  Seed: GAAGVGKSA (KRAS G12A)
GQAGVGKSY

SEQ ID NO: 7398 - protein, 10 aa, Artificial Sequence
  Description of Artificial Sequence: Synthetic peptide
  Seed: GAAGVGKSAL (KRAS G12A)
GRAGVGKSAF

SEQ ID NO: 7399 - protein, 10 aa, Artificial Sequence
  Description of Artificial Sequence: Synthetic peptide
  Seed: GAAGVGKSAL (KRAS G12A)
GRAGVGKSAI

SEQ ID NO: 7400 - protein, 10 aa, Artificial Sequence
  Description of Artificial Sequence: Synthetic peptide
  Seed: GAAGVGKSAL (KRAS G12A)
GRAGVGKSAL

SEQ ID NO: 7401 - protein, 10 aa, Artificial Sequence
  Description of Artificial Sequence: Synthetic peptide
  Seed: GAAGVGKSAL (KRAS G12A)
GRAGVGKSAM

SEQ ID NO: 7402 - protein, 10 aa, Artificial Sequence
  Description of Artificial Sequence: Synthetic peptide
  Seed: GAAGVGKSAL (KRAS G12A)
GRAGVGKSAV

SEQ ID NO: 7403 - protein, 10 aa, Artificial Sequence
  Description of Artificial Sequence: Synthetic peptide
  Seed: GAAGVGKSAL (KRAS G12A)
GRAGVGKSAY

SEQ ID NO: 7404 - protein, 9 aa, Artificial Sequence
  Description of Artificial Sequence: Synthetic peptide
  Seed: GAAGVGKSA (KRAS G12A)
GSAGVGKSA

SEQ ID NO: 7405 - protein, 10 aa, Artificial Sequence
  Description of Artificial Sequence: Synthetic peptide
  Seed: GAAGVGKSAL (KRAS G12A)
GSAGVGKSAF

SEQ ID NO: 7406 - protein, 10 aa, Artificial Sequence
  Description of Artificial Sequence: Synthetic peptide
  Seed: GAAGVGKSAL (KRAS G12A)
GSAGVGKSAH

SEQ ID NO: 7407 - protein, 10 aa, Artificial Sequence
  Description of Artificial Sequence: Synthetic peptide
  Seed: GAAGVGKSAL (KRAS G12A)
GSAGVGKSAI

SEQ ID NO: 7408 - protein, 10 aa, Artificial Sequence
  Description of Artificial Sequence: Synthetic peptide
  Seed: GAAGVGKSAL (KRAS G12A)
GSAGVGKSAK

SEQ ID NO: 7409 - protein, 10 aa, Artificial Sequence
  Description of Artificial Sequence: Synthetic peptide
  Seed: GAAGVGKSAL (KRAS G12A)
GSAGVGKSAL

SEQ ID NO: 7410 - protein, 10 aa, Artificial Sequence
  Description of Artificial Sequence: Synthetic peptide
  Seed: GAAGVGKSAL (KRAS G12A)
GSAGVGKSAM

SEQ ID NO: 7411 - protein, 10 aa, Artificial Sequence
  Description of Artificial Sequence: Synthetic peptide
  Seed: GAAGVGKSAL (KRAS G12A)
GSAGVGKSAR

SEQ ID NO: 7412 - protein, 10 aa, Artificial Sequence
  Description of Artificial Sequence: Synthetic peptide
  Seed: GAAGVGKSAL (KRAS G12A)
GSAGVGKSAV

SEQ ID NO: 7413 - protein, 10 aa, Artificial Sequence
  Description of Artificial Sequence: Synthetic peptide
  Seed: GAAGVGKSAL (KRAS G12A)
GSAGVGKSAW

SEQ ID NO: 7414 - protein, 10 aa, Artificial Sequence
  Description of Artificial Sequence: Synthetic peptide
  Seed: GAAGVGKSAL (KRAS G12A)
GSAGVGKSAY

SEQ ID NO: 7415 - protein, 9 aa, Artificial Sequence
  Description of Artificial Sequence: Synthetic peptide
  Seed: GAAGVGKSA (KRAS G12A)
GSAGVGKSC

SEQ ID NO: 7416 - protein, 9 aa, Artificial Sequence
  Description of Artificial Sequence: Synthetic peptide
  Seed: GAAGVGKSA (KRAS G12A)
GSAGVGKSF

SEQ ID NO: 7417 - protein, 9 aa, Artificial Sequence
  Description of Artificial Sequence: Synthetic peptide
  Seed: GAAGVGKSA (KRAS G12A)
GSAGVGKSH

SEQ ID NO: 7418 - protein, 9 aa, Artificial Sequence
  Description of Artificial Sequence: Synthetic peptide
  Seed: GAAGVGKSA (KRAS G12A)
GSAGVGKSI

SEQ ID NO: 7419 - protein, 9 aa, Artificial Sequence
  Description of Artificial Sequence: Synthetic peptide
  Seed: GAAGVGKSA (KRAS G12A)
GSAGVGKSK

SEQ ID NO: 7420 - protein, 9 aa, Artificial Sequence
  Description of Artificial Sequence: Synthetic peptide
  Seed: GAAGVGKSA (KRAS G12A)
GSAGVGKSL

SEQ ID NO: 7421 - protein, 9 aa, Artificial Sequence
  Description of Artificial Sequence: Synthetic peptide
  Seed: GAAGVGKSA (KRAS G12A)
GSAGVGKSM

SEQ ID NO: 7422 - protein, 9 aa, Artificial Sequence
  Description of Artificial Sequence: Synthetic peptide
  Seed: GAAGVGKSA (KRAS G12A)
GSAGVGKSR

SEQ ID NO: 7423 - protein, 9 aa, Artificial Sequence
  Description of Artificial Sequence: Synthetic peptide
  Seed: GAAGVGKSA (KRAS G12A)
GSAGVGKSV

SEQ ID NO: 7424 - protein, 9 aa, Artificial Sequence
  Description of Artificial Sequence: Synthetic peptide
  Seed: GAAGVGKSA (KRAS G12A)
GSAGVGKSW

SEQ ID NO: 7425 - protein, 9 aa, Artificial Sequence
  Description of Artificial Sequence: Synthetic peptide
  Seed: GAAGVGKSA (KRAS G12A)
GSAGVGKSY

SEQ ID NO: 7426 - protein, 9 aa, Artificial Sequence
  Description of Artificial Sequence: Synthetic peptide
  Seed: GAAGVGKSA (KRAS G12A)
GTAGVGKSA

SEQ ID NO: 7427 - protein, 10 aa, Artificial Sequence
  Description of Artificial Sequence: Synthetic peptide
  Seed: GAAGVGKSAL (KRAS G12A)
GTAGVGKSAF

SEQ ID NO: 7428 - protein, 10 aa, Artificial Sequence
  Description of Artificial Sequence: Synthetic peptide
  Seed: GAAGVGKSAL (KRAS G12A)
GTAGVGKSAH

SEQ ID NO: 7429 - protein, 10 aa, Artificial Sequence
  Description of Artificial Sequence: Synthetic peptide
  Seed: GAAGVGKSAL (KRAS G12A)
GTAGVGKSAI

SEQ ID NO: 7430 - protein, 10 aa, Artificial Sequence
  Description of Artificial Sequence: Synthetic peptide
  Seed: GAAGVGKSAL (KRAS G12A)
GTAGVGKSAK

SEQ ID NO: 7431 - protein, 10 aa, Artificial Sequence
  Description of Artificial Sequence: Synthetic peptide
  Seed: GAAGVGKSAL (KRAS G12A)
GTAGVGKSAL

SEQ ID NO: 7432 - protein, 10 aa, Artificial Sequence
  Description of Artificial Sequence: Synthetic peptide
  Seed: GAAGVGKSAL (KRAS G12A)
GTAGVGKSAM

SEQ ID NO: 7433 - protein, 10 aa, Artificial Sequence
  Description of Artificial Sequence: Synthetic peptide
  Seed: GAAGVGKSAL (KRAS G12A)
GTAGVGKSAR

SEQ ID NO: 7434 - protein, 10 aa, Artificial Sequence
  Description of Artificial Sequence: Synthetic peptide
  Seed: GAAGVGKSAL (KRAS G12A)
GTAGVGKSAV

SEQ ID NO: 7435 - protein, 10 aa, Artificial Sequence
  Description of Artificial Sequence: Synthetic peptide
  Seed: GAAGVGKSAL (KRAS G12A)
GTAGVGKSAW

SEQ ID NO: 7436 - protein, 10 aa, Artificial Sequence
  Description of Artificial Sequence: Synthetic peptide
  Seed: GAAGVGKSAL (KRAS G12A)
GTAGVGKSAY

SEQ ID NO: 7437 - protein, 9 aa, Artificial Sequence
  Description of Artificial Sequence: Synthetic peptide
  Seed: GAAGVGKSA (KRAS G12A)
GTAGVGKSF

SEQ ID NO: 7438 - protein, 9 aa, Artificial Sequence
  Description of Artificial Sequence: Synthetic peptide
  Seed: GAAGVGKSA (KRAS G12A)
GTAGVGKSH

SEQ ID NO: 7439 - protein, 9 aa, Artificial Sequence
  Description of Artificial Sequence: Synthetic peptide
  Seed: GAAGVGKSA (KRAS G12A)
GTAGVGKSI

SEQ ID NO: 7440 - protein, 9 aa, Artificial Sequence
  Description of Artificial Sequence: Synthetic peptide
  Seed: GAAGVGKSA (KRAS G12A)
GTAGVGKSK

SEQ ID NO: 7441 - protein, 9 aa, Artificial Sequence
  Description of Artificial Sequence: Synthetic peptide
  Seed: GAAGVGKSA (KRAS G12A)
GTAGVGKSL

SEQ ID NO: 7442 - protein, 9 aa, Artificial Sequence
  Description of Artificial Sequence: Synthetic peptide
  Seed: GAAGVGKSA (KRAS G12A)
GTAGVGKSM

SEQ ID NO: 7443 - protein, 9 aa, Artificial Sequence
  Description of Artificial Sequence: Synthetic peptide
  Seed: GAAGVGKSA (KRAS G12A)
GTAGVGKSR

SEQ ID NO: 7444 - protein, 9 aa, Artificial Sequence
  Description of Artificial Sequence: Synthetic peptide
  Seed: GAAGVGKSA (KRAS G12A)
GTAGVGKSV

SEQ ID NO: 7445 - protein, 9 aa, Artificial Sequence
  Description of Artificial Sequence: Synthetic peptide
  Seed: GAAGVGKSA (KRAS G12A)
GTAGVGKSW

SEQ ID NO: 7446 - protein, 9 aa, Artificial Sequence
  Description of Artificial Sequence: Synthetic peptide
  Seed: GAAGVGKSA (KRAS G12A)
GTAGVGKSY

SEQ ID NO: 7447 - protein, 9 aa, Artificial Sequence
  Description of Artificial Sequence: Synthetic peptide
  Seed: GAAGVGKSA (KRAS G12A)
GVAGVGKSA

SEQ ID NO: 7448 - protein, 10 aa, Artificial Sequence
  Description of Artificial Sequence: Synthetic peptide
  Seed: GAAGVGKSAL (KRAS G12A)
GVAGVGKSAF

SEQ ID NO: 7449 - protein, 10 aa, Artificial Sequence
  Description of Artificial Sequence: Synthetic peptide
  Seed: GAAGVGKSAL (KRAS G12A)
GVAGVGKSAH

SEQ ID NO: 7450 - protein, 10 aa, Artificial Sequence
  Description of Artificial Sequence: Synthetic peptide
  Seed: GAAGVGKSAL (KRAS G12A)
GVAGVGKSAK

SEQ ID NO: 7451 - protein, 10 aa, Artificial Sequence
  Description of Artificial Sequence: Synthetic peptide
  Seed: GAAGVGKSAL (KRAS G12A)
GVAGVGKSAL

SEQ ID NO: 7452 - protein, 10 aa, Artificial Sequence
  Description of Artificial Sequence: Synthetic peptide
  Seed: GAAGVGKSAL (KRAS G12A)
GVAGVGKSAM

SEQ ID NO: 7453 - protein, 10 aa, Artificial Sequence
  Description of Artificial Sequence: Synthetic peptide
  Seed: GAAGVGKSAL (KRAS G12A)
GVAGVGKSAR

SEQ ID NO: 7454 - protein, 10 aa, Artificial Sequence
  Description of Artificial Sequence: Synthetic peptide
  Seed: GAAGVGKSAL (KRAS G12A)
GVAGVGKSAW

SEQ ID NO: 7455 - protein, 10 aa, Artificial Sequence
  Description of Artificial Sequence: Synthetic peptide
  Seed: GAAGVGKSAL (KRAS G12A)
GVAGVGKSAY

SEQ ID NO: 7456 - protein, 9 aa, Artificial Sequence
  Description of Artificial Sequence: Synthetic peptide
  Seed: GAAGVGKSA (KRAS G12A)
GVAGVGKSC

SEQ ID NO: 7457 - protein, 9 aa, Artificial Sequence
  Description of Artificial Sequence: Synthetic peptide
  Seed: GAAGVGKSA (KRAS G12A)
GVAGVGKSF

SEQ ID NO: 7458 - protein, 9 aa, Artificial Sequence
  Description of Artificial Sequence: Synthetic peptide
  Seed: GAAGVGKSA (KRAS G12A)
GVAGVGKSH

SEQ ID NO: 7459 - protein, 9 aa, Artificial Sequence
  Description of Artificial Sequence: Synthetic peptide
  Seed: GAAGVGKSA (KRAS G12A)
GVAGVGKSI

SEQ ID NO: 7460 - protein, 9 aa, Artificial Sequence
  Description of Artificial Sequence: Synthetic peptide
  Seed: GAAGVGKSA (KRAS G12A)
GVAGVGKSK

SEQ ID NO: 7461 - protein, 9 aa, Artificial Sequence
  Description of Artificial Sequence: Synthetic peptide
  Seed: GAAGVGKSA (KRAS G12A)
GVAGVGKSL

SEQ ID NO: 7462 - protein, 9 aa, Artificial Sequence
  Description of Artificial Sequence: Synthetic peptide
  Seed: GAAGVGKSA (KRAS G12A)
GVAGVGKSM

SEQ ID NO: 7463 - protein, 9 aa, Artificial Sequence
  Description of Artificial Sequence: Synthetic peptide
  Seed: GAAGVGKSA (KRAS G12A)
GVAGVGKSR

SEQ ID NO: 7464 - protein, 9 aa, Artificial Sequence
  Description of Artificial Sequence: Synthetic peptide
  Seed: GAAGVGKSA (KRAS G12A)
GVAGVGKSV

SEQ ID NO: 7465 - protein, 9 aa, Artificial Sequence
  Description of Artificial Sequence: Synthetic peptide
  Seed: GAAGVGKSA (KRAS G12A)
GVAGVGKSW

SEQ ID NO: 7466 - protein, 9 aa, Artificial Sequence
  Description of Artificial Sequence: Synthetic peptide
  Seed: GAAGVGKSA (KRAS G12A)
GVAGVGKSY

SEQ ID NO: 7467 - protein, 10 aa, Artificial Sequence
  Description of Artificial Sequence: Synthetic peptide
  Seed: GAAGVGKSAL (KRAS G12A)
GWAGVGKSAF

SEQ ID NO: 7468 - protein, 10 aa, Artificial Sequence
  Description of Artificial Sequence: Synthetic peptide
  Seed: GAAGVGKSAL (KRAS G12A)
GWAGVGKSAY

SEQ ID NO: 7469 - protein, 9 aa, Artificial Sequence
  Description of Artificial Sequence: Synthetic peptide
  Seed: GAAGVGKSA (KRAS G12A)
GWAGVGKSK

SEQ ID NO: 7470 - protein, 9 aa, Artificial Sequence
  Description of Artificial Sequence: Synthetic peptide
  Seed: GAAGVGKSA (KRAS G12A)
GWAGVGKSY

SEQ ID NO: 7471 - protein, 10 aa, Artificial Sequence
  Description of Artificial Sequence: Synthetic peptide
  Seed: GAAGVGKSAL (KRAS G12A)
GYAGVGKSAF

SEQ ID NO: 7472 - protein, 10 aa, Artificial Sequence
  Description of Artificial Sequence: Synthetic peptide
  Seed: GAAGVGKSAL (KRAS G12A)
GYAGVGKSAK

SEQ ID NO: 7473 - protein, 10 aa, Artificial Sequence
  Description of Artificial Sequence: Synthetic peptide
  Seed: GAAGVGKSAL (KRAS G12A)
GYAGVGKSAL

SEQ ID NO: 7474 - protein, 10 aa, Artificial Sequence
  Description of Artificial Sequence: Synthetic peptide
  Seed: GAAGVGKSAL (KRAS G12A)
GYAGVGKSAY

SEQ ID NO: 7475 - protein, 9 aa, Artificial Sequence
  Description of Artificial Sequence: Synthetic peptide
  Seed: GAAGVGKSA (KRAS G12A)
GYAGVGKSF

SEQ ID NO: 7476 - protein, 9 aa, Artificial Sequence
  Description of Artificial Sequence: Synthetic peptide
  Seed: GAAGVGKSA (KRAS G12A)
GYAGVGKSK

SEQ ID NO: 7477 - protein, 9 aa, Artificial Sequence
  Description of Artificial Sequence: Synthetic peptide
  Seed: GAAGVGKSA (KRAS G12A)
GYAGVGKSY

SEQ ID NO: 7478 - protein, 10 aa, Artificial Sequence
  Description of Artificial Sequence: Synthetic peptide
  Seed: KLVVVGAAGV (KRAS G12A)
KIVVVGAAGA

SEQ ID NO: 7479 - protein, 10 aa, Artificial Sequence
  Description of Artificial Sequence: Synthetic peptide
  Seed: KLVVVGAAGV (KRAS G12A)
KIVVVGAAGI

SEQ ID NO: 7480 - protein, 10 aa, Artificial Sequence
  Description of Artificial Sequence: Synthetic peptide
  Seed: KLVVVGAAGV (KRAS G12A)
KIVVVGAAGL

SEQ ID NO: 7481 - protein, 10 aa, Artificial Sequence
  Description of Artificial Sequence: Synthetic peptide
  Seed: KLVVVGAAGV (KRAS G12A)
KQVVVGAAGA

SEQ ID NO: 7482 - protein, 10 aa, Artificial Sequence
  Description of Artificial Sequence: Synthetic peptide
  Seed: KLVVVGAAGV (KRAS G12A)
KQVVVGAAGF

SEQ ID NO: 7483 - protein, 10 aa, Artificial Sequence
  Description of Artificial Sequence: Synthetic peptide
  Seed: KLVVVGAAGV (KRAS G12A)
KQVVVGAAGM

SEQ ID NO: 7484 - protein, 10 aa, Artificial Sequence
  Description of Artificial Sequence: Synthetic peptide
  Seed: KLVVVGAAGV (KRAS G12A)
KTVVVGAAGI

SEQ ID NO: 7485 - protein, 10 aa, Artificial Sequence
  Description of Artificial Sequence: Synthetic peptide
  Seed: KLVVVGAAGV (KRAS G12A)
KTVVVGAAGL

SEQ ID NO: 7486 - protein, 10 aa, Artificial Sequence
  Description of Artificial Sequence: Synthetic peptide
  Seed: KLVVVGAAGV (KRAS G12A)
KVVVVGAAGA

SEQ ID NO: 7487 - protein, 10 aa, Artificial Sequence
  Description of Artificial Sequence: Synthetic peptide
  Seed: KLVVVGAAGV (KRAS G12A)
KVVVVGAAGI

SEQ ID NO: 7488 - protein, 10 aa, Artificial Sequence
  Description of Artificial Sequence: Synthetic peptide
  Seed: KLVVVGAAGV (KRAS G12A)
KVVVVGAAGL

SEQ ID NO: 7489 - protein, 9 aa, Artificial Sequence
  Description of Artificial Sequence: Synthetic peptide
  Seed: LVVVGAAGV (KRAS G12A)
LAVVGAAGL

SEQ ID NO: 7490 - protein, 11 aa, Artificial Sequence
  Description of Artificial Sequence: Synthetic peptide
  Seed: LVVVGAAGVGK (KRAS G12A)
LAVVGAAGVGF

SEQ ID NO: 7491 - protein, 11 aa, Artificial Sequence
  Description of Artificial Sequence: Synthetic peptide
  Seed: LVVVGAAGVGK (KRAS G12A)
LAVVGAAGVGH

SEQ ID NO: 7492 - protein, 11 aa, Artificial Sequence
  Description of Artificial Sequence: Synthetic peptide
  Seed: LVVVGAAGVGK (KRAS G12A)
LAVVGAAGVGI

SEQ ID NO: 7493 - protein, 11 aa, Artificial Sequence
  Description of Artificial Sequence: Synthetic peptide
  Seed: LVVVGAAGVGK (KRAS G12A)
LAVVGAAGVGK

SEQ ID NO: 7494 - protein, 11 aa, Artificial Sequence
  Description of Artificial Sequence: Synthetic peptide
  Seed: LVVVGAAGVGK (KRAS G12A)
LAVVGAAGVGL

SEQ ID NO: 7495 - protein, 11 aa, Artificial Sequence
  Description of Artificial Sequence: Synthetic peptide
  Seed: LVVVGAAGVGK (KRAS G12A)
LAVVGAAGVGM

SEQ ID NO: 7496 - protein, 11 aa, Artificial Sequence
  Description of Artificial Sequence: Synthetic peptide
  Seed: LVVVGAAGVGK (KRAS G12A)
LAVVGAAGVGR

SEQ ID NO: 7497 - protein, 11 aa, Artificial Sequence
  Description of Artificial Sequence: Synthetic peptide
  Seed: LVVVGAAGVGK (KRAS G12A)
LAVVGAAGVGV

SEQ ID NO: 7498 - protein, 11 aa, Artificial Sequence
  Description of Artificial Sequence: Synthetic peptide
  Seed: LVVVGAAGVGK (KRAS G12A)
LAVVGAAGVGW

SEQ ID NO: 7499 - protein, 11 aa, Artificial Sequence
  Description of Artificial Sequence: Synthetic peptide
  Seed: LVVVGAAGVGK (KRAS G12A)
LAVVGAAGVGY

SEQ ID NO: 7500 - protein, 11 aa, Artificial Sequence
  Description of Artificial Sequence: Synthetic peptide
  Seed: LVVVGAAGVGK (KRAS G12A)
LCVVGAAGVGK

SEQ ID NO: 7501 - protein, 11 aa, Artificial Sequence
  Description of Artificial Sequence: Synthetic peptide
  Seed: LVVVGAAGVGK (KRAS G12A)
LCVVGAAGVGR

SEQ ID NO: 7502 - protein, 11 aa, Artificial Sequence
  Description of Artificial Sequence: Synthetic peptide
  Seed: LVVVGAAGVGK (KRAS G12A)
LDVVGAAGVGK

SEQ ID NO: 7503 - protein, 11 aa, Artificial Sequence
  Description of Artificial Sequence: Synthetic peptide
  Seed: LVVVGAAGVGK (KRAS G12A)
LDVVGAAGVGR

SEQ ID NO: 7504 - protein, 11 aa, Artificial Sequence
  Description of Artificial Sequence: Synthetic peptide
  Seed: LVVVGAAGVGK (KRAS G12A)
LEVVGAAGVGK

SEQ ID NO: 7505 - protein, 11 aa, Artificial Sequence
  Description of Artificial Sequence: Synthetic peptide
  Seed: LVVVGAAGVGK (KRAS G12A)
LEVVGAAGVGR

SEQ ID NO: 7506 - protein, 11 aa, Artificial Sequence
  Description of Artificial Sequence: Synthetic peptide
  Seed: LVVVGAAGVGK (KRAS G12A)
LFVVGAAGVGK

SEQ ID NO: 7507 - protein, 11 aa, Artificial Sequence
  Description of Artificial Sequence: Synthetic peptide
  Seed: LVVVGAAGVGK (KRAS G12A)
LFVVGAAGVGR

SEQ ID NO: 7508 - protein, 11 aa, Artificial Sequence
  Description of Artificial Sequence: Synthetic peptide
  Seed: LVVVGAAGVGK (KRAS G12A)
LGVVGAAGVGK

SEQ ID NO: 7509 - protein, 11 aa, Artificial Sequence
  Description of Artificial Sequence: Synthetic peptide
  Seed: LVVVGAAGVGK (KRAS G12A)
LGVVGAAGVGL

SEQ ID NO: 7510 - protein, 11 aa, Artificial Sequence
  Description of Artificial Sequence: Synthetic peptide
  Seed: LVVVGAAGVGK (KRAS G12A)
LGVVGAAGVGR

SEQ ID NO: 7511 - protein, 11 aa, Artificial Sequence
  Description of Artificial Sequence: Synthetic peptide
  Seed: LVVVGAAGVGK (KRAS G12A)
LGVVGAAGVGY

SEQ ID NO: 7512 - protein, 11 aa, Artificial Sequence
  Description of Artificial Sequence: Synthetic peptide
  Seed: LVVVGAAGVGK (KRAS G12A)
LHVVGAAGVGK

SEQ ID NO: 7513 - protein, 11 aa, Artificial Sequence
  Description of Artificial Sequence: Synthetic peptide
  Seed: LVVVGAAGVGK (KRAS G12A)
LIVVGAAGVGK

SEQ ID NO: 7514 - protein, 11 aa, Artificial Sequence
  Description of Artificial Sequence: Synthetic peptide
  Seed: LVVVGAAGVGK (KRAS G12A)
LIVVGAAGVGR

SEQ ID NO: 7515 - protein, 11 aa, Artificial Sequence
  Description of Artificial Sequence: Synthetic peptide
  Seed: LVVVGAAGVGK (KRAS G12A)
LIVVGAAGVGY

SEQ ID NO: 7516 - protein, 11 aa, Artificial Sequence
  Description of Artificial Sequence: Synthetic peptide
  Seed: LVVVGAAGVGK (KRAS G12A)
LLVVGAAGVGK

SEQ ID NO: 7517 - protein, 11 aa, Artificial Sequence
  Description of Artificial Sequence: Synthetic peptide
  Seed: LVVVGAAGVGK (KRAS G12A)
LLVVGAAGVGR

SEQ ID NO: 7518 - protein, 11 aa, Artificial Sequence
  Description of Artificial Sequence: Synthetic peptide
  Seed: LVVVGAAGVGK (KRAS G12A)
LMVVGAAGVGK

SEQ ID NO: 7519 - protein, 11 aa, Artificial Sequence
  Description of Artificial Sequence: Synthetic peptide
  Seed: LVVVGAAGVGK (KRAS G12A)
LMVVGAAGVGR

SEQ ID NO: 7520 - protein, 11 aa, Artificial Sequence
  Description of Artificial Sequence: Synthetic peptide
  Seed: LVVVGAAGVGK (KRAS G12A)
LNVVGAAGVGK

SEQ ID NO: 7521 - protein, 11 aa, Artificial Sequence
  Description of Artificial Sequence: Synthetic peptide
  Seed: LVVVGAAGVGK (KRAS G12A)
LNVVGAAGVGR

SEQ ID NO: 7522 - protein, 11 aa, Artificial Sequence
  Description of Artificial Sequence: Synthetic peptide
  Seed: LVVVGAAGVGK (KRAS G12A)
LPVVGAAGVGK

SEQ ID NO: 7523 - protein, 11 aa, Artificial Sequence
  Description of Artificial Sequence: Synthetic peptide
  Seed: LVVVGAAGVGK (KRAS G12A)
LPVVGAAGVGR

SEQ ID NO: 7524 - protein, 11 aa, Artificial Sequence
  Description of Artificial Sequence: Synthetic peptide
  Seed: LVVVGAAGVGK (KRAS G12A)
LQVVGAAGVGK

SEQ ID NO: 7525 - protein, 11 aa, Artificial Sequence
  Description of Artificial Sequence: Synthetic peptide
  Seed: LVVVGAAGVGK (KRAS G12A)
LQVVGAAGVGR

SEQ ID NO: 7526 - protein, 11 aa, Artificial Sequence
  Description of Artificial Sequence: Synthetic peptide
  Seed: LVVVGAAGVGK (KRAS G12A)
LQVVGAAGVGY

SEQ ID NO: 7527 - protein, 9 aa, Artificial Sequence
  Description of Artificial Sequence: Synthetic peptide
  Seed: LVVVGAAGV (KRAS G12A)
LSVVGAAGL

SEQ ID NO: 7528 - protein, 11 aa, Artificial Sequence
  Description of Artificial Sequence: Synthetic peptide
  Seed: LVVVGAAGVGK (KRAS G12A)
LSVVGAAGVGF

SEQ ID NO: 7529 - protein, 11 aa, Artificial Sequence
  Description of Artificial Sequence: Synthetic peptide
  Seed: LVVVGAAGVGK (KRAS G12A)
LSVVGAAGVGH

SEQ ID NO: 7530 - protein, 11 aa, Artificial Sequence
  Description of Artificial Sequence: Synthetic peptide
  Seed: LVVVGAAGVGK (KRAS G12A)
LSVVGAAGVGK

SEQ ID NO: 7531 - protein, 11 aa, Artificial Sequence
  Description of Artificial Sequence: Synthetic peptide
  Seed: LVVVGAAGVGK (KRAS G12A)
LSVVGAAGVGL

SEQ ID NO: 7532 - protein, 11 aa, Artificial Sequence
  Description of Artificial Sequence: Synthetic peptide
  Seed: LVVVGAAGVGK (KRAS G12A)
LSVVGAAGVGM

SEQ ID NO: 7533 - protein, 11 aa, Artificial Sequence
  Description of Artificial Sequence: Synthetic peptide
  Seed: LVVVGAAGVGK (KRAS G12A)
LSVVGAAGVGR

SEQ ID NO: 7534 - protein, 11 aa, Artificial Sequence
  Description of Artificial Sequence: Synthetic peptide
  Seed: LVVVGAAGVGK (KRAS G12A)
LSVVGAAGVGY

SEQ ID NO: 7535 - protein, 11 aa, Artificial Sequence
  Description of Artificial Sequence: Synthetic peptide
  Seed: LVVVGAAGVGK (KRAS G12A)
LTVVGAAGVGF

SEQ ID NO: 7536 - protein, 11 aa, Artificial Sequence
  Description of Artificial Sequence: Synthetic peptide
  Seed: LVVVGAAGVGK (KRAS G12A)
LTVVGAAGVGH

SEQ ID NO: 7537 - protein, 11 aa, Artificial Sequence
  Description of Artificial Sequence: Synthetic peptide
  Seed: LVVVGAAGVGK (KRAS G12A)
LTVVGAAGVGK

SEQ ID NO: 7538 - protein, 11 aa, Artificial Sequence
  Description of Artificial Sequence: Synthetic peptide
  Seed: LVVVGAAGVGK (KRAS G12A)
LTVVGAAGVGL

SEQ ID NO: 7539 - protein, 11 aa, Artificial Sequence
  Description of Artificial Sequence: Synthetic peptide
  Seed: LVVVGAAGVGK (KRAS G12A)
LTVVGAAGVGM

SEQ ID NO: 7540 - protein, 11 aa, Artificial Sequence
  Description of Artificial Sequence: Synthetic peptide
  Seed: LVVVGAAGVGK (KRAS G12A)
LTVVGAAGVGR

SEQ ID NO: 7541 - protein, 11 aa, Artificial Sequence
  Description of Artificial Sequence: Synthetic peptide
  Seed: LVVVGAAGVGK (KRAS G12A)
LTVVGAAGVGY

SEQ ID NO: 7542 - protein, 9 aa, Artificial Sequence
  Description of Artificial Sequence: Synthetic peptide
  Seed: LVVVGAAGV (KRAS G12A)
LVVVGAAGA

SEQ ID NO: 7543 - protein, 11 aa, Artificial Sequence
  Description of Artificial Sequence: Synthetic peptide
  Seed: LVVVGAAGVGK (KRAS G12A)
LVVVGAAGVGF

SEQ ID NO: 7544 - protein, 11 aa, Artificial Sequence
  Description of Artificial Sequence: Synthetic peptide
  Seed: LVVVGAAGVGK (KRAS G12A)
LVVVGAAGVGH

SEQ ID NO: 7545 - protein, 11 aa, Artificial Sequence
  Description of Artificial Sequence: Synthetic peptide
  Seed: LVVVGAAGVGK (KRAS G12A)
LVVVGAAGVGL

SEQ ID NO: 7546 - protein, 11 aa, Artificial Sequence
  Description of Artificial Sequence: Synthetic peptide
  Seed: LVVVGAAGVGK (KRAS G12A)
LVVVGAAGVGR

SEQ ID NO: 7547 - protein, 11 aa, Artificial Sequence
  Description of Artificial Sequence: Synthetic peptide
  Seed: LVVVGAAGVGK (KRAS G12A)
LVVVGAAGVGY

SEQ ID NO: 7548 - protein, 11 aa, Artificial Sequence
  Description of Artificial Sequence: Synthetic peptide
  Seed: LVVVGAAGVGK (KRAS G12A)
LWVVGAAGVGK

SEQ ID NO: 7549 - protein, 11 aa, Artificial Sequence
  Description of Artificial Sequence: Synthetic peptide
  Seed: LVVVGAAGVGK (KRAS G12A)
LYVVGAAGVGK

SEQ ID NO: 7550 - protein, 8 aa, Artificial Sequence
  Description of Artificial Sequence: Synthetic peptide
  Seed: VGAAGVGK (KRAS G12A)
VAAAGVGF

SEQ ID NO: 7551 - protein, 8 aa, Artificial Sequence
  Description of Artificial Sequence: Synthetic peptide
  Seed: VGAAGVGK (KRAS G12A)
VAAAGVGH

SEQ ID NO: 7552 - protein, 8 aa, Artificial Sequence
  Description of Artificial Sequence: Synthetic peptide
  Seed: VGAAGVGK (KRAS G12A)
VAAAGVGI

SEQ ID NO: 7553 - protein, 8 aa, Artificial Sequence
  Description of Artificial Sequence: Synthetic peptide
  Seed: VGAAGVGK (KRAS G12A)
VAAAGVGK

SEQ ID NO: 7554 - protein, 11 aa, Artificial Sequence
  Description of Artificial Sequence: Synthetic peptide
  Seed: VGAAGVGKSAL (KRAS G12A)
VAAAGVGKSAA

SEQ ID NO: 7555 - protein, 11 aa, Artificial Sequence
  Description of Artificial Sequence: Synthetic peptide
  Seed: VGAAGVGKSAL (KRAS G12A)
VAAAGVGKSAF

SEQ ID NO: 7556 - protein, 11 aa, Artificial Sequence
  Description of Artificial Sequence: Synthetic peptide
  Seed: VGAAGVGKSAL (KRAS G12A)
VAAAGVGKSAH

SEQ ID NO: 7557 - protein, 11 aa, Artificial Sequence
  Description of Artificial Sequence: Synthetic peptide
  Seed: VGAAGVGKSAL (KRAS G12A)
VAAAGVGKSAI

SEQ ID NO: 7558 - protein, 11 aa, Artificial Sequence
  Description of Artificial Sequence: Synthetic peptide
  Seed: VGAAGVGKSAL (KRAS G12A)
VAAAGVGKSAK

SEQ ID NO: 7559 - protein, 11 aa, Artificial Sequence
  Description of Artificial Sequence: Synthetic peptide
  Seed: VGAAGVGKSAL (KRAS G12A)
VAAAGVGKSAL

SEQ ID NO: 7560 - protein, 11 aa, Artificial Sequence
  Description of Artificial Sequence: Synthetic peptide
  Seed: VGAAGVGKSAL (KRAS G12A)
VAAAGVGKSAM

SEQ ID NO: 7561 - protein, 11 aa, Artificial Sequence
  Description of Artificial Sequence: Synthetic peptide
  Seed: VGAAGVGKSAL (KRAS G12A)
VAAAGVGKSAR

SEQ ID NO: 7562 - protein, 11 aa, Artificial Sequence
  Description of Artificial Sequence: Synthetic peptide
  Seed: VGAAGVGKSAL (KRAS G12A)
VAAAGVGKSAV

SEQ ID NO: 7563 - protein, 11 aa, Artificial Sequence
  Description of Artificial Sequence: Synthetic peptide
  Seed: VGAAGVGKSAL (KRAS G12A)
VAAAGVGKSAW

SEQ ID NO: 7564 - protein, 11 aa, Artificial Sequence
  Description of Artificial Sequence: Synthetic peptide
  Seed: VGAAGVGKSAL (KRAS G12A)
VAAAGVGKSAY

SEQ ID NO: 7565 - protein, 8 aa, Artificial Sequence
  Description of Artificial Sequence: Synthetic peptide
  Seed: VGAAGVGK (KRAS G12A)
VAAAGVGL

SEQ ID NO: 7566 - protein, 8 aa, Artificial Sequence
  Description of Artificial Sequence: Synthetic peptide
  Seed: VGAAGVGK (KRAS G12A)
VAAAGVGM

SEQ ID NO: 7567 - protein, 8 aa, Artificial Sequence
  Description of Artificial Sequence: Synthetic peptide
  Seed: VGAAGVGK (KRAS G12A)
VAAAGVGR

SEQ ID NO: 7568 - protein, 8 aa, Artificial Sequence
  Description of Artificial Sequence: Synthetic peptide
  Seed: VGAAGVGK (KRAS G12A)
VAAAGVGV

SEQ ID NO: 7569 - protein, 8 aa, Artificial Sequence
  Description of Artificial Sequence: Synthetic peptide
  Seed: VGAAGVGK (KRAS G12A)
VAAAGVGY

SEQ ID NO: 7570 - protein, 9 aa, Artificial Sequence
  Description of Artificial Sequence: Synthetic peptide
  Seed: VVGAAGVGK (KRAS G12A)
VAGAAGVGA

SEQ ID NO: 7571 - protein, 9 aa, Artificial Sequence
  Description of Artificial Sequence: Synthetic peptide
  Seed: VVGAAGVGK (KRAS G12A)
VAGAAGVGF

SEQ ID NO: 7572 - protein, 9 aa, Artificial Sequence
  Description of Artificial Sequence: Synthetic peptide
  Seed: VVGAAGVGK (KRAS G12A)
VAGAAGVGH

SEQ ID NO: 7573 - protein, 9 aa, Artificial Sequence
  Description of Artificial Sequence: Synthetic peptide
  Seed: VVGAAGVGK (KRAS G12A)
VAGAAGVGI

SEQ ID NO: 7574 - protein, 9 aa, Artificial Sequence
  Description of Artificial Sequence: Synthetic peptide
  Seed: VVGAAGVGK (KRAS G12A)
VAGAAGVGL

SEQ ID NO: 7575 - protein, 9 aa, Artificial Sequence
  Description of Artificial Sequence: Synthetic peptide
  Seed: VVGAAGVGK (KRAS G12A)
VAGAAGVGM

SEQ ID NO: 7576 - protein, 9 aa, Artificial Sequence
  Description of Artificial Sequence: Synthetic peptide
  Seed: VVGAAGVGK (KRAS G12A)
VAGAAGVGR

SEQ ID NO: 7577 - protein, 9 aa, Artificial Sequence
  Description of Artificial Sequence: Synthetic peptide
  Seed: VVGAAGVGK (KRAS G12A)
VAGAAGVGV

SEQ ID NO: 7578 - protein, 9 aa, Artificial Sequence
  Description of Artificial Sequence: Synthetic peptide
  Seed: VVGAAGVGK (KRAS G12A)
VAGAAGVGW

SEQ ID NO: 7579 - protein, 9 aa, Artificial Sequence
  Description of Artificial Sequence: Synthetic peptide
  Seed: VVGAAGVGK (KRAS G12A)
VAGAAGVGY

SEQ ID NO: 7580 - protein, 10 aa, Artificial Sequence
  Description of Artificial Sequence: Synthetic peptide
  Seed: VVVGAAGVGK (KRAS G12A)
VAVGAAGVGA

SEQ ID NO: 7581 - protein, 10 aa, Artificial Sequence
  Description of Artificial Sequence: Synthetic peptide
  Seed: VVVGAAGVGK (KRAS G12A)
VAVGAAGVGC

SEQ ID NO: 7582 - protein, 10 aa, Artificial Sequence
  Description of Artificial Sequence: Synthetic peptide
  Seed: VVVGAAGVGK (KRAS G12A)
VAVGAAGVGF

SEQ ID NO: 7583 - protein, 10 aa, Artificial Sequence
  Description of Artificial Sequence: Synthetic peptide
  Seed: VVVGAAGVGK (KRAS G12A)
VAVGAAGVGH

SEQ ID NO: 7584 - protein, 10 aa, Artificial Sequence
  Description of Artificial Sequence: Synthetic peptide
  Seed: VVVGAAGVGK (KRAS G12A)
VAVGAAGVGI

SEQ ID NO: 7585 - protein, 10 aa, Artificial Sequence
  Description of Artificial Sequence: Synthetic peptide
  Seed: VVVGAAGVGK (KRAS G12A)
VAVGAAGVGL

SEQ ID NO: 7586 - protein, 10 aa, Artificial Sequence
  Description of Artificial Sequence: Synthetic peptide
  Seed: VVVGAAGVGK (KRAS G12A)
VAVGAAGVGM

SEQ ID NO: 7587 - protein, 10 aa, Artificial Sequence
  Description of Artificial Sequence: Synthetic peptide
  Seed: VVVGAAGVGK (KRAS G12A)
VAVGAAGVGQ

SEQ ID NO: 7588 - protein, 10 aa, Artificial Sequence
  Description of Artificial Sequence: Synthetic peptide
  Seed: VVVGAAGVGK (KRAS G12A)
VAVGAAGVGV

SEQ ID NO: 7589 - protein, 10 aa, Artificial Sequence
  Description of Artificial Sequence: Synthetic peptide
  Seed: VVVGAAGVGK (KRAS G12A)
VAVGAAGVGW

SEQ ID NO: 7590 - protein, 10 aa, Artificial Sequence
  Description of Artificial Sequence: Synthetic peptide
  Seed: VVVGAAGVGK (KRAS G12A)
VAVGAAGVGY

SEQ ID NO: 7591 - protein, 8 aa, Artificial Sequence
  Description of Artificial Sequence: Synthetic peptide
  Seed: VGAAGVGK (KRAS G12A)
VCAAGVGK

SEQ ID NO: 7592 - protein, 11 aa, Artificial Sequence
  Description of Artificial Sequence: Synthetic peptide
  Seed: VGAAGVGKSAL (KRAS G12A)
VCAAGVGKSAF

SEQ ID NO: 7593 - protein, 11 aa, Artificial Sequence
  Description of Artificial Sequence: Synthetic peptide
  Seed: VGAAGVGKSAL (KRAS G12A)
VCAAGVGKSAK

SEQ ID NO: 7594 - protein, 11 aa, Artificial Sequence
  Description of Artificial Sequence: Synthetic peptide
  Seed: VGAAGVGKSAL (KRAS G12A)
VCAAGVGKSAL

SEQ ID NO: 7595 - protein, 11 aa, Artificial Sequence
  Description of Artificial Sequence: Synthetic peptide
  Seed: VGAAGVGKSAL (KRAS G12A)
VCAAGVGKSAR

SEQ ID NO: 7596 - protein, 11 aa, Artificial Sequence
  Description of Artificial Sequence: Synthetic peptide
  Seed: VGAAGVGKSAL (KRAS G12A)
VCAAGVGKSAY

SEQ ID NO: 7597 - protein, 9 aa, Artificial Sequence
  Description of Artificial Sequence: Synthetic peptide
  Seed: VVGAAGVGK (KRAS G12A)
VCGAAGVGK

SEQ ID NO: 7598 - protein, 9 aa, Artificial Sequence
  Description of Artificial Sequence: Synthetic peptide
  Seed: VVGAAGVGK (KRAS G12A)
VCGAAGVGR

SEQ ID NO: 7599 - protein, 9 aa, Artificial Sequence
  Description of Artificial Sequence: Synthetic peptide
  Seed: VVGAAGVGK (KRAS G12A)
VCGAAGVGY

SEQ ID NO: 7600 - protein, 10 aa, Artificial Sequence
  Description of Artificial Sequence: Synthetic peptide
  Seed: VVVGAAGVGK (KRAS G12A)
VCVGAAGVGF

SEQ ID NO: 7601 - protein, 10 aa, Artificial Sequence
  Description of Artificial Sequence: Synthetic peptide
  Seed: VVVGAAGVGK (KRAS G12A)
VCVGAAGVGL

SEQ ID NO: 7602 - protein, 10 aa, Artificial Sequence
  Description of Artificial Sequence: Synthetic peptide
  Seed: VVVGAAGVGK (KRAS G12A)
VCVGAAGVGM

SEQ ID NO: 7603 - protein, 10 aa, Artificial Sequence
  Description of Artificial Sequence: Synthetic peptide
  Seed: VVVGAAGVGK (KRAS G12A)
VCVGAAGVGR

SEQ ID NO: 7604 - protein, 10 aa, Artificial Sequence
  Description of Artificial Sequence: Synthetic peptide
  Seed: VVVGAAGVGK (KRAS G12A)
VCVGAAGVGY

SEQ ID NO: 7605 - protein, 8 aa, Artificial Sequence
  Description of Artificial Sequence: Synthetic peptide
  Seed: VGAAGVGK (KRAS G12A)
VDAAGVGK

SEQ ID NO: 7606 - protein, 11 aa, Artificial Sequence
  Description of Artificial Sequence: Synthetic peptide
  Seed: VGAAGVGKSAL (KRAS G12A)
VDAAGVGKSAK

SEQ ID NO: 7607 - protein, 11 aa, Artificial Sequence
  Description of Artificial Sequence: Synthetic peptide
  Seed: VGAAGVGKSAL (KRAS G12A)
VDAAGVGKSAR

SEQ ID NO: 7608 - protein, 8 aa, Artificial Sequence
  Description of Artificial Sequence: Synthetic peptide
  Seed: VGAAGVGK (KRAS G12A)
VDAAGVGR

SEQ ID NO: 7609 - protein, 9 aa, Artificial Sequence
  Description of Artificial Sequence: Synthetic peptide
  Seed: VVGAAGVGK (KRAS G12A)
VDGAAGVGK

SEQ ID NO: 7610 - protein, 9 aa, Artificial Sequence
  Description of Artificial Sequence: Synthetic peptide
  Seed: VVGAAGVGK (KRAS G12A)
VDGAAGVGR

SEQ ID NO: 7611 - protein, 9 aa, Artificial Sequence
  Description of Artificial Sequence: Synthetic peptide
  Seed: VVGAAGVGK (KRAS G12A)
VDGAAGVGY

SEQ ID NO: 7612 - protein, 10 aa, Artificial Sequence
  Description of Artificial Sequence: Synthetic peptide
  Seed: VVVGAAGVGK (KRAS G12A)
VDVGAAGVGY

SEQ ID NO: 7613 - protein, 8 aa, Artificial Sequence
  Description of Artificial Sequence: Synthetic peptide
  Seed: VGAAGVGK (KRAS G12A)
VEAAGVGK

SEQ ID NO: 7614 - protein, 11 aa, Artificial Sequence
  Description of Artificial Sequence: Synthetic peptide
  Seed: VGAAGVGKSAL (KRAS G12A)
VEAAGVGKSAF

SEQ ID NO: 7615 - protein, 11 aa, Artificial Sequence
  Description of Artificial Sequence: Synthetic peptide
  Seed: VGAAGVGKSAL (KRAS G12A)
VEAAGVGKSAK

SEQ ID NO: 7616 - protein, 11 aa, Artificial Sequence
  Description of Artificial Sequence: Synthetic peptide
  Seed: VGAAGVGKSAL (KRAS G12A)
VEAAGVGKSAL

SEQ ID NO: 7617 - protein, 11 aa, Artificial Sequence
  Description of Artificial Sequence: Synthetic peptide
  Seed: VGAAGVGKSAL (KRAS G12A)
VEAAGVGKSAR

SEQ ID NO: 7618 - protein, 11 aa, Artificial Sequence
  Description of Artificial Sequence: Synthetic peptide
  Seed: VGAAGVGKSAL (KRAS G12A)
VEAAGVGKSAY

SEQ ID NO: 7619 - protein, 9 aa, Artificial Sequence
  Description of Artificial Sequence: Synthetic peptide
  Seed: VVGAAGVGK (KRAS G12A)
VEGAAGVGK

SEQ ID NO: 7620 - protein, 9 aa, Artificial Sequence
  Description of Artificial Sequence: Synthetic peptide
  Seed: VVGAAGVGK (KRAS G12A)
VEGAAGVGR

SEQ ID NO: 7621 - protein, 9 aa, Artificial Sequence
  Description of Artificial Sequence: Synthetic peptide
  Seed: VVGAAGVGK (KRAS G12A)
VEGAAGVGY

SEQ ID NO: 7622 - protein, 10 aa, Artificial Sequence
  Description of Artificial Sequence: Synthetic peptide
  Seed: VVVGAAGVGK (KRAS G12A)
VEVGAAGVGF

SEQ ID NO: 7623 - protein, 10 aa, Artificial Sequence
  Description of Artificial Sequence: Synthetic peptide
  Seed: VVVGAAGVGK (KRAS G12A)
VEVGAAGVGY

SEQ ID NO: 7624 - protein, 8 aa, Artificial Sequence
  Description of Artificial Sequence: Synthetic peptide
  Seed: VGAAGVGK (KRAS G12A)
VFAAGVGK

SEQ ID NO: 7625 - protein, 11 aa, Artificial Sequence
  Description of Artificial Sequence: Synthetic peptide
  Seed: VGAAGVGKSAL (KRAS G12A)
VFAAGVGKSAK

SEQ ID NO: 7626 - protein, 8 aa, Artificial Sequence
  Description of Artificial Sequence: Synthetic peptide
  Seed: VGAAGVGK (KRAS G12A)
VFAAGVGR

SEQ ID NO: 7627 - protein, 9 aa, Artificial Sequence
  Description of Artificial Sequence: Synthetic peptide
  Seed: VVGAAGVGK (KRAS G12A)
VFGAAGVGF

SEQ ID NO: 7628 - protein, 9 aa, Artificial Sequence
  Description of Artificial Sequence: Synthetic peptide
  Seed: VVGAAGVGK (KRAS G12A)
VFGAAGVGK

SEQ ID NO: 7629 - protein, 9 aa, Artificial Sequence
  Description of Artificial Sequence: Synthetic peptide
  Seed: VVGAAGVGK (KRAS G12A)
VFGAAGVGR

SEQ ID NO: 7630 - protein, 9 aa, Artificial Sequence
  Description of Artificial Sequence: Synthetic peptide
  Seed: VVGAAGVGK (KRAS G12A)
VFGAAGVGY

SEQ ID NO: 7631 - protein, 10 aa, Artificial Sequence
  Description of Artificial Sequence: Synthetic peptide
  Seed: VVVGAAGVGK (KRAS G12A)
VFVGAAGVGF

SEQ ID NO: 7632 - protein, 10 aa, Artificial Sequence
  Description of Artificial Sequence: Synthetic peptide
  Seed: VVVGAAGVGK (KRAS G12A)
VFVGAAGVGY

SEQ ID NO: 7633 - protein, 11 aa, Artificial Sequence
  Description of Artificial Sequence: Synthetic peptide
  Seed: VGAAGVGKSAL (KRAS G12A)
VGAAGVGKSAF

SEQ ID NO: 7634 - protein, 11 aa, Artificial Sequence
  Description of Artificial Sequence: Synthetic peptide
  Seed: VGAAGVGKSAL (KRAS G12A)
VGAAGVGKSAH

SEQ ID NO: 7635 - protein, 11 aa, Artificial Sequence
  Description of Artificial Sequence: Synthetic peptide
  Seed: VGAAGVGKSAL (KRAS G12A)
VGAAGVGKSAK

SEQ ID NO: 7636 - protein, 11 aa, Artificial Sequence
  Description of Artificial Sequence: Synthetic peptide
  Seed: VGAAGVGKSAL (KRAS G12A)
VGAAGVGKSAM

SEQ ID NO: 7637 - protein, 11 aa, Artificial Sequence
  Description of Artificial Sequence: Synthetic peptide
  Seed: VGAAGVGKSAL (KRAS G12A)
VGAAGVGKSAN

SEQ ID NO: 7638 - protein, 11 aa, Artificial Sequence
  Description of Artificial Sequence: Synthetic peptide
  Seed: VGAAGVGKSAL (KRAS G12A)
VGAAGVGKSAR

SEQ ID NO: 7639 - protein, 11 aa, Artificial Sequence
  Description of Artificial Sequence: Synthetic peptide
  Seed: VGAAGVGKSAL (KRAS G12A)
VGAAGVGKSAY

SEQ ID NO: 7640 - protein, 8 aa, Artificial Sequence
  Description of Artificial Sequence: Synthetic peptide
  Seed: VGAAGVGK (KRAS G12A)
VGAAGVGR

SEQ ID NO: 7641 - protein, 8 aa, Artificial Sequence
  Description of Artificial Sequence: Synthetic peptide
  Seed: VGAAGVGK (KRAS G12A)
VGAAGVGY

SEQ ID NO: 7642 - protein, 9 aa, Artificial Sequence
  Description of Artificial Sequence: Synthetic peptide
  Seed: VVGAAGVGK (KRAS G12A)
VGGAAGVGF

SEQ ID NO: 7643 - protein, 9 aa, Artificial Sequence
  Description of Artificial Sequence: Synthetic peptide
  Seed: VVGAAGVGK (KRAS G12A)
VGGAAGVGK

SEQ ID NO: 7644 - protein, 9 aa, Artificial Sequence
  Description of Artificial Sequence: Synthetic peptide
  Seed: VVGAAGVGK (KRAS G12A)
VGGAAGVGL

SEQ ID NO: 7645 - protein, 9 aa, Artificial Sequence
  Description of Artificial Sequence: Synthetic peptide
  Seed: VVGAAGVGK (KRAS G12A)
VGGAAGVGM

SEQ ID NO: 7646 - protein, 9 aa, Artificial Sequence
  Description of Artificial Sequence: Synthetic peptide
  Seed: VVGAAGVGK (KRAS G12A)
VGGAAGVGR

SEQ ID NO: 7647 - protein, 9 aa, Artificial Sequence
  Description of Artificial Sequence: Synthetic peptide
  Seed: VVGAAGVGK (KRAS G12A)
VGGAAGVGY

SEQ ID NO: 7648 - protein, 10 aa, Artificial Sequence
  Description of Artificial Sequence: Synthetic peptide
  Seed: VVVGAAGVGK (KRAS G12A)
VGVGAAGVGF

SEQ ID NO: 7649 - protein, 10 aa, Artificial Sequence
  Description of Artificial Sequence: Synthetic peptide
  Seed: VVVGAAGVGK (KRAS G12A)
VGVGAAGVGH

SEQ ID NO: 7650 - protein, 10 aa, Artificial Sequence
  Description of Artificial Sequence: Synthetic peptide
  Seed: VVVGAAGVGK (KRAS G12A)
VGVGAAGVGL

SEQ ID NO: 7651 - protein, 10 aa, Artificial Sequence
  Description of Artificial Sequence: Synthetic peptide
  Seed: VVVGAAGVGK (KRAS G12A)
VGVGAAGVGM

SEQ ID NO: 7652 - protein, 10 aa, Artificial Sequence
  Description of Artificial Sequence: Synthetic peptide
  Seed: VVVGAAGVGK (KRAS G12A)
VGVGAAGVGQ

SEQ ID NO: 7653 - protein, 10 aa, Artificial Sequence
  Description of Artificial Sequence: Synthetic peptide
  Seed: VVVGAAGVGK (KRAS G12A)
VGVGAAGVGR

SEQ ID NO: 7654 - protein, 10 aa, Artificial Sequence
  Description of Artificial Sequence: Synthetic peptide
  Seed: VVVGAAGVGK (KRAS G12A)
VGVGAAGVGY

SEQ ID NO: 7655 - protein, 11 aa, Artificial Sequence
  Description of Artificial Sequence: Synthetic peptide
  Seed: VGAAGVGKSAL (KRAS G12A)
VHAAGVGKSAL

SEQ ID NO: 7656 - protein, 11 aa, Artificial Sequence
  Description of Artificial Sequence: Synthetic peptide
  Seed: VGAAGVGKSAL (KRAS G12A)
VHAAGVGKSAM

SEQ ID NO: 7657 - protein, 9 aa, Artificial Sequence
  Description of Artificial Sequence: Synthetic peptide
  Seed: VVGAAGVGK (KRAS G12A)
VHGAAGVGK

SEQ ID NO: 7658 - protein, 10 aa, Artificial Sequence
  Description of Artificial Sequence: Synthetic peptide
  Seed: VVVGAAGVGK (KRAS G12A)
VHVGAAGVGY

SEQ ID NO: 7659 - protein, 8 aa, Artificial Sequence
  Description of Artificial Sequence: Synthetic peptide
  Seed: VGAAGVGK (KRAS G12A)
VIAAGVGK

SEQ ID NO: 7660 - protein, 11 aa, Artificial Sequence
  Description of Artificial Sequence: Synthetic peptide
  Seed: VGAAGVGKSAL (KRAS G12A)
VIAAGVGKSAF

SEQ ID NO: 7661 - protein, 11 aa, Artificial Sequence
  Description of Artificial Sequence: Synthetic peptide
  Seed: VGAAGVGKSAL (KRAS G12A)
VIAAGVGKSAH

SEQ ID NO: 7662 - protein, 11 aa, Artificial Sequence
  Description of Artificial Sequence: Synthetic peptide
  Seed: VGAAGVGKSAL (KRAS G12A)
VIAAGVGKSAK

SEQ ID NO: 7663 - protein, 11 aa, Artificial Sequence
  Description of Artificial Sequence: Synthetic peptide
  Seed: VGAAGVGKSAL (KRAS G12A)
VIAAGVGKSAL

SEQ ID NO: 7664 - protein, 11 aa, Artificial Sequence
  Description of Artificial Sequence: Synthetic peptide
  Seed: VGAAGVGKSAL (KRAS G12A)
VIAAGVGKSAM

SEQ ID NO: 7665 - protein, 11 aa, Artificial Sequence
  Description of Artificial Sequence: Synthetic peptide
  Seed: VGAAGVGKSAL (KRAS G12A)
VIAAGVGKSAR

SEQ ID NO: 7666 - protein, 11 aa, Artificial Sequence
  Description of Artificial Sequence: Synthetic peptide
  Seed: VGAAGVGKSAL (KRAS G12A)
VIAAGVGKSAY

SEQ ID NO: 7667 - protein, 8 aa, Artificial Sequence
  Description of Artificial Sequence: Synthetic peptide
  Seed: VGAAGVGK (KRAS G12A)
VIAAGVGR

SEQ ID NO: 7668 - protein, 8 aa, Artificial Sequence
  Description of Artificial Sequence: Synthetic peptide
  Seed: VGAAGVGK (KRAS G12A)
VIAAGVGY

SEQ ID NO: 7669 - protein, 9 aa, Artificial Sequence
  Description of Artificial Sequence: Synthetic peptide
  Seed: VVGAAGVGK (KRAS G12A)
VIGAAGVGF

SEQ ID NO: 7670 - protein, 9 aa, Artificial Sequence
  Description of Artificial Sequence: Synthetic peptide
  Seed: VVGAAGVGK (KRAS G12A)
VIGAAGVGH

SEQ ID NO: 7671 - protein, 9 aa, Artificial Sequence
  Description of Artificial Sequence: Synthetic peptide
  Seed: VVGAAGVGK (KRAS G12A)
VIGAAGVGL

SEQ ID NO: 7672 - protein, 9 aa, Artificial Sequence
  Description of Artificial Sequence: Synthetic peptide
  Seed: VVGAAGVGK (KRAS G12A)
VIGAAGVGM

SEQ ID NO: 7673 - protein, 9 aa, Artificial Sequence
  Description of Artificial Sequence: Synthetic peptide
  Seed: VVGAAGVGK (KRAS G12A)
VIGAAGVGR

SEQ ID NO: 7674 - protein, 9 aa, Artificial Sequence
  Description of Artificial Sequence: Synthetic peptide
  Seed: VVGAAGVGK (KRAS G12A)
VIGAAGVGY

SEQ ID NO: 7675 - protein, 10 aa, Artificial Sequence
  Description of Artificial Sequence: Synthetic peptide
  Seed: VVVGAAGVGK (KRAS G12A)
VIVGAAGVGF

SEQ ID NO: 7676 - protein, 10 aa, Artificial Sequence
  Description of Artificial Sequence: Synthetic peptide
  Seed: VVVGAAGVGK (KRAS G12A)
VIVGAAGVGH

SEQ ID NO: 7677 - protein, 10 aa, Artificial Sequence
  Description of Artificial Sequence: Synthetic peptide
  Seed: VVVGAAGVGK (KRAS G12A)
VIVGAAGVGL

SEQ ID NO: 7678 - protein, 10 aa, Artificial Sequence
  Description of Artificial Sequence: Synthetic peptide
  Seed: VVVGAAGVGK (KRAS G12A)
VIVGAAGVGM

SEQ ID NO: 7679 - protein, 10 aa, Artificial Sequence
  Description of Artificial Sequence: Synthetic peptide
  Seed: VVVGAAGVGK (KRAS G12A)
VIVGAAGVGQ

SEQ ID NO: 7680 - protein, 10 aa, Artificial Sequence
  Description of Artificial Sequence: Synthetic peptide
  Seed: VVVGAAGVGK (KRAS G12A)
VIVGAAGVGY

SEQ ID NO: 7681 - protein, 10 aa, Artificial Sequence
  Description of Artificial Sequence: Synthetic peptide
  Seed: VVVGAAGVGK (KRAS G12A)
VKVGAAGVGR

SEQ ID NO: 7682 - protein, 10 aa, Artificial Sequence
  Description of Artificial Sequence: Synthetic peptide
  Seed: VVVGAAGVGK (KRAS G12A)
VKVGAAGVGY

SEQ ID NO: 7683 - protein, 8 aa, Artificial Sequence
  Description of Artificial Sequence: Synthetic peptide
  Seed: VGAAGVGK (KRAS G12A)
VLAAGVGK

SEQ ID NO: 7684 - protein, 11 aa, Artificial Sequence
  Description of Artificial Sequence: Synthetic peptide
  Seed: VGAAGVGKSAL (KRAS G12A)
VLAAGVGKSAF

SEQ ID NO: 7685 - protein, 11 aa, Artificial Sequence
  Description of Artificial Sequence: Synthetic peptide
  Seed: VGAAGVGKSAL (KRAS G12A)
VLAAGVGKSAK

SEQ ID NO: 7686 - protein, 11 aa, Artificial Sequence
  Description of Artificial Sequence: Synthetic peptide
  Seed: VGAAGVGKSAL (KRAS G12A)
VLAAGVGKSAL

SEQ ID NO: 7687 - protein, 11 aa, Artificial Sequence
  Description of Artificial Sequence: Synthetic peptide
  Seed: VGAAGVGKSAL (KRAS G12A)
VLAAGVGKSAR

SEQ ID NO: 7688 - protein, 11 aa, Artificial Sequence
  Description of Artificial Sequence: Synthetic peptide
  Seed: VGAAGVGKSAL (KRAS G12A)
VLAAGVGKSAY

SEQ ID NO: 7689 - protein, 8 aa, Artificial Sequence
  Description of Artificial Sequence: Synthetic peptide
  Seed: VGAAGVGK (KRAS G12A)
VLAAGVGR

SEQ ID NO: 7690 - protein, 9 aa, Artificial Sequence
  Description of Artificial Sequence: Synthetic peptide
  Seed: VVGAAGVGK (KRAS G12A)
VLGAAGVGF

SEQ ID NO: 7691 - protein, 9 aa, Artificial Sequence
  Description of Artificial Sequence: Synthetic peptide
  Seed: VVGAAGVGK (KRAS G12A)
VLGAAGVGR

SEQ ID NO: 7692 - protein, 9 aa, Artificial Sequence
  Description of Artificial Sequence: Synthetic peptide
  Seed: VVGAAGVGK (KRAS G12A)
VLGAAGVGY

SEQ ID NO: 7693 - protein, 10 aa, Artificial Sequence
  Description of Artificial Sequence: Synthetic peptide
  Seed: VVVGAAGVGK (KRAS G12A)
VLVGAAGVGF

SEQ ID NO: 7694 - protein, 10 aa, Artificial Sequence
  Description of Artificial Sequence: Synthetic peptide
  Seed: VVVGAAGVGK (KRAS G12A)
VLVGAAGVGH

SEQ ID NO: 7695 - protein, 10 aa, Artificial Sequence
  Description of Artificial Sequence: Synthetic peptide
  Seed: VVVGAAGVGK (KRAS G12A)
VLVGAAGVGL

SEQ ID NO: 7696 - protein, 10 aa, Artificial Sequence
  Description of Artificial Sequence: Synthetic peptide
  Seed: VVVGAAGVGK (KRAS G12A)
VLVGAAGVGM

SEQ ID NO: 7697 - protein, 10 aa, Artificial Sequence
  Description of Artificial Sequence: Synthetic peptide
  Seed: VVVGAAGVGK (KRAS G12A)
VLVGAAGVGY

SEQ ID NO: 7698 - protein, 8 aa, Artificial Sequence
  Description of Artificial Sequence: Synthetic peptide
  Seed: VGAAGVGK (KRAS G12A)
VMAAGVGK

SEQ ID NO: 7699 - protein, 11 aa, Artificial Sequence
  Description of Artificial Sequence: Synthetic peptide
  Seed: VGAAGVGKSAL (KRAS G12A)
VMAAGVGKSAF

SEQ ID NO: 7700 - protein, 11 aa, Artificial Sequence
  Description of Artificial Sequence: Synthetic peptide
  Seed: VGAAGVGKSAL (KRAS G12A)
VMAAGVGKSAH

SEQ ID NO: 7701 - protein, 11 aa, Artificial Sequence
  Description of Artificial Sequence: Synthetic peptide
  Seed: VGAAGVGKSAL (KRAS G12A)
VMAAGVGKSAK

SEQ ID NO: 7702 - protein, 11 aa, Artificial Sequence
  Description of Artificial Sequence: Synthetic peptide
  Seed: VGAAGVGKSAL (KRAS G12A)
VMAAGVGKSAL

SEQ ID NO: 7703 - protein, 11 aa, Artificial Sequence
  Description of Artificial Sequence: Synthetic peptide
  Seed: VGAAGVGKSAL (KRAS G12A)
VMAAGVGKSAM

SEQ ID NO: 7704 - protein, 11 aa, Artificial Sequence
  Description of Artificial Sequence: Synthetic peptide
  Seed: VGAAGVGKSAL (KRAS G12A)
VMAAGVGKSAR

SEQ ID NO: 7705 - protein, 11 aa, Artificial Sequence
  Description of Artificial Sequence: Synthetic peptide
  Seed: VGAAGVGKSAL (KRAS G12A)
VMAAGVGKSAY

SEQ ID NO: 7706 - protein, 8 aa, Artificial Sequence
  Description of Artificial Sequence: Synthetic peptide
  Seed: VGAAGVGK (KRAS G12A)
VMAAGVGR

SEQ ID NO: 7707 - protein, 9 aa, Artificial Sequence
  Description of Artificial Sequence: Synthetic peptide
  Seed: VVGAAGVGK (KRAS G12A)
VMGAAGVGF

SEQ ID NO: 7708 - protein, 9 aa, Artificial Sequence
  Description of Artificial Sequence: Synthetic peptide
  Seed: VVGAAGVGK (KRAS G12A)
VMGAAGVGM

SEQ ID NO: 7709 - protein, 9 aa, Artificial Sequence
  Description of Artificial Sequence: Synthetic peptide
  Seed: VVGAAGVGK (KRAS G12A)
VMGAAGVGY

SEQ ID NO: 7710 - protein, 10 aa, Artificial Sequence
  Description of Artificial Sequence: Synthetic peptide
  Seed: VVVGAAGVGK (KRAS G12A)
VMVGAAGVGF

SEQ ID NO: 7711 - protein, 10 aa, Artificial Sequence
  Description of Artificial Sequence: Synthetic peptide
  Seed: VVVGAAGVGK (KRAS G12A)
VMVGAAGVGH

SEQ ID NO: 7712 - protein, 10 aa, Artificial Sequence
  Description of Artificial Sequence: Synthetic peptide
  Seed: VVVGAAGVGK (KRAS G12A)
VMVGAAGVGL

SEQ ID NO: 7713 - protein, 10 aa, Artificial Sequence
  Description of Artificial Sequence: Synthetic peptide
  Seed: VVVGAAGVGK (KRAS G12A)
VMVGAAGVGM

SEQ ID NO: 7714 - protein, 10 aa, Artificial Sequence
  Description of Artificial Sequence: Synthetic peptide
  Seed: VVVGAAGVGK (KRAS G12A)
VMVGAAGVGW

SEQ ID NO: 7715 - protein, 10 aa, Artificial Sequence
  Description of Artificial Sequence: Synthetic peptide
  Seed: VVVGAAGVGK (KRAS G12A)
VMVGAAGVGY

SEQ ID NO: 7716 - protein, 8 aa, Artificial Sequence
  Description of Artificial Sequence: Synthetic peptide
  Seed: VGAAGVGK (KRAS G12A)
VNAAGVGK

SEQ ID NO: 7717 - protein, 11 aa, Artificial Sequence
  Description of Artificial Sequence: Synthetic peptide
  Seed: VGAAGVGKSAL (KRAS G12A)
VNAAGVGKSAF

SEQ ID NO: 7718 - protein, 11 aa, Artificial Sequence
  Description of Artificial Sequence: Synthetic peptide
  Seed: VGAAGVGKSAL (KRAS G12A)
VNAAGVGKSAK

SEQ ID NO: 7719 - protein, 11 aa, Artificial Sequence
  Description of Artificial Sequence: Synthetic peptide
  Seed: VGAAGVGKSAL (KRAS G12A)
VNAAGVGKSAR

SEQ ID NO: 7720 - protein, 11 aa, Artificial Sequence
  Description of Artificial Sequence: Synthetic peptide
  Seed: VGAAGVGKSAL (KRAS G12A)
VNAAGVGKSAY

SEQ ID NO: 7721 - protein, 8 aa, Artificial Sequence
  Description of Artificial Sequence: Synthetic peptide
  Seed: VGAAGVGK (KRAS G12A)
VNAAGVGR

SEQ ID NO: 7722 - protein, 9 aa, Artificial Sequence
  Description of Artificial Sequence: Synthetic peptide
  Seed: VVGAAGVGK (KRAS G12A)
VNGAAGVGK

SEQ ID NO: 7723 - protein, 9 aa, Artificial Sequence
  Description of Artificial Sequence: Synthetic peptide
  Seed: VVGAAGVGK (KRAS G12A)
VNGAAGVGR

SEQ ID NO: 7724 - protein, 9 aa, Artificial Sequence
  Description of Artificial Sequence: Synthetic peptide
  Seed: VVGAAGVGK (KRAS G12A)
VNGAAGVGY

SEQ ID NO: 7725 - protein, 10 aa, Artificial Sequence
  Description of Artificial Sequence: Synthetic peptide
  Seed: VVVGAAGVGK (KRAS G12A)
VNVGAAGVGF

SEQ ID NO: 7726 - protein, 10 aa, Artificial Sequence
  Description of Artificial Sequence: Synthetic peptide
  Seed: VVVGAAGVGK (KRAS G12A)
VNVGAAGVGY

SEQ ID NO: 7727 - protein, 11 aa, Artificial Sequence
  Description of Artificial Sequence: Synthetic peptide
  Seed: VGAAGVGKSAL (KRAS G12A)
VPAAGVGKSAI

SEQ ID NO: 7728 - protein, 11 aa, Artificial Sequence
  Description of Artificial Sequence: Synthetic peptide
  Seed: VGAAGVGKSAL (KRAS G12A)
VPAAGVGKSAL

SEQ ID NO: 7729 - protein, 11 aa, Artificial Sequence
  Description of Artificial Sequence: Synthetic peptide
  Seed: VGAAGVGKSAL (KRAS G12A)
VPAAGVGKSAM

SEQ ID NO: 7730 - protein, 9 aa, Artificial Sequence
  Description of Artificial Sequence: Synthetic peptide
  Seed: VVGAAGVGK (KRAS G12A)
VPGAAGVGK

SEQ ID NO: 7731 - protein, 9 aa, Artificial Sequence
  Description of Artificial Sequence: Synthetic peptide
  Seed: VVGAAGVGK (KRAS G12A)
VPGAAGVGR

SEQ ID NO: 7732 - protein, 9 aa, Artificial Sequence
  Description of Artificial Sequence: Synthetic peptide
  Seed: VVGAAGVGK (KRAS G12A)
VPGAAGVGY

SEQ ID NO: 7733 - protein, 10 aa, Artificial Sequence
  Description of Artificial Sequence: Synthetic peptide
  Seed: VVVGAAGVGK (KRAS G12A)
VPVGAAGVGF

SEQ ID NO: 7734 - protein, 10 aa, Artificial Sequence
  Description of Artificial Sequence: Synthetic peptide
  Seed: VVVGAAGVGK (KRAS G12A)
VPVGAAGVGL

SEQ ID NO: 7735 - protein, 10 aa, Artificial Sequence
  Description of Artificial Sequence: Synthetic peptide
  Seed: VVVGAAGVGK (KRAS G12A)
VPVGAAGVGM

SEQ ID NO: 7736 - protein, 10 aa, Artificial Sequence
  Description of Artificial Sequence: Synthetic peptide
  Seed: VVVGAAGVGK (KRAS G12A)
VPVGAAGVGY

SEQ ID NO: 7737 - protein, 8 aa, Artificial Sequence
  Description of Artificial Sequence: Synthetic peptide
  Seed: VGAAGVGK (KRAS G12A)
VQAAGVGK

SEQ ID NO: 7738 - protein, 11 aa, Artificial Sequence
  Description of Artificial Sequence: Synthetic peptide
  Seed: VGAAGVGKSAL (KRAS G12A)
VQAAGVGKSAF

SEQ ID NO: 7739 - protein, 11 aa, Artificial Sequence
  Description of Artificial Sequence: Synthetic peptide
  Seed: VGAAGVGKSAL (KRAS G12A)
VQAAGVGKSAH

SEQ ID NO: 7740 - protein, 11 aa, Artificial Sequence
  Description of Artificial Sequence: Synthetic peptide
  Seed: VGAAGVGKSAL (KRAS G12A)
VQAAGVGKSAK

SEQ ID NO: 7741 - protein, 11 aa, Artificial Sequence
  Description of Artificial Sequence: Synthetic peptide
  Seed: VGAAGVGKSAL (KRAS G12A)
VQAAGVGKSAL

SEQ ID NO: 7742 - protein, 11 aa, Artificial Sequence
  Description of Artificial Sequence: Synthetic peptide
  Seed: VGAAGVGKSAL (KRAS G12A)
VQAAGVGKSAM

SEQ ID NO: 7743 - protein, 11 aa, Artificial Sequence
  Description of Artificial Sequence: Synthetic peptide
  Seed: VGAAGVGKSAL (KRAS G12A)
VQAAGVGKSAR

SEQ ID NO: 7744 - protein, 11 aa, Artificial Sequence
  Description of Artificial Sequence: Synthetic peptide
  Seed: VGAAGVGKSAL (KRAS G12A)
VQAAGVGKSAY

SEQ ID NO: 7745 - protein, 8 aa, Artificial Sequence
  Description of Artificial Sequence: Synthetic peptide
  Seed: VGAAGVGK (KRAS G12A)
VQAAGVGR

SEQ ID NO: 7746 - protein, 8 aa, Artificial Sequence
  Description of Artificial Sequence: Synthetic peptide
  Seed: VGAAGVGK (KRAS G12A)
VQAAGVGY

SEQ ID NO: 7747 - protein, 9 aa, Artificial Sequence
  Description of Artificial Sequence: Synthetic peptide
  Seed: VVGAAGVGK (KRAS G12A)
VQGAAGVGF

SEQ ID NO: 7748 - protein, 9 aa, Artificial Sequence
  Description of Artificial Sequence: Synthetic peptide
  Seed: VVGAAGVGK (KRAS G12A)
VQGAAGVGM

SEQ ID NO: 7749 - protein, 9 aa, Artificial Sequence
  Description of Artificial Sequence: Synthetic peptide
  Seed: VVGAAGVGK (KRAS G12A)
VQGAAGVGR

SEQ ID NO: 7750 - protein, 9 aa, Artificial Sequence
  Description of Artificial Sequence: Synthetic peptide
  Seed: VVGAAGVGK (KRAS G12A)
VQGAAGVGY

SEQ ID NO: 7751 - protein, 10 aa, Artificial Sequence
  Description of Artificial Sequence: Synthetic peptide
  Seed: VVVGAAGVGK (KRAS G12A)
VQVGAAGVGF

SEQ ID NO: 7752 - protein, 10 aa, Artificial Sequence
  Description of Artificial Sequence: Synthetic peptide
  Seed: VVVGAAGVGK (KRAS G12A)
VQVGAAGVGH

SEQ ID NO: 7753 - protein, 10 aa, Artificial Sequence
  Description of Artificial Sequence: Synthetic peptide
  Seed: VVVGAAGVGK (KRAS G12A)
VQVGAAGVGL

SEQ ID NO: 7754 - protein, 10 aa, Artificial Sequence
  Description of Artificial Sequence: Synthetic peptide
  Seed: VVVGAAGVGK (KRAS G12A)
VQVGAAGVGM

SEQ ID NO: 7755 - protein, 10 aa, Artificial Sequence
  Description of Artificial Sequence: Synthetic peptide
  Seed: VVVGAAGVGK (KRAS G12A)
VQVGAAGVGR

SEQ ID NO: 7756 - protein, 10 aa, Artificial Sequence
  Description of Artificial Sequence: Synthetic peptide
  Seed: VVVGAAGVGK (KRAS G12A)
VQVGAAGVGY

SEQ ID NO: 7757 - protein, 11 aa, Artificial Sequence
  Description of Artificial Sequence: Synthetic peptide
  Seed: VGAAGVGKSAL (KRAS G12A)
VRAAGVGKSAF

SEQ ID NO: 7758 - protein, 11 aa, Artificial Sequence
  Description of Artificial Sequence: Synthetic peptide
  Seed: VGAAGVGKSAL (KRAS G12A)
VRAAGVGKSAH

SEQ ID NO: 7759 - protein, 11 aa, Artificial Sequence
  Description of Artificial Sequence: Synthetic peptide
  Seed: VGAAGVGKSAL (KRAS G12A)
VRAAGVGKSAI

SEQ ID NO: 7760 - protein, 11 aa, Artificial Sequence
  Description of Artificial Sequence: Synthetic peptide
  Seed: VGAAGVGKSAL (KRAS G12A)
VRAAGVGKSAK

SEQ ID NO: 7761 - protein, 11 aa, Artificial Sequence
  Description of Artificial Sequence: Synthetic peptide
  Seed: VGAAGVGKSAL (KRAS G12A)
VRAAGVGKSAL

SEQ ID NO: 7762 - protein, 11 aa, Artificial Sequence
  Description of Artificial Sequence: Synthetic peptide
  Seed: VGAAGVGKSAL (KRAS G12A)
VRAAGVGKSAM

SEQ ID NO: 7763 - protein, 11 aa, Artificial Sequence
  Description of Artificial Sequence: Synthetic peptide
  Seed: VGAAGVGKSAL (KRAS G12A)
VRAAGVGKSAR

SEQ ID NO: 7764 - protein, 11 aa, Artificial Sequence
  Description of Artificial Sequence: Synthetic peptide
  Seed: VGAAGVGKSAL (KRAS G12A)
VRAAGVGKSAW

SEQ ID NO: 7765 - protein, 11 aa, Artificial Sequence
  Description of Artificial Sequence: Synthetic peptide
  Seed: VGAAGVGKSAL (KRAS G12A)
VRAAGVGKSAY

SEQ ID NO: 7766 - protein, 10 aa, Artificial Sequence
  Description of Artificial Sequence: Synthetic peptide
  Seed: VVVGAAGVGK (KRAS G12A)
VRVGAAGVGF

SEQ ID NO: 7767 - protein, 10 aa, Artificial Sequence
  Description of Artificial Sequence: Synthetic peptide
  Seed: VVVGAAGVGK (KRAS G12A)
VRVGAAGVGI

SEQ ID NO: 7768 - protein, 10 aa, Artificial Sequence
  Description of Artificial Sequence: Synthetic peptide
  Seed: VVVGAAGVGK (KRAS G12A)
VRVGAAGVGL

SEQ ID NO: 7769 - protein, 10 aa, Artificial Sequence
  Description of Artificial Sequence: Synthetic peptide
  Seed: VVVGAAGVGK (KRAS G12A)
VRVGAAGVGM

SEQ ID NO: 7770 - protein, 10 aa, Artificial Sequence
  Description of Artificial Sequence: Synthetic peptide
  Seed: VVVGAAGVGK (KRAS G12A)
VRVGAAGVGR

SEQ ID NO: 7771 - protein, 10 aa, Artificial Sequence
  Description of Artificial Sequence: Synthetic peptide
  Seed: VVVGAAGVGK (KRAS G12A)
VRVGAAGVGV

SEQ ID NO: 7772 - protein, 10 aa, Artificial Sequence
  Description of Artificial Sequence: Synthetic peptide
  Seed: VVVGAAGVGK (KRAS G12A)
VRVGAAGVGY

SEQ ID NO: 7773 - protein, 8 aa, Artificial Sequence
  Description of Artificial Sequence: Synthetic peptide
  Seed: VGAAGVGK (KRAS G12A)
VSAAGVGF

SEQ ID NO: 7774 - protein, 8 aa, Artificial Sequence
  Description of Artificial Sequence: Synthetic peptide
  Seed: VGAAGVGK (KRAS G12A)
VSAAGVGH

SEQ ID NO: 7775 - protein, 8 aa, Artificial Sequence
  Description of Artificial Sequence: Synthetic peptide
  Seed: VGAAGVGK (KRAS G12A)
VSAAGVGK

SEQ ID NO: 7776 - protein, 11 aa, Artificial Sequence
  Description of Artificial Sequence: Synthetic peptide
  Seed: VGAAGVGKSAL (KRAS G12A)
VSAAGVGKSAF

SEQ ID NO: 7777 - protein, 11 aa, Artificial Sequence
  Description of Artificial Sequence: Synthetic peptide
  Seed: VGAAGVGKSAL (KRAS G12A)
VSAAGVGKSAH

SEQ ID NO: 7778 - protein, 11 aa, Artificial Sequence
  Description of Artificial Sequence: Synthetic peptide
  Seed: VGAAGVGKSAL (KRAS G12A)
VSAAGVGKSAI

SEQ ID NO: 7779 - protein, 11 aa, Artificial Sequence
  Description of Artificial Sequence: Synthetic peptide
  Seed: VGAAGVGKSAL (KRAS G12A)
VSAAGVGKSAK

SEQ ID NO: 7780 - protein, 11 aa, Artificial Sequence
  Description of Artificial Sequence: Synthetic peptide
  Seed: VGAAGVGKSAL (KRAS G12A)
VSAAGVGKSAL

SEQ ID NO: 7781 - protein, 11 aa, Artificial Sequence
  Description of Artificial Sequence: Synthetic peptide
  Seed: VGAAGVGKSAL (KRAS G12A)
VSAAGVGKSAM

SEQ ID NO: 7782 - protein, 11 aa, Artificial Sequence
  Description of Artificial Sequence: Synthetic peptide
  Seed: VGAAGVGKSAL (KRAS G12A)
VSAAGVGKSAR

SEQ ID NO: 7783 - protein, 11 aa, Artificial Sequence
  Description of Artificial Sequence: Synthetic peptide
  Seed: VGAAGVGKSAL (KRAS G12A)
VSAAGVGKSAV

SEQ ID NO: 7784 - protein, 11 aa, Artificial Sequence
  Description of Artificial Sequence: Synthetic peptide
  Seed: VGAAGVGKSAL (KRAS G12A)
VSAAGVGKSAW

SEQ ID NO: 7785 - protein, 11 aa, Artificial Sequence
  Description of Artificial Sequence: Synthetic peptide
  Seed: VGAAGVGKSAL (KRAS G12A)
VSAAGVGKSAY

SEQ ID NO: 7786 - protein, 8 aa, Artificial Sequence
  Description of Artificial Sequence: Synthetic peptide
  Seed: VGAAGVGK (KRAS G12A)
VSAAGVGL

SEQ ID NO: 7787 - protein, 8 aa, Artificial Sequence
  Description of Artificial Sequence: Synthetic peptide
  Seed: VGAAGVGK (KRAS G12A)
VSAAGVGM

SEQ ID NO: 7788 - protein, 8 aa, Artificial Sequence
  Description of Artificial Sequence: Synthetic peptide
  Seed: VGAAGVGK (KRAS G12A)
VSAAGVGR

SEQ ID NO: 7789 - protein, 8 aa, Artificial Sequence
  Description of Artificial Sequence: Synthetic peptide
  Seed: VGAAGVGK (KRAS G12A)
VSAAGVGY

SEQ ID NO: 7790 - protein, 9 aa, Artificial Sequence
  Description of Artificial Sequence: Synthetic peptide
  Seed: VVGAAGVGK (KRAS G12A)
VSGAAGVGF

SEQ ID NO: 7791 - protein, 9 aa, Artificial Sequence
  Description of Artificial Sequence: Synthetic peptide
  Seed: VVGAAGVGK (KRAS G12A)
VSGAAGVGH

SEQ ID NO: 7792 - protein, 9 aa, Artificial Sequence
  Description of Artificial Sequence: Synthetic peptide
  Seed: VVGAAGVGK (KRAS G12A)
VSGAAGVGI

SEQ ID NO: 7793 - protein, 9 aa, Artificial Sequence
  Description of Artificial Sequence: Synthetic peptide
  Seed: VVGAAGVGK (KRAS G12A)
VSGAAGVGL

SEQ ID NO: 7794 - protein, 9 aa, Artificial Sequence
  Description of Artificial Sequence: Synthetic peptide
  Seed: VVGAAGVGK (KRAS G12A)
VSGAAGVGM

SEQ ID NO: 7795 - protein, 9 aa, Artificial Sequence
  Description of Artificial Sequence: Synthetic peptide
  Seed: VVGAAGVGK (KRAS G12A)
VSGAAGVGR

SEQ ID NO: 7796 - protein, 9 aa, Artificial Sequence
  Description of Artificial Sequence: Synthetic peptide
  Seed: VVGAAGVGK (KRAS G12A)
VSGAAGVGV

SEQ ID NO: 7797 - protein, 9 aa, Artificial Sequence
  Description of Artificial Sequence: Synthetic peptide
  Seed: VVGAAGVGK (KRAS G12A)
VSGAAGVGY

SEQ ID NO: 7798 - protein, 10 aa, Artificial Sequence
  Description of Artificial Sequence: Synthetic peptide
  Seed: VVVGAAGVGK (KRAS G12A)
VSVGAAGVGF

SEQ ID NO: 7799 - protein, 10 aa, Artificial Sequence
  Description of Artificial Sequence: Synthetic peptide
  Seed: VVVGAAGVGK (KRAS G12A)
VSVGAAGVGH

SEQ ID NO: 7800 - protein, 10 aa, Artificial Sequence
  Description of Artificial Sequence: Synthetic peptide
  Seed: VVVGAAGVGK (KRAS G12A)
VSVGAAGVGI

SEQ ID NO: 7801 - protein, 10 aa, Artificial Sequence
  Description of Artificial Sequence: Synthetic peptide
  Seed: VVVGAAGVGK (KRAS G12A)
VSVGAAGVGL

SEQ ID NO: 7802 - protein, 10 aa, Artificial Sequence
  Description of Artificial Sequence: Synthetic peptide
  Seed: VVVGAAGVGK (KRAS G12A)
VSVGAAGVGM

SEQ ID NO: 7803 - protein, 10 aa, Artificial Sequence
  Description of Artificial Sequence: Synthetic peptide
  Seed: VVVGAAGVGK (KRAS G12A)
VSVGAAGVGQ

SEQ ID NO: 7804 - protein, 10 aa, Artificial Sequence
  Description of Artificial Sequence: Synthetic peptide
  Seed: VVVGAAGVGK (KRAS G12A)
VSVGAAGVGV

SEQ ID NO: 7805 - protein, 10 aa, Artificial Sequence
  Description of Artificial Sequence: Synthetic peptide
  Seed: VVVGAAGVGK (KRAS G12A)
VSVGAAGVGW

SEQ ID NO: 7806 - protein, 10 aa, Artificial Sequence
  Description of Artificial Sequence: Synthetic peptide
  Seed: VVVGAAGVGK (KRAS G12A)
VSVGAAGVGY

SEQ ID NO: 7807 - protein, 8 aa, Artificial Sequence
  Description of Artificial Sequence: Synthetic peptide
  Seed: VGAAGVGK (KRAS G12A)
VTAAGVGF

SEQ ID NO: 7808 - protein, 8 aa, Artificial Sequence
  Description of Artificial Sequence: Synthetic peptide
  Seed: VGAAGVGK (KRAS G12A)
VTAAGVGK

SEQ ID NO: 7809 - protein, 11 aa, Artificial Sequence
  Description of Artificial Sequence: Synthetic peptide
  Seed: VGAAGVGKSAL (KRAS G12A)
VTAAGVGKSAF

SEQ ID NO: 7810 - protein, 11 aa, Artificial Sequence
  Description of Artificial Sequence: Synthetic peptide
  Seed: VGAAGVGKSAL (KRAS G12A)
VTAAGVGKSAH

SEQ ID NO: 7811 - protein, 11 aa, Artificial Sequence
  Description of Artificial Sequence: Synthetic peptide
  Seed: VGAAGVGKSAL (KRAS G12A)
VTAAGVGKSAI

SEQ ID NO: 7812 - protein, 11 aa, Artificial Sequence
  Description of Artificial Sequence: Synthetic peptide
  Seed: VGAAGVGKSAL (KRAS G12A)
VTAAGVGKSAK

SEQ ID NO: 7813 - protein, 11 aa, Artificial Sequence
  Description of Artificial Sequence: Synthetic peptide
  Seed: VGAAGVGKSAL (KRAS G12A)
VTAAGVGKSAL

SEQ ID NO: 7814 - protein, 11 aa, Artificial Sequence
  Description of Artificial Sequence: Synthetic peptide
  Seed: VGAAGVGKSAL (KRAS G12A)
VTAAGVGKSAM

SEQ ID NO: 7815 - protein, 11 aa, Artificial Sequence
  Description of Artificial Sequence: Synthetic peptide
  Seed: VGAAGVGKSAL (KRAS G12A)
VTAAGVGKSAR

SEQ ID NO: 7816 - protein, 11 aa, Artificial Sequence
  Description of Artificial Sequence: Synthetic peptide
  Seed: VGAAGVGKSAL (KRAS G12A)
VTAAGVGKSAV

SEQ ID NO: 7817 - protein, 11 aa, Artificial Sequence
  Description of Artificial Sequence: Synthetic peptide
  Seed: VGAAGVGKSAL (KRAS G12A)
VTAAGVGKSAW

SEQ ID NO: 7818 - protein, 11 aa, Artificial Sequence
  Description of Artificial Sequence: Synthetic peptide
  Seed: VGAAGVGKSAL (KRAS G12A)
VTAAGVGKSAY

SEQ ID NO: 7819 - protein, 8 aa, Artificial Sequence
  Description of Artificial Sequence: Synthetic peptide
  Seed: VGAAGVGK (KRAS G12A)
VTAAGVGL

SEQ ID NO: 7820 - protein, 8 aa, Artificial Sequence
  Description of Artificial Sequence: Synthetic peptide
  Seed: VGAAGVGK (KRAS G12A)
VTAAGVGM

SEQ ID NO: 7821 - protein, 8 aa, Artificial Sequence
  Description of Artificial Sequence: Synthetic peptide
  Seed: VGAAGVGK (KRAS G12A)
VTAAGVGR

SEQ ID NO: 7822 - protein, 8 aa, Artificial Sequence
  Description of Artificial Sequence: Synthetic peptide
  Seed: VGAAGVGK (KRAS G12A)
VTAAGVGY

SEQ ID NO: 7823 - protein, 9 aa, Artificial Sequence
  Description of Artificial Sequence: Synthetic peptide
  Seed: VVGAAGVGK (KRAS G12A)
VTGAAGVGF

SEQ ID NO: 7824 - protein, 9 aa, Artificial Sequence
  Description of Artificial Sequence: Synthetic peptide
  Seed: VVGAAGVGK (KRAS G12A)
VTGAAGVGH

SEQ ID NO: 7825 - protein, 9 aa, Artificial Sequence
  Description of Artificial Sequence: Synthetic peptide
  Seed: VVGAAGVGK (KRAS G12A)
VTGAAGVGI

SEQ ID NO: 7826 - protein, 9 aa, Artificial Sequence
  Description of Artificial Sequence: Synthetic peptide
  Seed: VVGAAGVGK (KRAS G12A)
VTGAAGVGL

SEQ ID NO: 7827 - protein, 9 aa, Artificial Sequence
  Description of Artificial Sequence: Synthetic peptide
  Seed: VVGAAGVGK (KRAS G12A)
VTGAAGVGM

SEQ ID NO: 7828 - protein, 9 aa, Artificial Sequence
  Description of Artificial Sequence: Synthetic peptide
  Seed: VVGAAGVGK (KRAS G12A)
VTGAAGVGR

SEQ ID NO: 7829 - protein, 9 aa, Artificial Sequence
  Description of Artificial Sequence: Synthetic peptide
  Seed: VVGAAGVGK (KRAS G12A)
VTGAAGVGV

SEQ ID NO: 7830 - protein, 9 aa, Artificial Sequence
  Description of Artificial Sequence: Synthetic peptide
  Seed: VVGAAGVGK (KRAS G12A)
VTGAAGVGY

SEQ ID NO: 7831 - protein, 10 aa, Artificial Sequence
  Description of Artificial Sequence: Synthetic peptide
  Seed: VVVGAAGVGK (KRAS G12A)
VTVGAAGVGF

SEQ ID NO: 7832 - protein, 10 aa, Artificial Sequence
  Description of Artificial Sequence: Synthetic peptide
  Seed: VVVGAAGVGK (KRAS G12A)
VTVGAAGVGH

SEQ ID NO: 7833 - protein, 10 aa, Artificial Sequence
  Description of Artificial Sequence: Synthetic peptide
  Seed: VVVGAAGVGK (KRAS G12A)
VTVGAAGVGI

SEQ ID NO: 7834 - protein, 10 aa, Artificial Sequence
  Description of Artificial Sequence: Synthetic peptide
  Seed: VVVGAAGVGK (KRAS G12A)
VTVGAAGVGL

SEQ ID NO: 7835 - protein, 10 aa, Artificial Sequence
  Description of Artificial Sequence: Synthetic peptide
  Seed: VVVGAAGVGK (KRAS G12A)
VTVGAAGVGM

SEQ ID NO: 7836 - protein, 10 aa, Artificial Sequence
  Description of Artificial Sequence: Synthetic peptide
  Seed: VVVGAAGVGK (KRAS G12A)
VTVGAAGVGQ

SEQ ID NO: 7837 - protein, 10 aa, Artificial Sequence
  Description of Artificial Sequence: Synthetic peptide
  Seed: VVVGAAGVGK (KRAS G12A)
VTVGAAGVGW

SEQ ID NO: 7838 - protein, 10 aa, Artificial Sequence
  Description of Artificial Sequence: Synthetic peptide
  Seed: VVVGAAGVGK (KRAS G12A)
VTVGAAGVGY

SEQ ID NO: 7839 - protein, 8 aa, Artificial Sequence
  Description of Artificial Sequence: Synthetic peptide
  Seed: VGAAGVGK (KRAS G12A)
VVAAGVGF

SEQ ID NO: 7840 - protein, 8 aa, Artificial Sequence
  Description of Artificial Sequence: Synthetic peptide
  Seed: VGAAGVGK (KRAS G12A)
VVAAGVGK

SEQ ID NO: 7841 - protein, 11 aa, Artificial Sequence
  Description of Artificial Sequence: Synthetic peptide
  Seed: VGAAGVGKSAL (KRAS G12A)
VVAAGVGKSAF

SEQ ID NO: 7842 - protein, 11 aa, Artificial Sequence
  Description of Artificial Sequence: Synthetic peptide
  Seed: VGAAGVGKSAL (KRAS G12A)
VVAAGVGKSAH

SEQ ID NO: 7843 - protein, 11 aa, Artificial Sequence
  Description of Artificial Sequence: Synthetic peptide
  Seed: VGAAGVGKSAL (KRAS G12A)
VVAAGVGKSAK

SEQ ID NO: 7844 - protein, 11 aa, Artificial Sequence
  Description of Artificial Sequence: Synthetic peptide
  Seed: VGAAGVGKSAL (KRAS G12A)
VVAAGVGKSAL

SEQ ID NO: 7845 - protein, 11 aa, Artificial Sequence
  Description of Artificial Sequence: Synthetic peptide
  Seed: VGAAGVGKSAL (KRAS G12A)
VVAAGVGKSAM

SEQ ID NO: 7846 - protein, 11 aa, Artificial Sequence
  Description of Artificial Sequence: Synthetic peptide
  Seed: VGAAGVGKSAL (KRAS G12A)
VVAAGVGKSAR

SEQ ID NO: 7847 - protein, 11 aa, Artificial Sequence
  Description of Artificial Sequence: Synthetic peptide
  Seed: VGAAGVGKSAL (KRAS G12A)
VVAAGVGKSAW

SEQ ID NO: 7848 - protein, 11 aa, Artificial Sequence
  Description of Artificial Sequence: Synthetic peptide
  Seed: VGAAGVGKSAL (KRAS G12A)
VVAAGVGKSAY

SEQ ID NO: 7849 - protein, 8 aa, Artificial Sequence
  Description of Artificial Sequence: Synthetic peptide
  Seed: VGAAGVGK (KRAS G12A)
VVAAGVGL

SEQ ID NO: 7850 - protein, 8 aa, Artificial Sequence
  Description of Artificial Sequence: Synthetic peptide
  Seed: VGAAGVGK (KRAS G12A)
VVAAGVGR

SEQ ID NO: 7851 - protein, 8 aa, Artificial Sequence
  Description of Artificial Sequence: Synthetic peptide
  Seed: VGAAGVGK (KRAS G12A)
VVAAGVGY

SEQ ID NO: 7852 - protein, 9 aa, Artificial Sequence
  Description of Artificial Sequence: Synthetic peptide
  Seed: VVGAAGVGK (KRAS G12A)
VVGAAGVGF

SEQ ID NO: 7853 - protein, 9 aa, Artificial Sequence
  Description of Artificial Sequence: Synthetic peptide
  Seed: VVGAAGVGK (KRAS G12A)
VVGAAGVGH

SEQ ID NO: 7854 - protein, 9 aa, Artificial Sequence
  Description of Artificial Sequence: Synthetic peptide
  Seed: VVGAAGVGK (KRAS G12A)
VVGAAGVGL

SEQ ID NO: 7855 - protein, 9 aa, Artificial Sequence
  Description of Artificial Sequence: Synthetic peptide
  Seed: VVGAAGVGK (KRAS G12A)
VVGAAGVGM

SEQ ID NO: 7856 - protein, 9 aa, Artificial Sequence
  Description of Artificial Sequence: Synthetic peptide
  Seed: VVGAAGVGK (KRAS G12A)
VVGAAGVGY

SEQ ID NO: 7857 - protein, 10 aa, Artificial Sequence
  Description of Artificial Sequence: Synthetic peptide
  Seed: VVVGAAGVGK (KRAS G12A)
VVVGAAGVGF

SEQ ID NO: 7858 - protein, 10 aa, Artificial Sequence
  Description of Artificial Sequence: Synthetic peptide
  Seed: VVVGAAGVGK (KRAS G12A)
VVVGAAGVGH

SEQ ID NO: 7859 - protein, 10 aa, Artificial Sequence
  Description of Artificial Sequence: Synthetic peptide
  Seed: VVVGAAGVGK (KRAS G12A)
VVVGAAGVGL

SEQ ID NO: 7860 - protein, 10 aa, Artificial Sequence
  Description of Artificial Sequence: Synthetic peptide
  Seed: VVVGAAGVGK (KRAS G12A)
VVVGAAGVGM

SEQ ID NO: 7861 - protein, 10 aa, Artificial Sequence
  Description of Artificial Sequence: Synthetic peptide
  Seed: VVVGAAGVGK (KRAS G12A)
VVVGAAGVGQ

SEQ ID NO: 7862 - protein, 10 aa, Artificial Sequence
  Description of Artificial Sequence: Synthetic peptide
  Seed: VVVGAAGVGK (KRAS G12A)
VVVGAAGVGY

SEQ ID NO: 7863 - protein, 9 aa, Artificial Sequence
  Description of Artificial Sequence: Synthetic peptide
  Seed: VVGAAGVGK (KRAS G12A)
VWGAAGVGK

SEQ ID NO: 7864 - protein, 9 aa, Artificial Sequence
  Description of Artificial Sequence: Synthetic peptide
  Seed: VVGAAGVGK (KRAS G12A)
VWGAAGVGR

SEQ ID NO: 7865 - protein, 10 aa, Artificial Sequence
  Description of Artificial Sequence: Synthetic peptide
  Seed: VVVGAAGVGK (KRAS G12A)
VWVGAAGVGF

SEQ ID NO: 7866 - protein, 10 aa, Artificial Sequence
  Description of Artificial Sequence: Synthetic peptide
  Seed: VVVGAAGVGK (KRAS G12A)
VWVGAAGVGY

SEQ ID NO: 7867 - protein, 9 aa, Artificial Sequence
  Description of Artificial Sequence: Synthetic peptide
  Seed: VVGAAGVGK (KRAS G12A)
VYGAAGVGK

SEQ ID NO: 7868 - protein, 9 aa, Artificial Sequence
  Description of Artificial Sequence: Synthetic peptide
  Seed: VVGAAGVGK (KRAS G12A)
VYGAAGVGR

SEQ ID NO: 7869 - protein, 10 aa, Artificial Sequence
  Description of Artificial Sequence: Synthetic peptide
  Seed: VVVGAAGVGK (KRAS G12A)
VYVGAAGVGF

SEQ ID NO: 7870 - protein, 10 aa, Artificial Sequence
  Description of Artificial Sequence: Synthetic peptide
  Seed: VVVGAAGVGK (KRAS G12A)
VYVGAAGVGL

SEQ ID NO: 7871 - protein, 10 aa, Artificial Sequence
  Description of Artificial Sequence: Synthetic peptide
  Seed: VVVGAAGVGK (KRAS G12A)
VYVGAAGVGM

SEQ ID NO: 7872 - protein, 10 aa, Artificial Sequence
  Description of Artificial Sequence: Synthetic peptide
  Seed: VVVGAAGVGK (KRAS G12A)
VYVGAAGVGY

SEQ ID NO: 7873 - protein, 10 aa, Homo sapiens
  Native (KRAS G12A)
KLVVVGAAGV

SEQ ID NO: 7874 - protein, 9 aa, Homo sapiens
  Native (KRAS G12A)
VVGAAGVGK

SEQ ID NO: 7875 - protein, 10 aa, Homo sapiens
  Native (KRAS G12A)
VVVGAAGVGK

SEQ ID NO: 7876 - protein, 9 aa, Homo sapiens
  Native (KRAS G12A)
GAAGVGKSA

SEQ ID NO: 7877 - protein, 10 aa, Homo sapiens
  Native (KRAS G12A)
GAAGVGKSAL

SEQ ID NO: 7878 - protein, 11 aa, Homo sapiens
  Native (KRAS G12A)
LVVVGAAGVGK

SEQ ID NO: 7879 - protein, 8 aa, Homo sapiens
  Native (KRAS G12A)
VGAAGVGK

SEQ ID NO: 7880 - protein, 11 aa, Homo sapiens
  Native (KRAS G12A)
VGAAGVGKSAL

SEQ ID NO: 7881 - protein, 10 aa, Artificial Sequence
  Description of Artificial Sequence: Synthetic peptide
  Seed: KLVVVGACGV (KRAS G12C)
KFVVVGACGV

SEQ ID NO: 7882 - protein, 10 aa, Artificial Sequence
  Description of Artificial Sequence: Synthetic peptide
  Seed: KLVVVGACGV (KRAS G12C)
KIVVVGACGV

SEQ ID NO: 7883 - protein, 10 aa, Artificial Sequence
  Description of Artificial Sequence: Synthetic peptide
  Seed: KLVVVGACGV (KRAS G12C)
KLVVVGACGA

SEQ ID NO: 7884 - protein, 10 aa, Artificial Sequence
  Description of Artificial Sequence: Synthetic peptide
  Seed: KLVVVGACGV (KRAS G12C)
KLVVVGACGI

SEQ ID NO: 7885 - protein, 10 aa, Artificial Sequence
  Description of Artificial Sequence: Synthetic peptide
  Seed: KLVVVGACGV (KRAS G12C)
KLVVVGACGL

SEQ ID NO: 7886 - protein, 10 aa, Artificial Sequence
  Description of Artificial Sequence: Synthetic peptide
  Seed: KLVVVGACGV (KRAS G12C)
KMVVVGACGA

SEQ ID NO: 7887 - protein, 10 aa, Artificial Sequence
  Description of Artificial Sequence: Synthetic peptide
  Seed: KLVVVGACGV (KRAS G12C)
KMVVVGACGI

SEQ ID NO: 7888 - protein, 10 aa, Artificial Sequence
  Description of Artificial Sequence: Synthetic peptide
  Seed: KLVVVGACGV (KRAS G12C)
KMVVVGACGL

SEQ ID NO: 7889 - protein, 10 aa, Artificial Sequence
  Description of Artificial Sequence: Synthetic peptide
  Seed: KLVVVGACGV (KRAS G12C)
KMVVVGACGV

SEQ ID NO: 7890 - protein, 10 aa, Artificial Sequence
  Description of Artificial Sequence: Synthetic peptide
  Seed: KLVVVGACGV (KRAS G12C)
KQVVVGACGI

SEQ ID NO: 7891 - protein, 10 aa, Artificial Sequence
  Description of Artificial Sequence: Synthetic peptide
  Seed: KLVVVGACGV (KRAS G12C)
KQVVVGACGL

SEQ ID NO: 7892 - protein, 10 aa, Artificial Sequence
  Description of Artificial Sequence: Synthetic peptide
  Seed: KLVVVGACGV (KRAS G12C)
KQVVVGACGV

SEQ ID NO: 7893 - protein, 10 aa, Artificial Sequence
  Description of Artificial Sequence: Synthetic peptide
  Seed: KLVVVGACGV (KRAS G12C)
KTVVVGACGV

SEQ ID NO: 7894 - protein, 10 aa, Artificial Sequence
  Description of Artificial Sequence: Synthetic peptide
  Seed: KLVVVGACGV (KRAS G12C)
KVVVVGACGV

SEQ ID NO: 7895 - protein, 10 aa, Artificial Sequence
  Description of Artificial Sequence: Synthetic peptide
  Seed: KLVVVGACGV (KRAS G12C)
KYVVVGACGV

SEQ ID NO: 7896 - protein, 9 aa, Artificial Sequence
  Description of Artificial Sequence: Synthetic peptide
  Seed: LVVVGACGV (KRAS G12C)
LAVVGACGV

SEQ ID NO: 7897 - protein, 9 aa, Artificial Sequence
  Description of Artificial Sequence: Synthetic peptide
  Seed: LVVVGACGV (KRAS G12C)
LIVVGACGI

SEQ ID NO: 7898 - protein, 9 aa, Artificial Sequence
  Description of Artificial Sequence: Synthetic peptide
  Seed: LVVVGACGV (KRAS G12C)
LIVVGACGV

SEQ ID NO: 7899 - protein, 9 aa, Artificial Sequence
  Description of Artificial Sequence: Synthetic peptide
  Seed: LVVVGACGV (KRAS G12C)
LLVVGACGA

SEQ ID NO: 7900 - protein, 9 aa, Artificial Sequence
  Description of Artificial Sequence: Synthetic peptide
  Seed: LVVVGACGV (KRAS G12C)
LLVVGACGI

SEQ ID NO: 7901 - protein, 9 aa, Artificial Sequence
  Description of Artificial Sequence: Synthetic peptide
  Seed: LVVVGACGV (KRAS G12C)
LLVVGACGL

SEQ ID NO: 7902 - protein, 9 aa, Artificial Sequence
  Description of Artificial Sequence: Synthetic peptide
  Seed: LVVVGACGV (KRAS G12C)
LLVVGACGM

SEQ ID NO: 7903 - protein, 9 aa, Artificial Sequence
  Description of Artificial Sequence: Synthetic peptide
  Seed: LVVVGACGV (KRAS G12C)
LLVVGACGV

SEQ ID NO: 7904 - protein, 9 aa, Artificial Sequence
  Description of Artificial Sequence: Synthetic peptide
  Seed: LVVVGACGV (KRAS G12C)
LMVVGACGA

SEQ ID NO: 7905 - protein, 9 aa, Artificial Sequence
  Description of Artificial Sequence: Synthetic peptide
  Seed: LVVVGACGV (KRAS G12C)
LMVVGACGI

SEQ ID NO: 7906 - protein, 9 aa, Artificial Sequence
  Description of Artificial Sequence: Synthetic peptide
  Seed: LVVVGACGV (KRAS G12C)
LMVVGACGL

SEQ ID NO: 7907 - protein, 9 aa, Artificial Sequence
  Description of Artificial Sequence: Synthetic peptide
  Seed: LVVVGACGV (KRAS G12C)
LMVVGACGM

SEQ ID NO: 7908 - protein, 9 aa, Artificial Sequence
  Description of Artificial Sequence: Synthetic peptide
  Seed: LVVVGACGV (KRAS G12C)
LQVVGACGA

SEQ ID NO: 7909 - protein, 9 aa, Artificial Sequence
  Description of Artificial Sequence: Synthetic peptide
  Seed: LVVVGACGV (KRAS G12C)
LQVVGACGI

SEQ ID NO: 7910 - protein, 9 aa, Artificial Sequence
  Description of Artificial Sequence: Synthetic peptide
  Seed: LVVVGACGV (KRAS G12C)
LQVVGACGL

SEQ ID NO: 7911 - protein, 9 aa, Artificial Sequence
  Description of Artificial Sequence: Synthetic peptide
  Seed: LVVVGACGV (KRAS G12C)
LQVVGACGM

SEQ ID NO: 7912 - protein, 9 aa, Artificial Sequence
  Description of Artificial Sequence: Synthetic peptide
  Seed: LVVVGACGV (KRAS G12C)
LSVVGACGV

SEQ ID NO: 7913 - protein, 9 aa, Artificial Sequence
  Description of Artificial Sequence: Synthetic peptide
  Seed: LVVVGACGV (KRAS G12C)
LTVVGACGA

SEQ ID NO: 7914 - protein, 9 aa, Artificial Sequence
  Description of Artificial Sequence: Synthetic peptide
  Seed: LVVVGACGV (KRAS G12C)
LTVVGACGI

SEQ ID NO: 7915 - protein, 9 aa, Artificial Sequence
  Description of Artificial Sequence: Synthetic peptide
  Seed: LVVVGACGV (KRAS G12C)
LTVVGACGL

SEQ ID NO: 7916 - protein, 9 aa, Artificial Sequence
  Description of Artificial Sequence: Synthetic peptide
  Seed: LVVVGACGV (KRAS G12C)
LVVVGACGI

SEQ ID NO: 7917 - protein, 9 aa, Artificial Sequence
  Description of Artificial Sequence: Synthetic peptide
  Seed: LVVVGACGV (KRAS G12C)
LVVVGACGL

SEQ ID NO: 7918 - protein, 9 aa, Artificial Sequence
  Description of Artificial Sequence: Synthetic peptide
  Seed: VVGACGVGK (KRAS G12C)
VAGACGVGK

SEQ ID NO: 7919 - protein, 9 aa, Artificial Sequence
  Description of Artificial Sequence: Synthetic peptide
  Seed: VVGACGVGK (KRAS G12C)
VAGACGVGR

SEQ ID NO: 7920 - protein, 10 aa, Artificial Sequence
  Description of Artificial Sequence: Synthetic peptide
  Seed: VVVGACGVGK (KRAS G12C)
VAVGACGVGK

SEQ ID NO: 7921 - protein, 10 aa, Artificial Sequence
  Description of Artificial Sequence: Synthetic peptide
  Seed: VVVGACGVGK (KRAS G12C)
VAVGACGVGR

SEQ ID NO: 7922 - protein, 10 aa, Artificial Sequence
  Description of Artificial Sequence: Synthetic peptide
  Seed: VVVGACGVGK (KRAS G12C)
VCVGACGVGK

SEQ ID NO: 7923 - protein, 10 aa, Artificial Sequence
  Description of Artificial Sequence: Synthetic peptide
  Seed: VVVGACGVGK (KRAS G12C)
VDVGACGVGK

SEQ ID NO: 7924 - protein, 10 aa, Artificial Sequence
  Description of Artificial Sequence: Synthetic peptide
  Seed: VVVGACGVGK (KRAS G12C)
VEVGACGVGK

SEQ ID NO: 7925 - protein, 9 aa, Artificial Sequence
  Description of Artificial Sequence: Synthetic peptide
  Seed: VVGACGVGK (KRAS G12C)
VFGACGVGK

SEQ ID NO: 7926 - protein, 9 aa, Artificial Sequence
  Description of Artificial Sequence: Synthetic peptide
  Seed: VVGACGVGK (KRAS G12C)
VFGACGVGR

SEQ ID NO: 7927 - protein, 10 aa, Artificial Sequence
  Description of Artificial Sequence: Synthetic peptide
  Seed: VVVGACGVGK (KRAS G12C)
VFVGACGVGK

SEQ ID NO: 7928 - protein, 9 aa, Artificial Sequence
  Description of Artificial Sequence: Synthetic peptide
  Seed: VVGACGVGK (KRAS G12C)
VGGACGVGR

SEQ ID NO: 7929 - protein, 10 aa, Artificial Sequence
  Description of Artificial Sequence: Synthetic peptide
  Seed: VVVGACGVGK (KRAS G12C)
VGVGACGVGK

SEQ ID NO: 7930 - protein, 10 aa, Artificial Sequence
  Description of Artificial Sequence: Synthetic peptide
  Seed: VVVGACGVGK (KRAS G12C)
VHVGACGVGK

SEQ ID NO: 7931 - protein, 9 aa, Artificial Sequence
  Description of Artificial Sequence: Synthetic peptide
  Seed: VVGACGVGK (KRAS G12C)
VIGACGVGK

SEQ ID NO: 7932 - protein, 9 aa, Artificial Sequence
  Description of Artificial Sequence: Synthetic peptide
  Seed: VVGACGVGK (KRAS G12C)
VIGACGVGR

SEQ ID NO: 7933 - protein, 10 aa, Artificial Sequence
  Description of Artificial Sequence: Synthetic peptide
  Seed: VVVGACGVGK (KRAS G12C)
VIVGACGVGK

SEQ ID NO: 7934 - protein, 10 aa, Artificial Sequence
  Description of Artificial Sequence: Synthetic peptide
  Seed: VVVGACGVGK (KRAS G12C)
VIVGACGVGR

SEQ ID NO: 7935 - protein, 10 aa, Artificial Sequence
  Description of Artificial Sequence: Synthetic peptide
  Seed: VVVGACGVGK (KRAS G12C)
VKVGACGVGK

SEQ ID NO: 7936 - protein, 9 aa, Artificial Sequence
  Description of Artificial Sequence: Synthetic peptide
  Seed: VVGACGVGK (KRAS G12C)
VLGACGVGK

SEQ ID NO: 7937 - protein, 9 aa, Artificial Sequence
  Description of Artificial Sequence: Synthetic peptide
  Seed: VVGACGVGK (KRAS G12C)
VLGACGVGR

SEQ ID NO: 7938 - protein, 10 aa, Artificial Sequence
  Description of Artificial Sequence: Synthetic peptide
  Seed: VVVGACGVGK (KRAS G12C)
VLVGACGVGK

SEQ ID NO: 7939 - protein, 10 aa, Artificial Sequence
  Description of Artificial Sequence: Synthetic peptide
  Seed: VVVGACGVGK (KRAS G12C)
VLVGACGVGR

SEQ ID NO: 7940 - protein, 10 aa, Artificial Sequence
  Description of Artificial Sequence: Synthetic peptide
  Seed: VVVGACGVGK (KRAS G12C)
VMVGACGVGR

SEQ ID NO: 7941 - protein, 10 aa, Artificial Sequence
  Description of Artificial Sequence: Synthetic peptide
  Seed: VVVGACGVGK (KRAS G12C)
VNVGACGVGK

SEQ ID NO: 7942 - protein, 10 aa, Artificial Sequence
  Description of Artificial Sequence: Synthetic peptide
  Seed: VVVGACGVGK (KRAS G12C)
VPVGACGVGK

SEQ ID NO: 7943 - protein, 10 aa, Artificial Sequence
  Description of Artificial Sequence: Synthetic peptide
  Seed: VVVGACGVGK (KRAS G12C)
VPVGACGVGR

SEQ ID NO: 7944 - protein, 9 aa, Artificial Sequence
  Description of Artificial Sequence: Synthetic peptide
  Seed: VVGACGVGK (KRAS G12C)
VQGACGVGK

SEQ ID NO: 7945 - protein, 9 aa, Artificial Sequence
  Description of Artificial Sequence: Synthetic peptide
  Seed: VVGACGVGK (KRAS G12C)
VQGACGVGR

SEQ ID NO: 7946 - protein, 10 aa, Artificial Sequence
  Description of Artificial Sequence: Synthetic peptide
  Seed: VVVGACGVGK (KRAS G12C)
VQVGACGVGK

SEQ ID NO: 7947 - protein, 10 aa, Artificial Sequence
  Description of Artificial Sequence: Synthetic peptide
  Seed: VVVGACGVGK (KRAS G12C)
VRVGACGVGK

SEQ ID NO: 7948 - protein, 9 aa, Artificial Sequence
  Description of Artificial Sequence: Synthetic peptide
  Seed: VVGACGVGK (KRAS G12C)
VSGACGVGK

SEQ ID NO: 7949 - protein, 9 aa, Artificial Sequence
  Description of Artificial Sequence: Synthetic peptide
  Seed: VVGACGVGK (KRAS G12C)
VSGACGVGR

SEQ ID NO: 7950 - protein, 10 aa, Artificial Sequence
  Description of Artificial Sequence: Synthetic peptide
  Seed: VVVGACGVGK (KRAS G12C)
VSVGACGVGK

SEQ ID NO: 7951 - protein, 10 aa, Artificial Sequence
  Description of Artificial Sequence: Synthetic peptide
  Seed: VVVGACGVGK (KRAS G12C)
VSVGACGVGR

SEQ ID NO: 7952 - protein, 9 aa, Artificial Sequence
  Description of Artificial Sequence: Synthetic peptide
  Seed: VVGACGVGK (KRAS G12C)
VTGACGVGK

SEQ ID NO: 7953 - protein, 9 aa, Artificial Sequence
  Description of Artificial Sequence: Synthetic peptide
  Seed: VVGACGVGK (KRAS G12C)
VTGACGVGR

SEQ ID NO: 7954 - protein, 9 aa, Artificial Sequence
  Description of Artificial Sequence: Synthetic peptide
  Seed: VVGACGVGK (KRAS G12C)
VVGACGVGR

SEQ ID NO: 7955 - protein, 9 aa, Artificial Sequence
  Description of Artificial Sequence: Synthetic peptide
  Seed: VVGACGVGK (KRAS G12C)
VWGACGVGK

SEQ ID NO: 7956 - protein, 9 aa, Artificial Sequence
  Description of Artificial Sequence: Synthetic peptide
  Seed: VVGACGVGK (KRAS G12C)
VWGACGVGR

SEQ ID NO: 7957 - protein, 10 aa, Artificial Sequence
  Description of Artificial Sequence: Synthetic peptide
  Seed: VVVGACGVGK (KRAS G12C)
VWVGACGVGK

SEQ ID NO: 7958 - protein, 9 aa, Artificial Sequence
  Description of Artificial Sequence: Synthetic peptide
  Seed: VVGACGVGK (KRAS G12C)
VYGACGVGK

SEQ ID NO: 7959 - protein, 9 aa, Artificial Sequence
  Description of Artificial Sequence: Synthetic peptide
  Seed: VVGACGVGK (KRAS G12C)
VYGACGVGR

SEQ ID NO: 7960 - protein, 10 aa, Artificial Sequence
  Description of Artificial Sequence: Synthetic peptide
  Seed: VVVGACGVGK (KRAS G12C)
VYVGACGVGK

SEQ ID NO: 7961 - protein, 10 aa, Artificial Sequence
  Description of Artificial Sequence: Synthetic peptide
  Seed: GACGVGKSAL (KRAS G12C)
GACGVGKSAA

SEQ ID NO: 7962 - protein, 10 aa, Artificial Sequence
  Description of Artificial Sequence: Synthetic peptide
  Seed: GACGVGKSAL (KRAS G12C)
GACGVGKSAF

SEQ ID NO: 7963 - protein, 10 aa, Artificial Sequence
  Description of Artificial Sequence: Synthetic peptide
  Seed: GACGVGKSAL (KRAS G12C)
GACGVGKSAH

SEQ ID NO: 7964 - protein, 10 aa, Artificial Sequence
  Description of Artificial Sequence: Synthetic peptide
  Seed: GACGVGKSAL (KRAS G12C)
GACGVGKSAI

SEQ ID NO: 7965 - protein, 10 aa, Artificial Sequence
  Description of Artificial Sequence: Synthetic peptide
  Seed: GACGVGKSAL (KRAS G12C)
GACGVGKSAK

SEQ ID NO: 7966 - protein, 10 aa, Artificial Sequence
  Description of Artificial Sequence: Synthetic peptide
  Seed: GACGVGKSAL (KRAS G12C)
GACGVGKSAM

SEQ ID NO: 7967 - protein, 10 aa, Artificial Sequence
  Description of Artificial Sequence: Synthetic peptide
  Seed: GACGVGKSAL (KRAS G12C)
GACGVGKSAR

SEQ ID NO: 7968 - protein, 10 aa, Artificial Sequence
  Description of Artificial Sequence: Synthetic peptide
  Seed: GACGVGKSAL (KRAS G12C)
GACGVGKSAV

SEQ ID NO: 7969 - protein, 10 aa, Artificial Sequence
  Description of Artificial Sequence: Synthetic peptide
  Seed: GACGVGKSAL (KRAS G12C)
GACGVGKSAW

SEQ ID NO: 7970 - protein, 10 aa, Artificial Sequence
  Description of Artificial Sequence: Synthetic peptide
  Seed: GACGVGKSAL (KRAS G12C)
GACGVGKSAY

SEQ ID NO: 7971 - protein, 9 aa, Artificial Sequence
  Description of Artificial Sequence: Synthetic peptide
  Seed: GACGVGKSA (KRAS G12C)
GACGVGKSC

SEQ ID NO: 7972 - protein, 9 aa, Artificial Sequence
  Description of Artificial Sequence: Synthetic peptide
  Seed: GACGVGKSA (KRAS G12C)
GACGVGKSF

SEQ ID NO: 7973 - protein, 9 aa, Artificial Sequence
  Description of Artificial Sequence: Synthetic peptide
  Seed: GACGVGKSA (KRAS G12C)
GACGVGKSH

SEQ ID NO: 7974 - protein, 9 aa, Artificial Sequence
  Description of Artificial Sequence: Synthetic peptide
  Seed: GACGVGKSA (KRAS G12C)
GACGVGKSI

SEQ ID NO: 7975 - protein, 9 aa, Artificial Sequence
  Description of Artificial Sequence: Synthetic peptide
  Seed: GACGVGKSA (KRAS G12C)
GACGVGKSK

SEQ ID NO: 7976 - protein, 9 aa, Artificial Sequence
  Description of Artificial Sequence: Synthetic peptide
  Seed: GACGVGKSA (KRAS G12C)
GACGVGKSM

SEQ ID NO: 7977 - protein, 9 aa, Artificial Sequence
  Description of Artificial Sequence: Synthetic peptide
  Seed: GACGVGKSA (KRAS G12C)
GACGVGKSQ

SEQ ID NO: 7978 - protein, 9 aa, Artificial Sequence
  Description of Artificial Sequence: Synthetic peptide
  Seed: GACGVGKSA (KRAS G12C)
GACGVGKSR

SEQ ID NO: 7979 - protein, 9 aa, Artificial Sequence
  Description of Artificial Sequence: Synthetic peptide
  Seed: GACGVGKSA (KRAS G12C)
GACGVGKST

SEQ ID NO: 7980 - protein, 9 aa, Artificial Sequence
  Description of Artificial Sequence: Synthetic peptide
  Seed: GACGVGKSA (KRAS G12C)
GACGVGKSV

SEQ ID NO: 7981 - protein, 9 aa, Artificial Sequence
  Description of Artificial Sequence: Synthetic peptide
  Seed: GACGVGKSA (KRAS G12C)
GACGVGKSW

SEQ ID NO: 7982 - protein, 9 aa, Artificial Sequence
  Description of Artificial Sequence: Synthetic peptide
  Seed: GACGVGKSA (KRAS G12C)
GACGVGKSY

SEQ ID NO: 7983 - protein, 10 aa, Artificial Sequence
  Description of Artificial Sequence: Synthetic peptide
  Seed: GACGVGKSAL (KRAS G12C)
GCCGVGKSAK

SEQ ID NO: 7984 - protein, 10 aa, Artificial Sequence
  Description of Artificial Sequence: Synthetic peptide
  Seed: GACGVGKSAL (KRAS G12C)
GCCGVGKSAY

SEQ ID NO: 7985 - protein, 9 aa, Artificial Sequence
  Description of Artificial Sequence: Synthetic peptide
  Seed: GACGVGKSA (KRAS G12C)
GCCGVGKSF

SEQ ID NO: 7986 - protein, 9 aa, Artificial Sequence
  Description of Artificial Sequence: Synthetic peptide
  Seed: GACGVGKSA (KRAS G12C)
GCCGVGKSK

SEQ ID NO: 7987 - protein, 9 aa, Artificial Sequence
  Description of Artificial Sequence: Synthetic peptide
  Seed: GACGVGKSA (KRAS G12C)
GCCGVGKSM

SEQ ID NO: 7988 - protein, 9 aa, Artificial Sequence
  Description of Artificial Sequence: Synthetic peptide
  Seed: GACGVGKSA (KRAS G12C)
GCCGVGKSR

SEQ ID NO: 7989 - protein, 9 aa, Artificial Sequence
  Description of Artificial Sequence: Synthetic peptide
  Seed: GACGVGKSA (KRAS G12C)
GCCGVGKSY

SEQ ID NO: 7990 - protein, 10 aa, Artificial Sequence
  Description of Artificial Sequence: Synthetic peptide
  Seed: GACGVGKSAL (KRAS G12C)
GDCGVGKSAK

SEQ ID NO: 7991 - protein, 10 aa, Artificial Sequence
  Description of Artificial Sequence: Synthetic peptide
  Seed: GACGVGKSAL (KRAS G12C)
GDCGVGKSAR

SEQ ID NO: 7992 - protein, 9 aa, Artificial Sequence
  Description of Artificial Sequence: Synthetic peptide
  Seed: GACGVGKSA (KRAS G12C)
GDCGVGKSF

SEQ ID NO: 7993 - protein, 9 aa, Artificial Sequence
  Description of Artificial Sequence: Synthetic peptide
  Seed: GACGVGKSA (KRAS G12C)
GDCGVGKSK

SEQ ID NO: 7994 - protein, 9 aa, Artificial Sequence
  Description of Artificial Sequence: Synthetic peptide
  Seed: GACGVGKSA (KRAS G12C)
GDCGVGKSR

SEQ ID NO: 7995 - protein, 9 aa, Artificial Sequence
  Description of Artificial Sequence: Synthetic peptide
  Seed: GACGVGKSA (KRAS G12C)
GDCGVGKSY

SEQ ID NO: 7996 - protein, 10 aa, Artificial Sequence
  Description of Artificial Sequence: Synthetic peptide
  Seed: GACGVGKSAL (KRAS G12C)
GECGVGKSAF

SEQ ID NO: 7997 - protein, 10 aa, Artificial Sequence
  Description of Artificial Sequence: Synthetic peptide
  Seed: GACGVGKSAL (KRAS G12C)
GECGVGKSAK

SEQ ID NO: 7998 - protein, 10 aa, Artificial Sequence
  Description of Artificial Sequence: Synthetic peptide
  Seed: GACGVGKSAL (KRAS G12C)
GECGVGKSAL

SEQ ID NO: 7999 - protein, 10 aa, Artificial Sequence
  Description of Artificial Sequence: Synthetic peptide
  Seed: GACGVGKSAL (KRAS G12C)
GECGVGKSAR

SEQ ID NO: 8000 - protein, 10 aa, Artificial Sequence
  Description of Artificial Sequence: Synthetic peptide
  Seed: GACGVGKSAL (KRAS G12C)
GECGVGKSAY

SEQ ID NO: 8001 - protein, 9 aa, Artificial Sequence
  Description of Artificial Sequence: Synthetic peptide
  Seed: GACGVGKSA (KRAS G12C)
GECGVGKSF

SEQ ID NO: 8002 - protein, 9 aa, Artificial Sequence
  Description of Artificial Sequence: Synthetic peptide
  Seed: GACGVGKSA (KRAS G12C)
GECGVGKSK

SEQ ID NO: 8003 - protein, 9 aa, Artificial Sequence
  Description of Artificial Sequence: Synthetic peptide
  Seed: GACGVGKSA (KRAS G12C)
GECGVGKSM

SEQ ID NO: 8004 - protein, 9 aa, Artificial Sequence
  Description of Artificial Sequence: Synthetic peptide
  Seed: GACGVGKSA (KRAS G12C)
GECGVGKSR

SEQ ID NO: 8005 - protein, 9 aa, Artificial Sequence
  Description of Artificial Sequence: Synthetic peptide
  Seed: GACGVGKSA (KRAS G12C)
GECGVGKSY

SEQ ID NO: 8006 - protein, 10 aa, Artificial Sequence
  Description of Artificial Sequence: Synthetic peptide
  Seed: GACGVGKSAL (KRAS G12C)
GFCGVGKSAK

SEQ ID NO: 8007 - protein, 10 aa, Artificial Sequence
  Description of Artificial Sequence: Synthetic peptide
  Seed: GACGVGKSAL (KRAS G12C)
GFCGVGKSAL

SEQ ID NO: 8008 - protein, 10 aa, Artificial Sequence
  Description of Artificial Sequence: Synthetic peptide
  Seed: GACGVGKSAL (KRAS G12C)
GFCGVGKSAY

SEQ ID NO: 8009 - protein, 9 aa, Artificial Sequence
  Description of Artificial Sequence: Synthetic peptide
  Seed: GACGVGKSA (KRAS G12C)
GFCGVGKSK

SEQ ID NO: 8010 - protein, 9 aa, Artificial Sequence
  Description of Artificial Sequence: Synthetic peptide
  Seed: GACGVGKSA (KRAS G12C)
GFCGVGKSR

SEQ ID NO: 8011 - protein, 9 aa, Artificial Sequence
  Description of Artificial Sequence: Synthetic peptide
  Seed: GACGVGKSA (KRAS G12C)
GFCGVGKSY

SEQ ID NO: 8012 - protein, 10 aa, Artificial Sequence
  Description of Artificial Sequence: Synthetic peptide
  Seed: GACGVGKSAL (KRAS G12C)
GGCGVGKSAF

SEQ ID NO: 8013 - protein, 10 aa, Artificial Sequence
  Description of Artificial Sequence: Synthetic peptide
  Seed: GACGVGKSAL (KRAS G12C)
GGCGVGKSAK

SEQ ID NO: 8014 - protein, 10 aa, Artificial Sequence
  Description of Artificial Sequence: Synthetic peptide
  Seed: GACGVGKSAL (KRAS G12C)
GGCGVGKSAL

SEQ ID NO: 8015 - protein, 10 aa, Artificial Sequence
  Description of Artificial Sequence: Synthetic peptide
  Seed: GACGVGKSAL (KRAS G12C)
GGCGVGKSAM

SEQ ID NO: 8016 - protein, 10 aa, Artificial Sequence
  Description of Artificial Sequence: Synthetic peptide
  Seed: GACGVGKSAL (KRAS G12C)
GGCGVGKSAR

SEQ ID NO: 8017 - protein, 10 aa, Artificial Sequence
  Description of Artificial Sequence: Synthetic peptide
  Seed: GACGVGKSAL (KRAS G12C)
GGCGVGKSAY

SEQ ID NO: 8018 - protein, 9 aa, Artificial Sequence
  Description of Artificial Sequence: Synthetic peptide
  Seed: GACGVGKSA (KRAS G12C)
GGCGVGKSF

SEQ ID NO: 8019 - protein, 9 aa, Artificial Sequence
  Description of Artificial Sequence: Synthetic peptide
  Seed: GACGVGKSA (KRAS G12C)
GGCGVGKSH

SEQ ID NO: 8020 - protein, 9 aa, Artificial Sequence
  Description of Artificial Sequence: Synthetic peptide
  Seed: GACGVGKSA (KRAS G12C)
GGCGVGKSK

SEQ ID NO: 8021 - protein, 9 aa, Artificial Sequence
  Description of Artificial Sequence: Synthetic peptide
  Seed: GACGVGKSA (KRAS G12C)
GGCGVGKSL

SEQ ID NO: 8022 - protein, 9 aa, Artificial Sequence
  Description of Artificial Sequence: Synthetic peptide
  Seed: GACGVGKSA (KRAS G12C)
GGCGVGKSM

SEQ ID NO: 8023 - protein, 9 aa, Artificial Sequence
  Description of Artificial Sequence: Synthetic peptide
  Seed: GACGVGKSA (KRAS G12C)
GGCGVGKSR

SEQ ID NO: 8024 - protein, 9 aa, Artificial Sequence
  Description of Artificial Sequence: Synthetic peptide
  Seed: GACGVGKSA (KRAS G12C)
GGCGVGKSV

SEQ ID NO: 8025 - protein, 9 aa, Artificial Sequence
  Description of Artificial Sequence: Synthetic peptide
  Seed: GACGVGKSA (KRAS G12C)
GGCGVGKSY

SEQ ID NO: 8026 - protein, 10 aa, Artificial Sequence
  Description of Artificial Sequence: Synthetic peptide
  Seed: GACGVGKSAL (KRAS G12C)
GHCGVGKSAL

SEQ ID NO: 8027 - protein, 10 aa, Artificial Sequence
  Description of Artificial Sequence: Synthetic peptide
  Seed: GACGVGKSAL (KRAS G12C)
GHCGVGKSAM

SEQ ID NO: 8028 - protein, 9 aa, Artificial Sequence
  Description of Artificial Sequence: Synthetic peptide
  Seed: GACGVGKSA (KRAS G12C)
GICGVGKSA

SEQ ID NO: 8029 - protein, 10 aa, Artificial Sequence
  Description of Artificial Sequence: Synthetic peptide
  Seed: GACGVGKSAL (KRAS G12C)
GICGVGKSAF

SEQ ID NO: 8030 - protein, 10 aa, Artificial Sequence
  Description of Artificial Sequence: Synthetic peptide
  Seed: GACGVGKSAL (KRAS G12C)
GICGVGKSAK

SEQ ID NO: 8031 - protein, 10 aa, Artificial Sequence
  Description of Artificial Sequence: Synthetic peptide
  Seed: GACGVGKSAL (KRAS G12C)
GICGVGKSAL

SEQ ID NO: 8032 - protein, 10 aa, Artificial Sequence
  Description of Artificial Sequence: Synthetic peptide
  Seed: GACGVGKSAL (KRAS G12C)
GICGVGKSAM

SEQ ID NO: 8033 - protein, 10 aa, Artificial Sequence
  Description of Artificial Sequence: Synthetic peptide
  Seed: GACGVGKSAL (KRAS G12C)
GICGVGKSAR

SEQ ID NO: 8034 - protein, 10 aa, Artificial Sequence
  Description of Artificial Sequence: Synthetic peptide
  Seed: GACGVGKSAL (KRAS G12C)
GICGVGKSAY

SEQ ID NO: 8035 - protein, 9 aa, Artificial Sequence
  Description of Artificial Sequence: Synthetic peptide
  Seed: GACGVGKSA (KRAS G12C)
GICGVGKSF

SEQ ID NO: 8036 - protein, 9 aa, Artificial Sequence
  Description of Artificial Sequence: Synthetic peptide
  Seed: GACGVGKSA (KRAS G12C)
GICGVGKSH

SEQ ID NO: 8037 - protein, 9 aa, Artificial Sequence
  Description of Artificial Sequence: Synthetic peptide
  Seed: GACGVGKSA (KRAS G12C)
GICGVGKSI

SEQ ID NO: 8038 - protein, 9 aa, Artificial Sequence
  Description of Artificial Sequence: Synthetic peptide
  Seed: GACGVGKSA (KRAS G12C)
GICGVGKSK

SEQ ID NO: 8039 - protein, 9 aa, Artificial Sequence
  Description of Artificial Sequence: Synthetic peptide
  Seed: GACGVGKSA (KRAS G12C)
GICGVGKSL

SEQ ID NO: 8040 - protein, 9 aa, Artificial Sequence
  Description of Artificial Sequence: Synthetic peptide
  Seed: GACGVGKSA (KRAS G12C)
GICGVGKSM

SEQ ID NO: 8041 - protein, 9 aa, Artificial Sequence
  Description of Artificial Sequence: Synthetic peptide
  Seed: GACGVGKSA (KRAS G12C)
GICGVGKSR

SEQ ID NO: 8042 - protein, 9 aa, Artificial Sequence
  Description of Artificial Sequence: Synthetic peptide
  Seed: GACGVGKSA (KRAS G12C)
GICGVGKSV

SEQ ID NO: 8043 - protein, 9 aa, Artificial Sequence
  Description of Artificial Sequence: Synthetic peptide
  Seed: GACGVGKSA (KRAS G12C)
GICGVGKSY

SEQ ID NO: 8044 - protein, 10 aa, Artificial Sequence
  Description of Artificial Sequence: Synthetic peptide
  Seed: GACGVGKSAL (KRAS G12C)
GLCGVGKSAF

SEQ ID NO: 8045 - protein, 10 aa, Artificial Sequence
  Description of Artificial Sequence: Synthetic peptide
  Seed: GACGVGKSAL (KRAS G12C)
GLCGVGKSAK

SEQ ID NO: 8046 - protein, 10 aa, Artificial Sequence
  Description of Artificial Sequence: Synthetic peptide
  Seed: GACGVGKSAL (KRAS G12C)
GLCGVGKSAL

SEQ ID NO: 8047 - protein, 10 aa, Artificial Sequence
  Description of Artificial Sequence: Synthetic peptide
  Seed: GACGVGKSAL (KRAS G12C)
GLCGVGKSAM

SEQ ID NO: 8048 - protein, 10 aa, Artificial Sequence
  Description of Artificial Sequence: Synthetic peptide
  Seed: GACGVGKSAL (KRAS G12C)
GLCGVGKSAR

SEQ ID NO: 8049 - protein, 10 aa, Artificial Sequence
  Description of Artificial Sequence: Synthetic peptide
  Seed: GACGVGKSAL (KRAS G12C)
GLCGVGKSAY

SEQ ID NO: 8050 - protein, 9 aa, Artificial Sequence
  Description of Artificial Sequence: Synthetic peptide
  Seed: GACGVGKSA (KRAS G12C)
GLCGVGKSF

SEQ ID NO: 8051 - protein, 9 aa, Artificial Sequence
  Description of Artificial Sequence: Synthetic peptide
  Seed: GACGVGKSA (KRAS G12C)
GLCGVGKSH

SEQ ID NO: 8052 - protein, 9 aa, Artificial Sequence
  Description of Artificial Sequence: Synthetic peptide
  Seed: GACGVGKSA (KRAS G12C)
GLCGVGKSK

SEQ ID NO: 8053 - protein, 9 aa, Artificial Sequence
  Description of Artificial Sequence: Synthetic peptide
  Seed: GACGVGKSA (KRAS G12C)
GLCGVGKSL

SEQ ID NO: 8054 - protein, 9 aa, Artificial Sequence
  Description of Artificial Sequence: Synthetic peptide
  Seed: GACGVGKSA (KRAS G12C)
GLCGVGKSM

SEQ ID NO: 8055 - protein, 9 aa, Artificial Sequence
  Description of Artificial Sequence: Synthetic peptide
  Seed: GACGVGKSA (KRAS G12C)
GLCGVGKSR

SEQ ID NO: 8056 - protein, 9 aa, Artificial Sequence
  Description of Artificial Sequence: Synthetic peptide
  Seed: GACGVGKSA (KRAS G12C)
GLCGVGKSY

SEQ ID NO: 8057 - protein, 10 aa, Artificial Sequence
  Description of Artificial Sequence: Synthetic peptide
  Seed: GACGVGKSAL (KRAS G12C)
GMCGVGKSAF

SEQ ID NO: 8058 - protein, 10 aa, Artificial Sequence
  Description of Artificial Sequence: Synthetic peptide
  Seed: GACGVGKSAL (KRAS G12C)
GMCGVGKSAK

SEQ ID NO: 8059 - protein, 10 aa, Artificial Sequence
  Description of Artificial Sequence: Synthetic peptide
  Seed: GACGVGKSAL (KRAS G12C)
GMCGVGKSAL

SEQ ID NO: 8060 - protein, 10 aa, Artificial Sequence
  Description of Artificial Sequence: Synthetic peptide
  Seed: GACGVGKSAL (KRAS G12C)
GMCGVGKSAM

SEQ ID NO: 8061 - protein, 10 aa, Artificial Sequence
  Description of Artificial Sequence: Synthetic peptide
  Seed: GACGVGKSAL (KRAS G12C)
GMCGVGKSAR

SEQ ID NO: 8062 - protein, 10 aa, Artificial Sequence
  Description of Artificial Sequence: Synthetic peptide
  Seed: GACGVGKSAL (KRAS G12C)
GMCGVGKSAY

SEQ ID NO: 8063 - protein, 9 aa, Artificial Sequence
  Description of Artificial Sequence: Synthetic peptide
  Seed: GACGVGKSA (KRAS G12C)
GMCGVGKSF

SEQ ID NO: 8064 - protein, 9 aa, Artificial Sequence
  Description of Artificial Sequence: Synthetic peptide
  Seed: GACGVGKSA (KRAS G12C)
GMCGVGKSH

SEQ ID NO: 8065 - protein, 9 aa, Artificial Sequence
  Description of Artificial Sequence: Synthetic peptide
  Seed: GACGVGKSA (KRAS G12C)
GMCGVGKSK

SEQ ID NO: 8066 - protein, 9 aa, Artificial Sequence
  Description of Artificial Sequence: Synthetic peptide
  Seed: GACGVGKSA (KRAS G12C)
GMCGVGKSL

SEQ ID NO: 8067 - protein, 9 aa, Artificial Sequence
  Description of Artificial Sequence: Synthetic peptide
  Seed: GACGVGKSA (KRAS G12C)
GMCGVGKSM

SEQ ID NO: 8068 - protein, 9 aa, Artificial Sequence
  Description of Artificial Sequence: Synthetic peptide
  Seed: GACGVGKSA (KRAS G12C)
GMCGVGKSR

SEQ ID NO: 8069 - protein, 9 aa, Artificial Sequence
  Description of Artificial Sequence: Synthetic peptide
  Seed: GACGVGKSA (KRAS G12C)
GMCGVGKSY

SEQ ID NO: 8070 - protein, 10 aa, Artificial Sequence
  Description of Artificial Sequence: Synthetic peptide
  Seed: GACGVGKSAL (KRAS G12C)
GNCGVGKSAK

SEQ ID NO: 8071 - protein, 10 aa, Artificial Sequence
  Description of Artificial Sequence: Synthetic peptide
  Seed: GACGVGKSAL (KRAS G12C)
GNCGVGKSAR

SEQ ID NO: 8072 - protein, 10 aa, Artificial Sequence
  Description of Artificial Sequence: Synthetic peptide
  Seed: GACGVGKSAL (KRAS G12C)
GNCGVGKSAY

SEQ ID NO: 8073 - protein, 9 aa, Artificial Sequence
  Description of Artificial Sequence: Synthetic peptide
  Seed: GACGVGKSA (KRAS G12C)
GNCGVGKSF

SEQ ID NO: 8074 - protein, 9 aa, Artificial Sequence
  Description of Artificial Sequence: Synthetic peptide
  Seed: GACGVGKSA (KRAS G12C)
GNCGVGKSK

SEQ ID NO: 8075 - protein, 9 aa, Artificial Sequence
  Description of Artificial Sequence: Synthetic peptide
  Seed: GACGVGKSA (KRAS G12C)
GNCGVGKSM

SEQ ID NO: 8076 - protein, 9 aa, Artificial Sequence
  Description of Artificial Sequence: Synthetic peptide
  Seed: GACGVGKSA (KRAS G12C)
GNCGVGKSR

SEQ ID NO: 8077 - protein, 9 aa, Artificial Sequence
  Description of Artificial Sequence: Synthetic peptide
  Seed: GACGVGKSA (KRAS G12C)
GNCGVGKSY

SEQ ID NO: 8078 - protein, 10 aa, Artificial Sequence
  Description of Artificial Sequence: Synthetic peptide
  Seed: GACGVGKSAL (KRAS G12C)
GPCGVGKSAA

SEQ ID NO: 8079 - protein, 10 aa, Artificial Sequence
  Description of Artificial Sequence: Synthetic peptide
  Seed: GACGVGKSAL (KRAS G12C)
GPCGVGKSAC

SEQ ID NO: 8080 - protein, 10 aa, Artificial Sequence
  Description of Artificial Sequence: Synthetic peptide
  Seed: GACGVGKSAL (KRAS G12C)
GPCGVGKSAF

SEQ ID NO: 8081 - protein, 10 aa, Artificial Sequence
  Description of Artificial Sequence: Synthetic peptide
  Seed: GACGVGKSAL (KRAS G12C)
GPCGVGKSAI

SEQ ID NO: 8082 - protein, 10 aa, Artificial Sequence
  Description of Artificial Sequence: Synthetic peptide
  Seed: GACGVGKSAL (KRAS G12C)
GPCGVGKSAP

SEQ ID NO: 8083 - protein, 10 aa, Artificial Sequence
  Description of Artificial Sequence: Synthetic peptide
  Seed: GACGVGKSAL (KRAS G12C)
GPCGVGKSAS

SEQ ID NO: 8084 - protein, 10 aa, Artificial Sequence
  Description of Artificial Sequence: Synthetic peptide
  Seed: GACGVGKSAL (KRAS G12C)
GPCGVGKSAT

SEQ ID NO: 8085 - protein, 10 aa, Artificial Sequence
  Description of Artificial Sequence: Synthetic peptide
  Seed: GACGVGKSAL (KRAS G12C)
GPCGVGKSAV

SEQ ID NO: 8086 - protein, 10 aa, Artificial Sequence
  Description of Artificial Sequence: Synthetic peptide
  Seed: GACGVGKSAL (KRAS G12C)
GPCGVGKSAW

SEQ ID NO: 8087 - protein, 10 aa, Artificial Sequence
  Description of Artificial Sequence: Synthetic peptide
  Seed: GACGVGKSAL (KRAS G12C)
GPCGVGKSAY

SEQ ID NO: 8088 - protein, 9 aa, Artificial Sequence
  Description of Artificial Sequence: Synthetic peptide
  Seed: GACGVGKSA (KRAS G12C)
GPCGVGKSC

SEQ ID NO: 8089 - protein, 9 aa, Artificial Sequence
  Description of Artificial Sequence: Synthetic peptide
  Seed: GACGVGKSA (KRAS G12C)
GPCGVGKSF

SEQ ID NO: 8090 - protein, 9 aa, Artificial Sequence
  Description of Artificial Sequence: Synthetic peptide
  Seed: GACGVGKSA (KRAS G12C)
GPCGVGKSG

SEQ ID NO: 8091 - protein, 9 aa, Artificial Sequence
  Description of Artificial Sequence: Synthetic peptide
  Seed: GACGVGKSA (KRAS G12C)
GPCGVGKSI

SEQ ID NO: 8092 - protein, 9 aa, Artificial Sequence
  Description of Artificial Sequence: Synthetic peptide
  Seed: GACGVGKSA (KRAS G12C)
GPCGVGKSK

SEQ ID NO: 8093 - protein, 9 aa, Artificial Sequence
  Description of Artificial Sequence: Synthetic peptide
  Seed: GACGVGKSA (KRAS G12C)
GPCGVGKSL

SEQ ID NO: 8094 - protein, 9 aa, Artificial Sequence
  Description of Artificial Sequence: Synthetic peptide
  Seed: GACGVGKSA (KRAS G12C)
GPCGVGKSM

SEQ ID NO: 8095 - protein, 9 aa, Artificial Sequence
  Description of Artificial Sequence: Synthetic peptide
  Seed: GACGVGKSA (KRAS G12C)
GPCGVGKSP

SEQ ID NO: 8096 - protein, 9 aa, Artificial Sequence
  Description of Artificial Sequence: Synthetic peptide
  Seed: GACGVGKSA (KRAS G12C)
GPCGVGKSR

SEQ ID NO: 8097 - protein, 9 aa, Artificial Sequence
  Description of Artificial Sequence: Synthetic peptide
  Seed: GACGVGKSA (KRAS G12C)
GPCGVGKSS

SEQ ID NO: 8098 - protein, 9 aa, Artificial Sequence
  Description of Artificial Sequence: Synthetic peptide
  Seed: GACGVGKSA (KRAS G12C)
GPCGVGKST

SEQ ID NO: 8099 - protein, 9 aa, Artificial Sequence
  Description of Artificial Sequence: Synthetic peptide
  Seed: GACGVGKSA (KRAS G12C)
GPCGVGKSV

SEQ ID NO: 8100 - protein, 9 aa, Artificial Sequence
  Description of Artificial Sequence: Synthetic peptide
  Seed: GACGVGKSA (KRAS G12C)
GPCGVGKSW

SEQ ID NO: 8101 - protein, 9 aa, Artificial Sequence
  Description of Artificial Sequence: Synthetic peptide
  Seed: GACGVGKSA (KRAS G12C)
GPCGVGKSY

SEQ ID NO: 8102 - protein, 10 aa, Artificial Sequence
  Description of Artificial Sequence: Synthetic peptide
  Seed: GACGVGKSAL (KRAS G12C)
GQCGVGKSAF

SEQ ID NO: 8103 - protein, 10 aa, Artificial Sequence
  Description of Artificial Sequence: Synthetic peptide
  Seed: GACGVGKSAL (KRAS G12C)
GQCGVGKSAK

SEQ ID NO: 8104 - protein, 10 aa, Artificial Sequence
  Description of Artificial Sequence: Synthetic peptide
  Seed: GACGVGKSAL (KRAS G12C)
GQCGVGKSAL

SEQ ID NO: 8105 - protein, 10 aa, Artificial Sequence
  Description of Artificial Sequence: Synthetic peptide
  Seed: GACGVGKSAL (KRAS G12C)
GQCGVGKSAM

SEQ ID NO: 8106 - protein, 10 aa, Artificial Sequence
  Description of Artificial Sequence: Synthetic peptide
  Seed: GACGVGKSAL (KRAS G12C)
GQCGVGKSAR

SEQ ID NO: 8107 - protein, 10 aa, Artificial Sequence
  Description of Artificial Sequence: Synthetic peptide
  Seed: GACGVGKSAL (KRAS G12C)
GQCGVGKSAY

SEQ ID NO: 8108 - protein, 9 aa, Artificial Sequence
  Description of Artificial Sequence: Synthetic peptide
  Seed: GACGVGKSA (KRAS G12C)
GQCGVGKSF

SEQ ID NO: 8109 - protein, 9 aa, Artificial Sequence
  Description of Artificial Sequence: Synthetic peptide
  Seed: GACGVGKSA (KRAS G12C)
GQCGVGKSH

SEQ ID NO: 8110 - protein, 9 aa, Artificial Sequence
  Description of Artificial Sequence: Synthetic peptide
  Seed: GACGVGKSA (KRAS G12C)
GQCGVGKSK

SEQ ID NO: 8111 - protein, 9 aa, Artificial Sequence
  Description of Artificial Sequence: Synthetic peptide
  Seed: GACGVGKSA (KRAS G12C)
GQCGVGKSL

SEQ ID NO: 8112 - protein, 9 aa, Artificial Sequence
  Description of Artificial Sequence: Synthetic peptide
  Seed: GACGVGKSA (KRAS G12C)
GQCGVGKSM

SEQ ID NO: 8113 - protein, 9 aa, Artificial Sequence
  Description of Artificial Sequence: Synthetic peptide
  Seed: GACGVGKSA (KRAS G12C)
GQCGVGKSR

SEQ ID NO: 8114 - protein, 9 aa, Artificial Sequence
  Description of Artificial Sequence: Synthetic peptide
  Seed: GACGVGKSA (KRAS G12C)
GQCGVGKSY

SEQ ID NO: 8115 - protein, 10 aa, Artificial Sequence
  Description of Artificial Sequence: Synthetic peptide
  Seed: GACGVGKSAL (KRAS G12C)
GRCGVGKSAF

SEQ ID NO: 8116 - protein, 10 aa, Artificial Sequence
  Description of Artificial Sequence: Synthetic peptide
  Seed: GACGVGKSAL (KRAS G12C)
GRCGVGKSAI

SEQ ID NO: 8117 - protein, 10 aa, Artificial Sequence
  Description of Artificial Sequence: Synthetic peptide
  Seed: GACGVGKSAL (KRAS G12C)
GRCGVGKSAL

SEQ ID NO: 8118 - protein, 10 aa, Artificial Sequence
  Description of Artificial Sequence: Synthetic peptide
  Seed: GACGVGKSAL (KRAS G12C)
GRCGVGKSAM

SEQ ID NO: 8119 - protein, 10 aa, Artificial Sequence
  Description of Artificial Sequence: Synthetic peptide
  Seed: GACGVGKSAL (KRAS G12C)
GRCGVGKSAV

SEQ ID NO: 8120 - protein, 9 aa, Artificial Sequence
  Description of Artificial Sequence: Synthetic peptide
  Seed: GACGVGKSA (KRAS G12C)
GSCGVGKSA

SEQ ID NO: 8121 - protein, 10 aa, Artificial Sequence
  Description of Artificial Sequence: Synthetic peptide
  Seed: GACGVGKSAL (KRAS G12C)
GSCGVGKSAF

SEQ ID NO: 8122 - protein, 10 aa, Artificial Sequence
  Description of Artificial Sequence: Synthetic peptide
  Seed: GACGVGKSAL (KRAS G12C)
GSCGVGKSAH

SEQ ID NO: 8123 - protein, 10 aa, Artificial Sequence
  Description of Artificial Sequence: Synthetic peptide
  Seed: GACGVGKSAL (KRAS G12C)
GSCGVGKSAI

SEQ ID NO: 8124 - protein, 10 aa, Artificial Sequence
  Description of Artificial Sequence: Synthetic peptide
  Seed: GACGVGKSAL (KRAS G12C)
GSCGVGKSAK

SEQ ID NO: 8125 - protein, 10 aa, Artificial Sequence
  Description of Artificial Sequence: Synthetic peptide
  Seed: GACGVGKSAL (KRAS G12C)
GSCGVGKSAL

SEQ ID NO: 8126 - protein, 10 aa, Artificial Sequence
  Description of Artificial Sequence: Synthetic peptide
  Seed: GACGVGKSAL (KRAS G12C)
GSCGVGKSAM

SEQ ID NO: 8127 - protein, 10 aa, Artificial Sequence
  Description of Artificial Sequence: Synthetic peptide
  Seed: GACGVGKSAL (KRAS G12C)
GSCGVGKSAR

SEQ ID NO: 8128 - protein, 10 aa, Artificial Sequence
  Description of Artificial Sequence: Synthetic peptide
  Seed: GACGVGKSAL (KRAS G12C)
GSCGVGKSAV

SEQ ID NO: 8129 - protein, 10 aa, Artificial Sequence
  Description of Artificial Sequence: Synthetic peptide
  Seed: GACGVGKSAL (KRAS G12C)
GSCGVGKSAY

SEQ ID NO: 8130 - protein, 9 aa, Artificial Sequence
  Description of Artificial Sequence: Synthetic peptide
  Seed: GACGVGKSA (KRAS G12C)
GSCGVGKSF

SEQ ID NO: 8131 - protein, 9 aa, Artificial Sequence
  Description of Artificial Sequence: Synthetic peptide
  Seed: GACGVGKSA (KRAS G12C)
GSCGVGKSH

SEQ ID NO: 8132 - protein, 9 aa, Artificial Sequence
  Description of Artificial Sequence: Synthetic peptide
  Seed: GACGVGKSA (KRAS G12C)
GSCGVGKSI

SEQ ID NO: 8133 - protein, 9 aa, Artificial Sequence
  Description of Artificial Sequence: Synthetic peptide
  Seed: GACGVGKSA (KRAS G12C)
GSCGVGKSK

SEQ ID NO: 8134 - protein, 9 aa, Artificial Sequence
  Description of Artificial Sequence: Synthetic peptide
  Seed: GACGVGKSA (KRAS G12C)
GSCGVGKSL

SEQ ID NO: 8135 - protein, 9 aa, Artificial Sequence
  Description of Artificial Sequence: Synthetic peptide
  Seed: GACGVGKSA (KRAS G12C)
GSCGVGKSM

SEQ ID NO: 8136 - protein, 9 aa, Artificial Sequence
  Description of Artificial Sequence: Synthetic peptide
  Seed: GACGVGKSA (KRAS G12C)
GSCGVGKSR

SEQ ID NO: 8137 - protein, 9 aa, Artificial Sequence
  Description of Artificial Sequence: Synthetic peptide
  Seed: GACGVGKSA (KRAS G12C)
GSCGVGKSV

SEQ ID NO: 8138 - protein, 9 aa, Artificial Sequence
  Description of Artificial Sequence: Synthetic peptide
  Seed: GACGVGKSA (KRAS G12C)
GSCGVGKSW

SEQ ID NO: 8139 - protein, 9 aa, Artificial Sequence
  Description of Artificial Sequence: Synthetic peptide
  Seed: GACGVGKSA (KRAS G12C)
GSCGVGKSY

SEQ ID NO: 8140 - protein, 9 aa, Artificial Sequence
  Description of Artificial Sequence: Synthetic peptide
  Seed: GACGVGKSA (KRAS G12C)
GTCGVGKSA

SEQ ID NO: 8141 - protein, 10 aa, Artificial Sequence
  Description of Artificial Sequence: Synthetic peptide
  Seed: GACGVGKSAL (KRAS G12C)
GTCGVGKSAF

SEQ ID NO: 8142 - protein, 10 aa, Artificial Sequence
  Description of Artificial Sequence: Synthetic peptide
  Seed: GACGVGKSAL (KRAS G12C)
GTCGVGKSAH

SEQ ID NO: 8143 - protein, 10 aa, Artificial Sequence
  Description of Artificial Sequence: Synthetic peptide
  Seed: GACGVGKSAL (KRAS G12C)
GTCGVGKSAI

SEQ ID NO: 8144 - protein, 10 aa, Artificial Sequence
  Description of Artificial Sequence: Synthetic peptide
  Seed: GACGVGKSAL (KRAS G12C)
GTCGVGKSAK

SEQ ID NO: 8145 - protein, 10 aa, Artificial Sequence
  Description of Artificial Sequence: Synthetic peptide
  Seed: GACGVGKSAL (KRAS G12C)
GTCGVGKSAL

SEQ ID NO: 8146 - protein, 10 aa, Artificial Sequence
  Description of Artificial Sequence: Synthetic peptide
  Seed: GACGVGKSAL (KRAS G12C)
GTCGVGKSAM

SEQ ID NO: 8147 - protein, 10 aa, Artificial Sequence
  Description of Artificial Sequence: Synthetic peptide
  Seed: GACGVGKSAL (KRAS G12C)
GTCGVGKSAR

SEQ ID NO: 8148 - protein, 10 aa, Artificial Sequence
  Description of Artificial Sequence: Synthetic peptide
  Seed: GACGVGKSAL (KRAS G12C)
GTCGVGKSAV

SEQ ID NO: 8149 - protein, 10 aa, Artificial Sequence
  Description of Artificial Sequence: Synthetic peptide
  Seed: GACGVGKSAL (KRAS G12C)
GTCGVGKSAY

SEQ ID NO: 8150 - protein, 9 aa, Artificial Sequence
  Description of Artificial Sequence: Synthetic peptide
  Seed: GACGVGKSA (KRAS G12C)
GTCGVGKSF

SEQ ID NO: 8151 - protein, 9 aa, Artificial Sequence
  Description of Artificial Sequence: Synthetic peptide
  Seed: GACGVGKSA (KRAS G12C)
GTCGVGKSH

SEQ ID NO: 8152 - protein, 9 aa, Artificial Sequence
  Description of Artificial Sequence: Synthetic peptide
  Seed: GACGVGKSA (KRAS G12C)
GTCGVGKSI

SEQ ID NO: 8153 - protein, 9 aa, Artificial Sequence
  Description of Artificial Sequence: Synthetic peptide
  Seed: GACGVGKSA (KRAS G12C)
GTCGVGKSK

SEQ ID NO: 8154 - protein, 9 aa, Artificial Sequence
  Description of Artificial Sequence: Synthetic peptide
  Seed: GACGVGKSA (KRAS G12C)
GTCGVGKSL

SEQ ID NO: 8155 - protein, 9 aa, Artificial Sequence
  Description of Artificial Sequence: Synthetic peptide
  Seed: GACGVGKSA (KRAS G12C)
GTCGVGKSM

SEQ ID NO: 8156 - protein, 9 aa, Artificial Sequence
  Description of Artificial Sequence: Synthetic peptide
  Seed: GACGVGKSA (KRAS G12C)
GTCGVGKSR

SEQ ID NO: 8157 - protein, 9 aa, Artificial Sequence
  Description of Artificial Sequence: Synthetic peptide
  Seed: GACGVGKSA (KRAS G12C)
GTCGVGKSV

SEQ ID NO: 8158 - protein, 9 aa, Artificial Sequence
  Description of Artificial Sequence: Synthetic peptide
  Seed: GACGVGKSA (KRAS G12C)
GTCGVGKSW

SEQ ID NO: 8159 - protein, 9 aa, Artificial Sequence
  Description of Artificial Sequence: Synthetic peptide
  Seed: GACGVGKSA (KRAS G12C)
GTCGVGKSY

SEQ ID NO: 8160 - protein, 9 aa, Artificial Sequence
  Description of Artificial Sequence: Synthetic peptide
  Seed: GACGVGKSA (KRAS G12C)
GVCGVGKSA

SEQ ID NO: 8161 - protein, 10 aa, Artificial Sequence
  Description of Artificial Sequence: Synthetic peptide
  Seed: GACGVGKSAL (KRAS G12C)
GVCGVGKSAF

SEQ ID NO: 8162 - protein, 10 aa, Artificial Sequence
  Description of Artificial Sequence: Synthetic peptide
  Seed: GACGVGKSAL (KRAS G12C)
GVCGVGKSAH

SEQ ID NO: 8163 - protein, 10 aa, Artificial Sequence
  Description of Artificial Sequence: Synthetic peptide
  Seed: GACGVGKSAL (KRAS G12C)
GVCGVGKSAK

SEQ ID NO: 8164 - protein, 10 aa, Artificial Sequence
  Description of Artificial Sequence: Synthetic peptide
  Seed: GACGVGKSAL (KRAS G12C)
GVCGVGKSAL

SEQ ID NO: 8165 - protein, 10 aa, Artificial Sequence
  Description of Artificial Sequence: Synthetic peptide
  Seed: GACGVGKSAL (KRAS G12C)
GVCGVGKSAM

SEQ ID NO: 8166 - protein, 10 aa, Artificial Sequence
  Description of Artificial Sequence: Synthetic peptide
  Seed: GACGVGKSAL (KRAS G12C)
GVCGVGKSAR

SEQ ID NO: 8167 - protein, 10 aa, Artificial Sequence
  Description of Artificial Sequence: Synthetic peptide
  Seed: GACGVGKSAL (KRAS G12C)
GVCGVGKSAY

SEQ ID NO: 8168 - protein, 9 aa, Artificial Sequence
  Description of Artificial Sequence: Synthetic peptide
  Seed: GACGVGKSA (KRAS G12C)
GVCGVGKSF

SEQ ID NO: 8169 - protein, 9 aa, Artificial Sequence
  Description of Artificial Sequence: Synthetic peptide
  Seed: GACGVGKSA (KRAS G12C)
GVCGVGKSH

SEQ ID NO: 8170 - protein, 9 aa, Artificial Sequence
  Description of Artificial Sequence: Synthetic peptide
  Seed: GACGVGKSA (KRAS G12C)
GVCGVGKSI

SEQ ID NO: 8171 - protein, 9 aa, Artificial Sequence
  Description of Artificial Sequence: Synthetic peptide
  Seed: GACGVGKSA (KRAS G12C)
GVCGVGKSK

SEQ ID NO: 8172 - protein, 9 aa, Artificial Sequence
  Description of Artificial Sequence: Synthetic peptide
  Seed: GACGVGKSA (KRAS G12C)
GVCGVGKSL

SEQ ID NO: 8173 - protein, 9 aa, Artificial Sequence
  Description of Artificial Sequence: Synthetic peptide
  Seed: GACGVGKSA (KRAS G12C)
GVCGVGKSM

SEQ ID NO: 8174 - protein, 9 aa, Artificial Sequence
  Description of Artificial Sequence: Synthetic peptide
  Seed: GACGVGKSA (KRAS G12C)
GVCGVGKSR

SEQ ID NO: 8175 - protein, 9 aa, Artificial Sequence
  Description of Artificial Sequence: Synthetic peptide
  Seed: GACGVGKSA (KRAS G12C)
GVCGVGKSV

SEQ ID NO: 8176 - protein, 9 aa, Artificial Sequence
  Description of Artificial Sequence: Synthetic peptide
  Seed: GACGVGKSA (KRAS G12C)
GVCGVGKSW

SEQ ID NO: 8177 - protein, 9 aa, Artificial Sequence
  Description of Artificial Sequence: Synthetic peptide
  Seed: GACGVGKSA (KRAS G12C)
GVCGVGKSY

SEQ ID NO: 8178 - protein, 10 aa, Artificial Sequence
  Description of Artificial Sequence: Synthetic peptide
  Seed: GACGVGKSAL (KRAS G12C)
GYCGVGKSAL

SEQ ID NO: 8179 - protein, 10 aa, Artificial Sequence
  Description of Artificial Sequence: Synthetic peptide
  Seed: GACGVGKSAL (KRAS G12C)
GYCGVGKSAM

SEQ ID NO: 8180 - protein, 9 aa, Artificial Sequence
  Description of Artificial Sequence: Synthetic peptide
  Seed: GACGVGKSA (KRAS G12C)
GYCGVGKSK

SEQ ID NO: 8181 - protein, 9 aa, Artificial Sequence
  Description of Artificial Sequence: Synthetic peptide
  Seed: GACGVGKSA (KRAS G12C)
GYCGVGKSY

SEQ ID NO: 8182 - protein, 10 aa, Artificial Sequence
  Description of Artificial Sequence: Synthetic peptide
  Seed: KLVVVGACGV (KRAS G12C)
KAVVVGACGV

SEQ ID NO: 8183 - protein, 10 aa, Artificial Sequence
  Description of Artificial Sequence: Synthetic peptide
  Seed: KLVVVGACGV (KRAS G12C)
KIVVVGACGA

SEQ ID NO: 8184 - protein, 10 aa, Artificial Sequence
  Description of Artificial Sequence: Synthetic peptide
  Seed: KLVVVGACGV (KRAS G12C)
KIVVVGACGI

SEQ ID NO: 8185 - protein, 10 aa, Artificial Sequence
  Description of Artificial Sequence: Synthetic peptide
  Seed: KLVVVGACGV (KRAS G12C)
KIVVVGACGL

SEQ ID NO: 8186 - protein, 10 aa, Artificial Sequence
  Description of Artificial Sequence: Synthetic peptide
  Seed: KLVVVGACGV (KRAS G12C)
KLVVVGACGM

SEQ ID NO: 8187 - protein, 10 aa, Artificial Sequence
  Description of Artificial Sequence: Synthetic peptide
  Seed: KLVVVGACGV (KRAS G12C)
KMVVVGACGM

SEQ ID NO: 8188 - protein, 10 aa, Artificial Sequence
  Description of Artificial Sequence: Synthetic peptide
  Seed: KLVVVGACGV (KRAS G12C)
KQVVVGACGA

SEQ ID NO: 8189 - protein, 10 aa, Artificial Sequence
  Description of Artificial Sequence: Synthetic peptide
  Seed: KLVVVGACGV (KRAS G12C)
KQVVVGACGF

SEQ ID NO: 8190 - protein, 10 aa, Artificial Sequence
  Description of Artificial Sequence: Synthetic peptide
  Seed: KLVVVGACGV (KRAS G12C)
KQVVVGACGM

SEQ ID NO: 8191 - protein, 10 aa, Artificial Sequence
  Description of Artificial Sequence: Synthetic peptide
  Seed: KLVVVGACGV (KRAS G12C)
KSVVVGACGV

SEQ ID NO: 8192 - protein, 10 aa, Artificial Sequence
  Description of Artificial Sequence: Synthetic peptide
  Seed: KLVVVGACGV (KRAS G12C)
KTVVVGACGI

SEQ ID NO: 8193 - protein, 10 aa, Artificial Sequence
  Description of Artificial Sequence: Synthetic peptide
  Seed: KLVVVGACGV (KRAS G12C)
KTVVVGACGL

SEQ ID NO: 8194 - protein, 10 aa, Artificial Sequence
  Description of Artificial Sequence: Synthetic peptide
  Seed: KLVVVGACGV (KRAS G12C)
KVVVVGACGA

SEQ ID NO: 8195 - protein, 10 aa, Artificial Sequence
  Description of Artificial Sequence: Synthetic peptide
  Seed: KLVVVGACGV (KRAS G12C)
KVVVVGACGI

SEQ ID NO: 8196 - protein, 10 aa, Artificial Sequence
  Description of Artificial Sequence: Synthetic peptide
  Seed: KLVVVGACGV (KRAS G12C)
KVVVVGACGL

SEQ ID NO: 8197 - protein, 9 aa, Artificial Sequence
  Description of Artificial Sequence: Synthetic peptide
  Seed: LVVVGACGV (KRAS G12C)
LAVVGACGI

SEQ ID NO: 8198 - protein, 9 aa, Artificial Sequence
  Description of Artificial Sequence: Synthetic peptide
  Seed: LVVVGACGV (KRAS G12C)
LAVVGACGL

SEQ ID NO: 8199 - protein, 11 aa, Artificial Sequence
  Description of Artificial Sequence: Synthetic peptide
  Seed: LVVVGACGVGK (KRAS G12C)
LAVVGACGVGF

SEQ ID NO: 8200 - protein, 11 aa, Artificial Sequence
  Description of Artificial Sequence: Synthetic peptide
  Seed: LVVVGACGVGK (KRAS G12C)
LAVVGACGVGH

SEQ ID NO: 8201 - protein, 11 aa, Artificial Sequence
  Description of Artificial Sequence: Synthetic peptide
  Seed: LVVVGACGVGK (KRAS G12C)
LAVVGACGVGK

SEQ ID NO: 8202 - protein, 11 aa, Artificial Sequence
  Description of Artificial Sequence: Synthetic peptide
  Seed: LVVVGACGVGK (KRAS G12C)
LAVVGACGVGL

SEQ ID NO: 8203 - protein, 11 aa, Artificial Sequence
  Description of Artificial Sequence: Synthetic peptide
  Seed: LVVVGACGVGK (KRAS G12C)
LAVVGACGVGM

SEQ ID NO: 8204 - protein, 11 aa, Artificial Sequence
  Description of Artificial Sequence: Synthetic peptide
  Seed: LVVVGACGVGK (KRAS G12C)
LAVVGACGVGR

SEQ ID NO: 8205 - protein, 11 aa, Artificial Sequence
  Description of Artificial Sequence: Synthetic peptide
  Seed: LVVVGACGVGK (KRAS G12C)
LAVVGACGVGY

SEQ ID NO: 8206 - protein, 11 aa, Artificial Sequence
  Description of Artificial Sequence: Synthetic peptide
  Seed: LVVVGACGVGK (KRAS G12C)
LCVVGACGVGK

SEQ ID NO: 8207 - protein, 11 aa, Artificial Sequence
  Description of Artificial Sequence: Synthetic peptide
  Seed: LVVVGACGVGK (KRAS G12C)
LCVVGACGVGR

SEQ ID NO: 8208 - protein, 11 aa, Artificial Sequence
  Description of Artificial Sequence: Synthetic peptide
  Seed: LVVVGACGVGK (KRAS G12C)
LDVVGACGVGK

SEQ ID NO: 8209 - protein, 11 aa, Artificial Sequence
  Description of Artificial Sequence: Synthetic peptide
  Seed: LVVVGACGVGK (KRAS G12C)
LDVVGACGVGR

SEQ ID NO: 8210 - protein, 11 aa, Artificial Sequence
  Description of Artificial Sequence: Synthetic peptide
  Seed: LVVVGACGVGK (KRAS G12C)
LEVVGACGVGK

SEQ ID NO: 8211 - protein, 11 aa, Artificial Sequence
  Description of Artificial Sequence: Synthetic peptide
  Seed: LVVVGACGVGK (KRAS G12C)
LEVVGACGVGR

SEQ ID NO: 8212 - protein, 11 aa, Artificial Sequence
  Description of Artificial Sequence: Synthetic peptide
  Seed: LVVVGACGVGK (KRAS G12C)
LFVVGACGVGK

SEQ ID NO: 8213 - protein, 11 aa, Artificial Sequence
  Description of Artificial Sequence: Synthetic peptide
  Seed: LVVVGACGVGK (KRAS G12C)
LFVVGACGVGR

SEQ ID NO: 8214 - protein, 11 aa, Artificial Sequence
  Description of Artificial Sequence: Synthetic peptide
  Seed: LVVVGACGVGK (KRAS G12C)
LGVVGACGVGK

SEQ ID NO: 8215 - protein, 11 aa, Artificial Sequence
  Description of Artificial Sequence: Synthetic peptide
  Seed: LVVVGACGVGK (KRAS G12C)
LGVVGACGVGR

SEQ ID NO: 8216 - protein, 11 aa, Artificial Sequence
  Description of Artificial Sequence: Synthetic peptide
  Seed: LVVVGACGVGK (KRAS G12C)
LHVVGACGVGK

SEQ ID NO: 8217 - protein, 9 aa, Artificial Sequence
  Description of Artificial Sequence: Synthetic peptide
  Seed: LVVVGACGV (KRAS G12C)
LIVVGACGA

SEQ ID NO: 8218 - protein, 9 aa, Artificial Sequence
  Description of Artificial Sequence: Synthetic peptide
  Seed: LVVVGACGV (KRAS G12C)
LIVVGACGL

SEQ ID NO: 8219 - protein, 11 aa, Artificial Sequence
  Description of Artificial Sequence: Synthetic peptide
  Seed: LVVVGACGVGK (KRAS G12C)
LIVVGACGVGK

SEQ ID NO: 8220 - protein, 11 aa, Artificial Sequence
  Description of Artificial Sequence: Synthetic peptide
  Seed: LVVVGACGVGK (KRAS G12C)
LIVVGACGVGR

SEQ ID NO: 8221 - protein, 11 aa, Artificial Sequence
  Description of Artificial Sequence: Synthetic peptide
  Seed: LVVVGACGVGK (KRAS G12C)
LIVVGACGVGY

SEQ ID NO: 8222 - protein, 9 aa, Artificial Sequence
  Description of Artificial Sequence: Synthetic peptide
  Seed: LVVVGACGV (KRAS G12C)
LLVVGACGT

SEQ ID NO: 8223 - protein, 11 aa, Artificial Sequence
  Description of Artificial Sequence: Synthetic peptide
  Seed: LVVVGACGVGK (KRAS G12C)
LLVVGACGVGK

SEQ ID NO: 8224 - protein, 11 aa, Artificial Sequence
  Description of Artificial Sequence: Synthetic peptide
  Seed: LVVVGACGVGK (KRAS G12C)
LLVVGACGVGR

SEQ ID NO: 8225 - protein, 9 aa, Artificial Sequence
  Description of Artificial Sequence: Synthetic peptide
  Seed: LVVVGACGV (KRAS G12C)
LMVVGACGT

SEQ ID NO: 8226 - protein, 11 aa, Artificial Sequence
  Description of Artificial Sequence: Synthetic peptide
  Seed: LVVVGACGVGK (KRAS G12C)
LMVVGACGVGK

SEQ ID NO: 8227 - protein, 11 aa, Artificial Sequence
  Description of Artificial Sequence: Synthetic peptide
  Seed: LVVVGACGVGK (KRAS G12C)
LMVVGACGVGR

SEQ ID NO: 8228 - protein, 11 aa, Artificial Sequence
  Description of Artificial Sequence: Synthetic peptide
  Seed: LVVVGACGVGK (KRAS G12C)
LNVVGACGVGK

SEQ ID NO: 8229 - protein, 11 aa, Artificial Sequence
  Description of Artificial Sequence: Synthetic peptide
  Seed: LVVVGACGVGK (KRAS G12C)
LNVVGACGVGR

SEQ ID NO: 8230 - protein, 11 aa, Artificial Sequence
  Description of Artificial Sequence: Synthetic peptide
  Seed: LVVVGACGVGK (KRAS G12C)
LPVVGACGVGK

SEQ ID NO: 8231 - protein, 11 aa, Artificial Sequence
  Description of Artificial Sequence: Synthetic peptide
  Seed: LVVVGACGVGK (KRAS G12C)
LPVVGACGVGR

SEQ ID NO: 8232 - protein, 11 aa, Artificial Sequence
  Description of Artificial Sequence: Synthetic peptide
  Seed: LVVVGACGVGK (KRAS G12C)
LQVVGACGVGK

SEQ ID NO: 8233 - protein, 11 aa, Artificial Sequence
  Description of Artificial Sequence: Synthetic peptide
  Seed: LVVVGACGVGK (KRAS G12C)
LQVVGACGVGR

SEQ ID NO: 8234 - protein, 9 aa, Artificial Sequence
  Description of Artificial Sequence: Synthetic peptide
  Seed: LVVVGACGV (KRAS G12C)
LSVVGACGI

SEQ ID NO: 8235 - protein, 9 aa, Artificial Sequence
  Description of Artificial Sequence: Synthetic peptide
  Seed: LVVVGACGV (KRAS G12C)
LSVVGACGL

SEQ ID NO: 8236 - protein, 11 aa, Artificial Sequence
  Description of Artificial Sequence: Synthetic peptide
  Seed: LVVVGACGVGK (KRAS G12C)
LSVVGACGVGF

SEQ ID NO: 8237 - protein, 11 aa, Artificial Sequence
  Description of Artificial Sequence: Synthetic peptide
  Seed: LVVVGACGVGK (KRAS G12C)
LSVVGACGVGK

SEQ ID NO: 8238 - protein, 11 aa, Artificial Sequence
  Description of Artificial Sequence: Synthetic peptide
  Seed: LVVVGACGVGK (KRAS G12C)
LSVVGACGVGL

SEQ ID NO: 8239 - protein, 11 aa, Artificial Sequence
  Description of Artificial Sequence: Synthetic peptide
  Seed: LVVVGACGVGK (KRAS G12C)
LSVVGACGVGR

SEQ ID NO: 8240 - protein, 11 aa, Artificial Sequence
  Description of Artificial Sequence: Synthetic peptide
  Seed: LVVVGACGVGK (KRAS G12C)
LSVVGACGVGY

SEQ ID NO: 8241 - protein, 11 aa, Artificial Sequence
  Description of Artificial Sequence: Synthetic peptide
  Seed: LVVVGACGVGK (KRAS G12C)
LTVVGACGVGF

SEQ ID NO: 8242 - protein, 11 aa, Artificial Sequence
  Description of Artificial Sequence: Synthetic peptide
  Seed: LVVVGACGVGK (KRAS G12C)
LTVVGACGVGK

SEQ ID NO: 8243 - protein, 11 aa, Artificial Sequence
  Description of Artificial Sequence: Synthetic peptide
  Seed: LVVVGACGVGK (KRAS G12C)
LTVVGACGVGR

SEQ ID NO: 8244 - protein, 11 aa, Artificial Sequence
  Description of Artificial Sequence: Synthetic peptide
  Seed: LVVVGACGVGK (KRAS G12C)
LTVVGACGVGY

SEQ ID NO: 8245 - protein, 9 aa, Artificial Sequence
  Description of Artificial Sequence: Synthetic peptide
  Seed: LVVVGACGV (KRAS G12C)
LVVVGACGA

SEQ ID NO: 8246 - protein, 11 aa, Artificial Sequence
  Description of Artificial Sequence: Synthetic peptide
  Seed: LVVVGACGVGK (KRAS G12C)
LVVVGACGVGR

SEQ ID NO: 8247 - protein, 11 aa, Artificial Sequence
  Description of Artificial Sequence: Synthetic peptide
  Seed: LVVVGACGVGK (KRAS G12C)
LVVVGACGVGY

SEQ ID NO: 8248 - protein, 11 aa, Artificial Sequence
  Description of Artificial Sequence: Synthetic peptide
  Seed: LVVVGACGVGK (KRAS G12C)
LWVVGACGVGK

SEQ ID NO: 8249 - protein, 11 aa, Artificial Sequence
  Description of Artificial Sequence: Synthetic peptide
  Seed: LVVVGACGVGK (KRAS G12C)
LYVVGACGVGK

SEQ ID NO: 8250 - protein, 8 aa, Artificial Sequence
  Description of Artificial Sequence: Synthetic peptide
  Seed: VGACGVGK (KRAS G12C)
VAACGVGF

SEQ ID NO: 8251 - protein, 8 aa, Artificial Sequence
  Description of Artificial Sequence: Synthetic peptide
  Seed: VGACGVGK (KRAS G12C)
VAACGVGI

SEQ ID NO: 8252 - protein, 8 aa, Artificial Sequence
  Description of Artificial Sequence: Synthetic peptide
  Seed: VGACGVGK (KRAS G12C)
VAACGVGK

SEQ ID NO: 8253 - protein, 11 aa, Artificial Sequence
  Description of Artificial Sequence: Synthetic peptide
  Seed: VGACGVGKSAL (KRAS G12C)
VAACGVGKSAF

SEQ ID NO: 8254 - protein, 11 aa, Artificial Sequence
  Description of Artificial Sequence: Synthetic peptide
  Seed: VGACGVGKSAL (KRAS G12C)
VAACGVGKSAL

SEQ ID NO: 8255 - protein, 11 aa, Artificial Sequence
  Description of Artificial Sequence: Synthetic peptide
  Seed: VGACGVGKSAL (KRAS G12C)
VAACGVGKSAM

SEQ ID NO: 8256 - protein, 8 aa, Artificial Sequence
  Description of Artificial Sequence: Synthetic peptide
  Seed: VGACGVGK (KRAS G12C)
VAACGVGL

SEQ ID NO: 8257 - protein, 8 aa, Artificial Sequence
  Description of Artificial Sequence: Synthetic peptide
  Seed: VGACGVGK (KRAS G12C)
VAACGVGM

SEQ ID NO: 8258 - protein, 8 aa, Artificial Sequence
  Description of Artificial Sequence: Synthetic peptide
  Seed: VGACGVGK (KRAS G12C)
VAACGVGR

SEQ ID NO: 8259 - protein, 8 aa, Artificial Sequence
  Description of Artificial Sequence: Synthetic peptide
  Seed: VGACGVGK (KRAS G12C)
VAACGVGY

SEQ ID NO: 8260 - protein, 9 aa, Artificial Sequence
  Description of Artificial Sequence: Synthetic peptide
  Seed: VVGACGVGK (KRAS G12C)
VAGACGVGF

SEQ ID NO: 8261 - protein, 9 aa, Artificial Sequence
  Description of Artificial Sequence: Synthetic peptide
  Seed: VVGACGVGK (KRAS G12C)
VAGACGVGH

SEQ ID NO: 8262 - protein, 9 aa, Artificial Sequence
  Description of Artificial Sequence: Synthetic peptide
  Seed: VVGACGVGK (KRAS G12C)
VAGACGVGI

SEQ ID NO: 8263 - protein, 9 aa, Artificial Sequence
  Description of Artificial Sequence: Synthetic peptide
  Seed: VVGACGVGK (KRAS G12C)
VAGACGVGL

SEQ ID NO: 8264 - protein, 9 aa, Artificial Sequence
  Description of Artificial Sequence: Synthetic peptide
  Seed: VVGACGVGK (KRAS G12C)
VAGACGVGM

SEQ ID NO: 8265 - protein, 9 aa, Artificial Sequence
  Description of Artificial Sequence: Synthetic peptide
  Seed: VVGACGVGK (KRAS G12C)
VAGACGVGV

SEQ ID NO: 8266 - protein, 9 aa, Artificial Sequence
  Description of Artificial Sequence: Synthetic peptide
  Seed: VVGACGVGK (KRAS G12C)
VAGACGVGW

SEQ ID NO: 8267 - protein, 9 aa, Artificial Sequence
  Description of Artificial Sequence: Synthetic peptide
  Seed: VVGACGVGK (KRAS G12C)
VAGACGVGY

SEQ ID NO: 8268 - protein, 10 aa, Artificial Sequence
  Description of Artificial Sequence: Synthetic peptide
  Seed: VVVGACGVGK (KRAS G12C)
VAVGACGVGA

SEQ ID NO: 8269 - protein, 10 aa, Artificial Sequence
  Description of Artificial Sequence: Synthetic peptide
  Seed: VVVGACGVGK (KRAS G12C)
VAVGACGVGF

SEQ ID NO: 8270 - protein, 10 aa, Artificial Sequence
  Description of Artificial Sequence: Synthetic peptide
  Seed: VVVGACGVGK (KRAS G12C)
VAVGACGVGH

SEQ ID NO: 8271 - protein, 10 aa, Artificial Sequence
  Description of Artificial Sequence: Synthetic peptide
  Seed: VVVGACGVGK (KRAS G12C)
VAVGACGVGI

SEQ ID NO: 8272 - protein, 10 aa, Artificial Sequence
  Description of Artificial Sequence: Synthetic peptide
  Seed: VVVGACGVGK (KRAS G12C)
VAVGACGVGL

SEQ ID NO: 8273 - protein, 10 aa, Artificial Sequence
  Description of Artificial Sequence: Synthetic peptide
  Seed: VVVGACGVGK (KRAS G12C)
VAVGACGVGM

SEQ ID NO: 8274 - protein, 10 aa, Artificial Sequence
  Description of Artificial Sequence: Synthetic peptide
  Seed: VVVGACGVGK (KRAS G12C)
VAVGACGVGQ

SEQ ID NO: 8275 - protein, 10 aa, Artificial Sequence
  Description of Artificial Sequence: Synthetic peptide
  Seed: VVVGACGVGK (KRAS G12C)
VAVGACGVGV

SEQ ID NO: 8276 - protein, 10 aa, Artificial Sequence
  Description of Artificial Sequence: Synthetic peptide
  Seed: VVVGACGVGK (KRAS G12C)
VAVGACGVGW

SEQ ID NO: 8277 - protein, 10 aa, Artificial Sequence
  Description of Artificial Sequence: Synthetic peptide
  Seed: VVVGACGVGK (KRAS G12C)
VAVGACGVGY

SEQ ID NO: 8278 - protein, 9 aa, Artificial Sequence
  Description of Artificial Sequence: Synthetic peptide
  Seed: VVGACGVGK (KRAS G12C)
VCGACGVGK

SEQ ID NO: 8279 - protein, 9 aa, Artificial Sequence
  Description of Artificial Sequence: Synthetic peptide
  Seed: VVGACGVGK (KRAS G12C)
VCGACGVGR

SEQ ID NO: 8280 - protein, 9 aa, Artificial Sequence
  Description of Artificial Sequence: Synthetic peptide
  Seed: VVGACGVGK (KRAS G12C)
VCGACGVGY

SEQ ID NO: 8281 - protein, 10 aa, Artificial Sequence
  Description of Artificial Sequence: Synthetic peptide
  Seed: VVVGACGVGK (KRAS G12C)
VCVGACGVGR

SEQ ID NO: 8282 - protein, 10 aa, Artificial Sequence
  Description of Artificial Sequence: Synthetic peptide
  Seed: VVVGACGVGK (KRAS G12C)
VCVGACGVGY

SEQ ID NO: 8283 - protein, 8 aa, Artificial Sequence
  Description of Artificial Sequence: Synthetic peptide
  Seed: VGACGVGK (KRAS G12C)
VDACGVGK

SEQ ID NO: 8284 - protein, 9 aa, Artificial Sequence
  Description of Artificial Sequence: Synthetic peptide
  Seed: VVGACGVGK (KRAS G12C)
VDGACGVGK

SEQ ID NO: 8285 - protein, 9 aa, Artificial Sequence
  Description of Artificial Sequence: Synthetic peptide
  Seed: VVGACGVGK (KRAS G12C)
VDGACGVGR

SEQ ID NO: 8286 - protein, 9 aa, Artificial Sequence
  Description of Artificial Sequence: Synthetic peptide
  Seed: VVGACGVGK (KRAS G12C)
VDGACGVGY

SEQ ID NO: 8287 - protein, 10 aa, Artificial Sequence
  Description of Artificial Sequence: Synthetic peptide
  Seed: VVVGACGVGK (KRAS G12C)
VDVGACGVGR

SEQ ID NO: 8288 - protein, 10 aa, Artificial Sequence
  Description of Artificial Sequence: Synthetic peptide
  Seed: VVVGACGVGK (KRAS G12C)
VDVGACGVGY

SEQ ID NO: 8289 - protein, 9 aa, Artificial Sequence
  Description of Artificial Sequence: Synthetic peptide
  Seed: VVGACGVGK (KRAS G12C)
VEGACGVGK

SEQ ID NO: 8290 - protein, 9 aa, Artificial Sequence
  Description of Artificial Sequence: Synthetic peptide
  Seed: VVGACGVGK (KRAS G12C)
VEGACGVGR

SEQ ID NO: 8291 - protein, 10 aa, Artificial Sequence
  Description of Artificial Sequence: Synthetic peptide
  Seed: VVVGACGVGK (KRAS G12C)
VEVGACGVGF

SEQ ID NO: 8292 - protein, 10 aa, Artificial Sequence
  Description of Artificial Sequence: Synthetic peptide
  Seed: VVVGACGVGK (KRAS G12C)
VEVGACGVGR

SEQ ID NO: 8293 - protein, 10 aa, Artificial Sequence
  Description of Artificial Sequence: Synthetic peptide
  Seed: VVVGACGVGK (KRAS G12C)
VEVGACGVGY

SEQ ID NO: 8294 - protein, 8 aa, Artificial Sequence
  Description of Artificial Sequence: Synthetic peptide
  Seed: VGACGVGK (KRAS G12C)
VFACGVGK

SEQ ID NO: 8295 - protein, 10 aa, Artificial Sequence
  Description of Artificial Sequence: Synthetic peptide
  Seed: VVVGACGVGK (KRAS G12C)
VFVGACGVGF

SEQ ID NO: 8296 - protein, 10 aa, Artificial Sequence
  Description of Artificial Sequence: Synthetic peptide
  Seed: VVVGACGVGK (KRAS G12C)
VFVGACGVGR

SEQ ID NO: 8297 - protein, 10 aa, Artificial Sequence
  Description of Artificial Sequence: Synthetic peptide
  Seed: VVVGACGVGK (KRAS G12C)
VFVGACGVGY

SEQ ID NO: 8298 - protein, 11 aa, Artificial Sequence
  Description of Artificial Sequence: Synthetic peptide
  Seed: VGACGVGKSAL (KRAS G12C)
VGACGVGKSAF

SEQ ID NO: 8299 - protein, 11 aa, Artificial Sequence
  Description of Artificial Sequence: Synthetic peptide
  Seed: VGACGVGKSAL (KRAS G12C)
VGACGVGKSAK

SEQ ID NO: 8300 - protein, 8 aa, Artificial Sequence
  Description of Artificial Sequence: Synthetic peptide
  Seed: VGACGVGK (KRAS G12C)
VGACGVGR

SEQ ID NO: 8301 - protein, 9 aa, Artificial Sequence
  Description of Artificial Sequence: Synthetic peptide
  Seed: VVGACGVGK (KRAS G12C)
VGGACGVGF

SEQ ID NO: 8302 - protein, 9 aa, Artificial Sequence
  Description of Artificial Sequence: Synthetic peptide
  Seed: VVGACGVGK (KRAS G12C)
VGGACGVGK

SEQ ID NO: 8303 - protein, 9 aa, Artificial Sequence
  Description of Artificial Sequence: Synthetic peptide
  Seed: VVGACGVGK (KRAS G12C)
VGGACGVGM

SEQ ID NO: 8304 - protein, 9 aa, Artificial Sequence
  Description of Artificial Sequence: Synthetic peptide
  Seed: VVGACGVGK (KRAS G12C)
VGGACGVGY

SEQ ID NO: 8305 - protein, 10 aa, Artificial Sequence
  Description of Artificial Sequence: Synthetic peptide
  Seed: VVVGACGVGK (KRAS G12C)
VGVGACGVGF

SEQ ID NO: 8306 - protein, 10 aa, Artificial Sequence
  Description of Artificial Sequence: Synthetic peptide
  Seed: VVVGACGVGK (KRAS G12C)
VGVGACGVGH

SEQ ID NO: 8307 - protein, 10 aa, Artificial Sequence
  Description of Artificial Sequence: Synthetic peptide
  Seed: VVVGACGVGK (KRAS G12C)
VGVGACGVGL

SEQ ID NO: 8308 - protein, 10 aa, Artificial Sequence
  Description of Artificial Sequence: Synthetic peptide
  Seed: VVVGACGVGK (KRAS G12C)
VGVGACGVGM

SEQ ID NO: 8309 - protein, 10 aa, Artificial Sequence
  Description of Artificial Sequence: Synthetic peptide
  Seed: VVVGACGVGK (KRAS G12C)
VGVGACGVGQ

SEQ ID NO: 8310 - protein, 10 aa, Artificial Sequence
  Description of Artificial Sequence: Synthetic peptide
  Seed: VVVGACGVGK (KRAS G12C)
VGVGACGVGR

SEQ ID NO: 8311 - protein, 10 aa, Artificial Sequence
  Description of Artificial Sequence: Synthetic peptide
  Seed: VVVGACGVGK (KRAS G12C)
VGVGACGVGY

SEQ ID NO: 8312 - protein, 9 aa, Artificial Sequence
  Description of Artificial Sequence: Synthetic peptide
  Seed: VVGACGVGK (KRAS G12C)
VHGACGVGK

SEQ ID NO: 8313 - protein, 10 aa, Artificial Sequence
  Description of Artificial Sequence: Synthetic peptide
  Seed: VVVGACGVGK (KRAS G12C)
VHVGACGVGR

SEQ ID NO: 8314 - protein, 8 aa, Artificial Sequence
  Description of Artificial Sequence: Synthetic peptide
  Seed: VGACGVGK (KRAS G12C)
VIACGVGK

SEQ ID NO: 8315 - protein, 11 aa, Artificial Sequence
  Description of Artificial Sequence: Synthetic peptide
  Seed: VGACGVGKSAL (KRAS G12C)
VIACGVGKSAL

SEQ ID NO: 8316 - protein, 8 aa, Artificial Sequence
  Description of Artificial Sequence: Synthetic peptide
  Seed: VGACGVGK (KRAS G12C)
VIACGVGR

SEQ ID NO: 8317 - protein, 9 aa, Artificial Sequence
  Description of Artificial Sequence: Synthetic peptide
  Seed: VVGACGVGK (KRAS G12C)
VIGACGVGF

SEQ ID NO: 8318 - protein, 9 aa, Artificial Sequence
  Description of Artificial Sequence: Synthetic peptide
  Seed: VVGACGVGK (KRAS G12C)
VIGACGVGL

SEQ ID NO: 8319 - protein, 9 aa, Artificial Sequence
  Description of Artificial Sequence: Synthetic peptide
  Seed: VVGACGVGK (KRAS G12C)
VIGACGVGM

SEQ ID NO: 8320 - protein, 9 aa, Artificial Sequence
  Description of Artificial Sequence: Synthetic peptide
  Seed: VVGACGVGK (KRAS G12C)
VIGACGVGY

SEQ ID NO: 8321 - protein, 10 aa, Artificial Sequence
  Description of Artificial Sequence: Synthetic peptide
  Seed: VVVGACGVGK (KRAS G12C)
VIVGACGVGF

SEQ ID NO: 8322 - protein, 10 aa, Artificial Sequence
  Description of Artificial Sequence: Synthetic peptide
  Seed: VVVGACGVGK (KRAS G12C)
VIVGACGVGH

SEQ ID NO: 8323 - protein, 10 aa, Artificial Sequence
  Description of Artificial Sequence: Synthetic peptide
  Seed: VVVGACGVGK (KRAS G12C)
VIVGACGVGL

SEQ ID NO: 8324 - protein, 10 aa, Artificial Sequence
  Description of Artificial Sequence: Synthetic peptide
  Seed: VVVGACGVGK (KRAS G12C)
VIVGACGVGM

SEQ ID NO: 8325 - protein, 10 aa, Artificial Sequence
  Description of Artificial Sequence: Synthetic peptide
  Seed: VVVGACGVGK (KRAS G12C)
VIVGACGVGQ

SEQ ID NO: 8326 - protein, 10 aa, Artificial Sequence
  Description of Artificial Sequence: Synthetic peptide
  Seed: VVVGACGVGK (KRAS G12C)
VIVGACGVGY

SEQ ID NO: 8327 - protein, 10 aa, Artificial Sequence
  Description of Artificial Sequence: Synthetic peptide
  Seed: VVVGACGVGK (KRAS G12C)
VKVGACGVGR

SEQ ID NO: 8328 - protein, 8 aa, Artificial Sequence
  Description of Artificial Sequence: Synthetic peptide
  Seed: VGACGVGK (KRAS G12C)
VLACGVGK

SEQ ID NO: 8329 - protein, 8 aa, Artificial Sequence
  Description of Artificial Sequence: Synthetic peptide
  Seed: VGACGVGK (KRAS G12C)
VLACGVGR

SEQ ID NO: 8330 - protein, 9 aa, Artificial Sequence
  Description of Artificial Sequence: Synthetic peptide
  Seed: VVGACGVGK (KRAS G12C)
VLGACGVGY

SEQ ID NO: 8331 - protein, 10 aa, Artificial Sequence
  Description of Artificial Sequence: Synthetic peptide
  Seed: VVVGACGVGK (KRAS G12C)
VLVGACGVGF

SEQ ID NO: 8332 - protein, 10 aa, Artificial Sequence
  Description of Artificial Sequence: Synthetic peptide
  Seed: VVVGACGVGK (KRAS G12C)
VLVGACGVGL

SEQ ID NO: 8333 - protein, 10 aa, Artificial Sequence
  Description of Artificial Sequence: Synthetic peptide
  Seed: VVVGACGVGK (KRAS G12C)
VLVGACGVGM

SEQ ID NO: 8334 - protein, 10 aa, Artificial Sequence
  Description of Artificial Sequence: Synthetic peptide
  Seed: VVVGACGVGK (KRAS G12C)
VLVGACGVGY

SEQ ID NO: 8335 - protein, 8 aa, Artificial Sequence
  Description of Artificial Sequence: Synthetic peptide
  Seed: VGACGVGK (KRAS G12C)
VMACGVGK

SEQ ID NO: 8336 - protein, 9 aa, Artificial Sequence
  Description of Artificial Sequence: Synthetic peptide
  Seed: VVGACGVGK (KRAS G12C)
VMGACGVGF

SEQ ID NO: 8337 - protein, 9 aa, Artificial Sequence
  Description of Artificial Sequence: Synthetic peptide
  Seed: VVGACGVGK (KRAS G12C)
VMGACGVGY

SEQ ID NO: 8338 - protein, 10 aa, Artificial Sequence
  Description of Artificial Sequence: Synthetic peptide
  Seed: VVVGACGVGK (KRAS G12C)
VMVGACGVGF

SEQ ID NO: 8339 - protein, 10 aa, Artificial Sequence
  Description of Artificial Sequence: Synthetic peptide
  Seed: VVVGACGVGK (KRAS G12C)
VMVGACGVGH

SEQ ID NO: 8340 - protein, 10 aa, Artificial Sequence
  Description of Artificial Sequence: Synthetic peptide
  Seed: VVVGACGVGK (KRAS G12C)
VMVGACGVGL

SEQ ID NO: 8341 - protein, 10 aa, Artificial Sequence
  Description of Artificial Sequence: Synthetic peptide
  Seed: VVVGACGVGK (KRAS G12C)
VMVGACGVGM

SEQ ID NO: 8342 - protein, 10 aa, Artificial Sequence
  Description of Artificial Sequence: Synthetic peptide
  Seed: VVVGACGVGK (KRAS G12C)
VMVGACGVGY

SEQ ID NO: 8343 - protein, 8 aa, Artificial Sequence
  Description of Artificial Sequence: Synthetic peptide
  Seed: VGACGVGK (KRAS G12C)
VNACGVGK

SEQ ID NO: 8344 - protein, 8 aa, Artificial Sequence
  Description of Artificial Sequence: Synthetic peptide
  Seed: VGACGVGK (KRAS G12C)
VNACGVGR

SEQ ID NO: 8345 - protein, 9 aa, Artificial Sequence
  Description of Artificial Sequence: Synthetic peptide
  Seed: VVGACGVGK (KRAS G12C)
VNGACGVGK

SEQ ID NO: 8346 - protein, 9 aa, Artificial Sequence
  Description of Artificial Sequence: Synthetic peptide
  Seed: VVGACGVGK (KRAS G12C)
VNGACGVGR

SEQ ID NO: 8347 - protein, 9 aa, Artificial Sequence
  Description of Artificial Sequence: Synthetic peptide
  Seed: VVGACGVGK (KRAS G12C)
VNGACGVGY

SEQ ID NO: 8348 - protein, 10 aa, Artificial Sequence
  Description of Artificial Sequence: Synthetic peptide
  Seed: VVVGACGVGK (KRAS G12C)
VNVGACGVGF

SEQ ID NO: 8349 - protein, 10 aa, Artificial Sequence
  Description of Artificial Sequence: Synthetic peptide
  Seed: VVVGACGVGK (KRAS G12C)
VNVGACGVGR

SEQ ID NO: 8350 - protein, 10 aa, Artificial Sequence
  Description of Artificial Sequence: Synthetic peptide
  Seed: VVVGACGVGK (KRAS G12C)
VNVGACGVGY

SEQ ID NO: 8351 - protein, 9 aa, Artificial Sequence
  Description of Artificial Sequence: Synthetic peptide
  Seed: VVGACGVGK (KRAS G12C)
VPGACGVGK

SEQ ID NO: 8352 - protein, 9 aa, Artificial Sequence
  Description of Artificial Sequence: Synthetic peptide
  Seed: VVGACGVGK (KRAS G12C)
VPGACGVGR

SEQ ID NO: 8353 - protein, 10 aa, Artificial Sequence
  Description of Artificial Sequence: Synthetic peptide
  Seed: VVVGACGVGK (KRAS G12C)
VPVGACGVGY

SEQ ID NO: 8354 - protein, 8 aa, Artificial Sequence
  Description of Artificial Sequence: Synthetic peptide
  Seed: VGACGVGK (KRAS G12C)
VQACGVGK

SEQ ID NO: 8355 - protein, 8 aa, Artificial Sequence
  Description of Artificial Sequence: Synthetic peptide
  Seed: VGACGVGK (KRAS G12C)
VQACGVGR

SEQ ID NO: 8356 - protein, 9 aa, Artificial Sequence
  Description of Artificial Sequence: Synthetic peptide
  Seed: VVGACGVGK (KRAS G12C)
VQGACGVGF

SEQ ID NO: 8357 - protein, 9 aa, Artificial Sequence
  Description of Artificial Sequence: Synthetic peptide
  Seed: VVGACGVGK (KRAS G12C)
VQGACGVGY

SEQ ID NO: 8358 - protein, 10 aa, Artificial Sequence
  Description of Artificial Sequence: Synthetic peptide
  Seed: VVVGACGVGK (KRAS G12C)
VQVGACGVGF

SEQ ID NO: 8359 - protein, 10 aa, Artificial Sequence
  Description of Artificial Sequence: Synthetic peptide
  Seed: VVVGACGVGK (KRAS G12C)
VQVGACGVGH

SEQ ID NO: 8360 - protein, 10 aa, Artificial Sequence
  Description of Artificial Sequence: Synthetic peptide
  Seed: VVVGACGVGK (KRAS G12C)
VQVGACGVGM

SEQ ID NO: 8361 - protein, 10 aa, Artificial Sequence
  Description of Artificial Sequence: Synthetic peptide
  Seed: VVVGACGVGK (KRAS G12C)
VQVGACGVGR

SEQ ID NO: 8362 - protein, 10 aa, Artificial Sequence
  Description of Artificial Sequence: Synthetic peptide
  Seed: VVVGACGVGK (KRAS G12C)
VQVGACGVGY

SEQ ID NO: 8363 - protein, 11 aa, Artificial Sequence
  Description of Artificial Sequence: Synthetic peptide
  Seed: VGACGVGKSAL (KRAS G12C)
VRACGVGKSAF

SEQ ID NO: 8364 - protein, 11 aa, Artificial Sequence
  Description of Artificial Sequence: Synthetic peptide
  Seed: VGACGVGKSAL (KRAS G12C)
VRACGVGKSAK

SEQ ID NO: 8365 - protein, 11 aa, Artificial Sequence
  Description of Artificial Sequence: Synthetic peptide
  Seed: VGACGVGKSAL (KRAS G12C)
VRACGVGKSAL

SEQ ID NO: 8366 - protein, 11 aa, Artificial Sequence
  Description of Artificial Sequence: Synthetic peptide
  Seed: VGACGVGKSAL (KRAS G12C)
VRACGVGKSAM

SEQ ID NO: 8367 - protein, 11 aa, Artificial Sequence
  Description of Artificial Sequence: Synthetic peptide
  Seed: VGACGVGKSAL (KRAS G12C)
VRACGVGKSAR

SEQ ID NO: 8368 - protein, 11 aa, Artificial Sequence
  Description of Artificial Sequence: Synthetic peptide
  Seed: VGACGVGKSAL (KRAS G12C)
VRACGVGKSAY

SEQ ID NO: 8369 - protein, 10 aa, Artificial Sequence
  Description of Artificial Sequence: Synthetic peptide
  Seed: VVVGACGVGK (KRAS G12C)
VRVGACGVGF

SEQ ID NO: 8370 - protein, 10 aa, Artificial Sequence
  Description of Artificial Sequence: Synthetic peptide
  Seed: VVVGACGVGK (KRAS G12C)
VRVGACGVGL

SEQ ID NO: 8371 - protein, 10 aa, Artificial Sequence
  Description of Artificial Sequence: Synthetic peptide
  Seed: VVVGACGVGK (KRAS G12C)
VRVGACGVGM

SEQ ID NO: 8372 - protein, 10 aa, Artificial Sequence
  Description of Artificial Sequence: Synthetic peptide
  Seed: VVVGACGVGK (KRAS G12C)
VRVGACGVGY

SEQ ID NO: 8373 - protein, 8 aa, Artificial Sequence
  Description of Artificial Sequence: Synthetic peptide
  Seed: VGACGVGK (KRAS G12C)
VSACGVGF

SEQ ID NO: 8374 - protein, 8 aa, Artificial Sequence
  Description of Artificial Sequence: Synthetic peptide
  Seed: VGACGVGK (KRAS G12C)
VSACGVGK

SEQ ID NO: 8375 - protein, 11 aa, Artificial Sequence
  Description of Artificial Sequence: Synthetic peptide
  Seed: VGACGVGKSAL (KRAS G12C)
VSACGVGKSAL

SEQ ID NO: 8376 - protein, 8 aa, Artificial Sequence
  Description of Artificial Sequence: Synthetic peptide
  Seed: VGACGVGK (KRAS G12C)
VSACGVGL

SEQ ID NO: 8377 - protein, 8 aa, Artificial Sequence
  Description of Artificial Sequence: Synthetic peptide
  Seed: VGACGVGK (KRAS G12C)
VSACGVGR

SEQ ID NO: 8378 - protein, 8 aa, Artificial Sequence
  Description of Artificial Sequence: Synthetic peptide
  Seed: VGACGVGK (KRAS G12C)
VSACGVGY

SEQ ID NO: 8379 - protein, 9 aa, Artificial Sequence
  Description of Artificial Sequence: Synthetic peptide
  Seed: VVGACGVGK (KRAS G12C)
VSGACGVGF

SEQ ID NO: 8380 - protein, 9 aa, Artificial Sequence
  Description of Artificial Sequence: Synthetic peptide
  Seed: VVGACGVGK (KRAS G12C)
VSGACGVGH

SEQ ID NO: 8381 - protein, 9 aa, Artificial Sequence
  Description of Artificial Sequence: Synthetic peptide
  Seed: VVGACGVGK (KRAS G12C)
VSGACGVGL

SEQ ID NO: 8382 - protein, 9 aa, Artificial Sequence
  Description of Artificial Sequence: Synthetic peptide
  Seed: VVGACGVGK (KRAS G12C)
VSGACGVGM

SEQ ID NO: 8383 - protein, 9 aa, Artificial Sequence
  Description of Artificial Sequence: Synthetic peptide
  Seed: VVGACGVGK (KRAS G12C)
VSGACGVGY

SEQ ID NO: 8384 - protein, 10 aa, Artificial Sequence
  Description of Artificial Sequence: Synthetic peptide
  Seed: VVVGACGVGK (KRAS G12C)
VSVGACGVGF

SEQ ID NO: 8385 - protein, 10 aa, Artificial Sequence
  Description of Artificial Sequence: Synthetic peptide
  Seed: VVVGACGVGK (KRAS G12C)
VSVGACGVGH

SEQ ID NO: 8386 - protein, 10 aa, Artificial Sequence
  Description of Artificial Sequence: Synthetic peptide
  Seed: VVVGACGVGK (KRAS G12C)
VSVGACGVGL

SEQ ID NO: 8387 - protein, 10 aa, Artificial Sequence
  Description of Artificial Sequence: Synthetic peptide
  Seed: VVVGACGVGK (KRAS G12C)
VSVGACGVGM

SEQ ID NO: 8388 - protein, 10 aa, Artificial Sequence
  Description of Artificial Sequence: Synthetic peptide
  Seed: VVVGACGVGK (KRAS G12C)
VSVGACGVGW

SEQ ID NO: 8389 - protein, 10 aa, Artificial Sequence
  Description of Artificial Sequence: Synthetic peptide
  Seed: VVVGACGVGK (KRAS G12C)
VSVGACGVGY

SEQ ID NO: 8390 - protein, 8 aa, Artificial Sequence
  Description of Artificial Sequence: Synthetic peptide
  Seed: VGACGVGK (KRAS G12C)
VTACGVGK

SEQ ID NO: 8391 - protein, 11 aa, Artificial Sequence
  Description of Artificial Sequence: Synthetic peptide
  Seed: VGACGVGKSAL (KRAS G12C)
VTACGVGKSAL

SEQ ID NO: 8392 - protein, 8 aa, Artificial Sequence
  Description of Artificial Sequence: Synthetic peptide
  Seed: VGACGVGK (KRAS G12C)
VTACGVGL

SEQ ID NO: 8393 - protein, 8 aa, Artificial Sequence
  Description of Artificial Sequence: Synthetic peptide
  Seed: VGACGVGK (KRAS G12C)
VTACGVGR

SEQ ID NO: 8394 - protein, 9 aa, Artificial Sequence
  Description of Artificial Sequence: Synthetic peptide
  Seed: VVGACGVGK (KRAS G12C)
VTGACGVGF

SEQ ID NO: 8395 - protein, 9 aa, Artificial Sequence
  Description of Artificial Sequence: Synthetic peptide
  Seed: VVGACGVGK (KRAS G12C)
VTGACGVGH

SEQ ID NO: 8396 - protein, 9 aa, Artificial Sequence
  Description of Artificial Sequence: Synthetic peptide
  Seed: VVGACGVGK (KRAS G12C)
VTGACGVGL

SEQ ID NO: 8397 - protein, 9 aa, Artificial Sequence
  Description of Artificial Sequence: Synthetic peptide
  Seed: VVGACGVGK (KRAS G12C)
VTGACGVGM

SEQ ID NO: 8398 - protein, 9 aa, Artificial Sequence
  Description of Artificial Sequence: Synthetic peptide
  Seed: VVGACGVGK (KRAS G12C)
VTGACGVGY

SEQ ID NO: 8399 - protein, 10 aa, Artificial Sequence
  Description of Artificial Sequence: Synthetic peptide
  Seed: VVVGACGVGK (KRAS G12C)
VTVGACGVGF

SEQ ID NO: 8400 - protein, 10 aa, Artificial Sequence
  Description of Artificial Sequence: Synthetic peptide
  Seed: VVVGACGVGK (KRAS G12C)
VTVGACGVGH

SEQ ID NO: 8401 - protein, 10 aa, Artificial Sequence
  Description of Artificial Sequence: Synthetic peptide
  Seed: VVVGACGVGK (KRAS G12C)
VTVGACGVGL

SEQ ID NO: 8402 - protein, 10 aa, Artificial Sequence
  Description of Artificial Sequence: Synthetic peptide
  Seed: VVVGACGVGK (KRAS G12C)
VTVGACGVGM

SEQ ID NO: 8403 - protein, 10 aa, Artificial Sequence
  Description of Artificial Sequence: Synthetic peptide
  Seed: VVVGACGVGK (KRAS G12C)
VTVGACGVGQ

SEQ ID NO: 8404 - protein, 10 aa, Artificial Sequence
  Description of Artificial Sequence: Synthetic peptide
  Seed: VVVGACGVGK (KRAS G12C)
VTVGACGVGW

SEQ ID NO: 8405 - protein, 10 aa, Artificial Sequence
  Description of Artificial Sequence: Synthetic peptide
  Seed: VVVGACGVGK (KRAS G12C)
VTVGACGVGY

SEQ ID NO: 8406 - protein, 8 aa, Artificial Sequence
  Description of Artificial Sequence: Synthetic peptide
  Seed: VGACGVGK (KRAS G12C)
VVACGVGK

SEQ ID NO: 8407 - protein, 11 aa, Artificial Sequence
  Description of Artificial Sequence: Synthetic peptide
  Seed: VGACGVGKSAL (KRAS G12C)
VVACGVGKSAL

SEQ ID NO: 8408 - protein, 8 aa, Artificial Sequence
  Description of Artificial Sequence: Synthetic peptide
  Seed: VGACGVGK (KRAS G12C)
VVACGVGR

SEQ ID NO: 8409 - protein, 9 aa, Artificial Sequence
  Description of Artificial Sequence: Synthetic peptide
  Seed: VVGACGVGK (KRAS G12C)
VVGACGVGF

SEQ ID NO: 8410 - protein, 9 aa, Artificial Sequence
  Description of Artificial Sequence: Synthetic peptide
  Seed: VVGACGVGK (KRAS G12C)
VVGACGVGH

SEQ ID NO: 8411 - protein, 9 aa, Artificial Sequence
  Description of Artificial Sequence: Synthetic peptide
  Seed: VVGACGVGK (KRAS G12C)
VVGACGVGL

SEQ ID NO: 8412 - protein, 9 aa, Artificial Sequence
  Description of Artificial Sequence: Synthetic peptide
  Seed: VVGACGVGK (KRAS G12C)
VVGACGVGM

SEQ ID NO: 8413 - protein, 9 aa, Artificial Sequence
  Description of Artificial Sequence: Synthetic peptide
  Seed: VVGACGVGK (KRAS G12C)
VVGACGVGY

SEQ ID NO: 8414 - protein, 10 aa, Artificial Sequence
  Description of Artificial Sequence: Synthetic peptide
  Seed: VVVGACGVGK (KRAS G12C)
VVVGACGVGF

SEQ ID NO: 8415 - protein, 10 aa, Artificial Sequence
  Description of Artificial Sequence: Synthetic peptide
  Seed: VVVGACGVGK (KRAS G12C)
VVVGACGVGH

SEQ ID NO: 8416 - protein, 10 aa, Artificial Sequence
  Description of Artificial Sequence: Synthetic peptide
  Seed: VVVGACGVGK (KRAS G12C)
VVVGACGVGL

SEQ ID NO: 8417 - protein, 10 aa, Artificial Sequence
  Description of Artificial Sequence: Synthetic peptide
  Seed: VVVGACGVGK (KRAS G12C)
VVVGACGVGM

SEQ ID NO: 8418 - protein, 10 aa, Artificial Sequence
  Description of Artificial Sequence: Synthetic peptide
  Seed: VVVGACGVGK (KRAS G12C)
VVVGACGVGQ

SEQ ID NO: 8419 - protein, 10 aa, Artificial Sequence
  Description of Artificial Sequence: Synthetic peptide
  Seed: VVVGACGVGK (KRAS G12C)
VVVGACGVGY

SEQ ID NO: 8420 - protein, 10 aa, Artificial Sequence
  Description of Artificial Sequence: Synthetic peptide
  Seed: VVVGACGVGK (KRAS G12C)
VWVGACGVGR

SEQ ID NO: 8421 - protein, 10 aa, Artificial Sequence
  Description of Artificial Sequence: Synthetic peptide
  Seed: VVVGACGVGK (KRAS G12C)
VYVGACGVGF

SEQ ID NO: 8422 - protein, 10 aa, Artificial Sequence
  Description of Artificial Sequence: Synthetic peptide
  Seed: VVVGACGVGK (KRAS G12C)
VYVGACGVGR

SEQ ID NO: 8423 - protein, 10 aa, Artificial Sequence
  Description of Artificial Sequence: Synthetic peptide
  Seed: VVVGACGVGK (KRAS G12C)
VYVGACGVGY

SEQ ID NO: 8424 - protein, 10 aa, Homo sapiens
  Native (KRAS G12C)
KLVVVGACGV

SEQ ID NO: 8425 - protein, 9 aa, Homo sapiens
  Native (KRAS G12C)
LVVVGACGV

SEQ ID NO: 8426 - protein, 9 aa, Homo sapiens
  Native (KRAS G12C)
VVGACGVGK

SEQ ID NO: 8427 - protein, 9 aa, Homo sapiens
  Native (KRAS G12C)
GACGVGKSA

SEQ ID NO: 8428 - protein, 10 aa, Homo sapiens
  Native (KRAS G12C)
GACGVGKSAL

SEQ ID NO: 8429 - protein, 11 aa, Homo sapiens
  Native (KRAS G12C)
LVVVGACGVGK

SEQ ID NO: 8430 - protein, 8 aa, Homo sapiens
  Native (KRAS G12C)
VGACGVGK

SEQ ID NO: 8431 - protein, 11 aa, Homo sapiens
  Native (KRAS G12C)
VGACGVGKSAL

SEQ ID NO: 8432 - protein, 10 aa, Artificial Sequence
  Description of Artificial Sequence: Synthetic peptide
  Seed: KLVVVGADGV (KRAS G12D)
KIVVVGADGV

SEQ ID NO: 8433 - protein, 10 aa, Artificial Sequence
  Description of Artificial Sequence: Synthetic peptide
  Seed: KLVVVGADGV (KRAS G12D)
KLVVVGADGA

SEQ ID NO: 8434 - protein, 10 aa, Artificial Sequence
  Description of Artificial Sequence: Synthetic peptide
  Seed: KLVVVGADGV (KRAS G12D)
KLVVVGADGI

SEQ ID NO: 8435 - protein, 10 aa, Artificial Sequence
  Description of Artificial Sequence: Synthetic peptide
  Seed: KLVVVGADGV (KRAS G12D)
KLVVVGADGL

SEQ ID NO: 8436 - protein, 10 aa, Artificial Sequence
  Description of Artificial Sequence: Synthetic peptide
  Seed: KLVVVGADGV (KRAS G12D)
KMVVVGADGA

SEQ ID NO: 8437 - protein, 10 aa, Artificial Sequence
  Description of Artificial Sequence: Synthetic peptide
  Seed: KLVVVGADGV (KRAS G12D)
KMVVVGADGI

SEQ ID NO: 8438 - protein, 10 aa, Artificial Sequence
  Description of Artificial Sequence: Synthetic peptide
  Seed: KLVVVGADGV (KRAS G12D)
KMVVVGADGL

SEQ ID NO: 8439 - protein, 10 aa, Artificial Sequence
  Description of Artificial Sequence: Synthetic peptide
  Seed: KLVVVGADGV (KRAS G12D)
KMVVVGADGV

SEQ ID NO: 8440 - protein, 10 aa, Artificial Sequence
  Description of Artificial Sequence: Synthetic peptide
  Seed: KLVVVGADGV (KRAS G12D)
KQVVVGADGI

SEQ ID NO: 8441 - protein, 10 aa, Artificial Sequence
  Description of Artificial Sequence: Synthetic peptide
  Seed: KLVVVGADGV (KRAS G12D)
KQVVVGADGL

SEQ ID NO: 8442 - protein, 10 aa, Artificial Sequence
  Description of Artificial Sequence: Synthetic peptide
  Seed: KLVVVGADGV (KRAS G12D)
KQVVVGADGV

SEQ ID NO: 8443 - protein, 10 aa, Artificial Sequence
  Description of Artificial Sequence: Synthetic peptide
  Seed: KLVVVGADGV (KRAS G12D)
KTVVVGADGV

SEQ ID NO: 8444 - protein, 10 aa, Artificial Sequence
  Description of Artificial Sequence: Synthetic peptide
  Seed: KLVVVGADGV (KRAS G12D)
KVVVVGADGV

SEQ ID NO: 8445 - protein, 9 aa, Artificial Sequence
  Description of Artificial Sequence: Synthetic peptide
  Seed: LVVVGADGV (KRAS G12D)
LAVVGADGV

SEQ ID NO: 8446 - protein, 9 aa, Artificial Sequence
  Description of Artificial Sequence: Synthetic peptide
  Seed: LVVVGADGV (KRAS G12D)
LIVVGADGL

SEQ ID NO: 8447 - protein, 9 aa, Artificial Sequence
  Description of Artificial Sequence: Synthetic peptide
  Seed: LVVVGADGV (KRAS G12D)
LIVVGADGV

SEQ ID NO: 8448 - protein, 9 aa, Artificial Sequence
  Description of Artificial Sequence: Synthetic peptide
  Seed: LVVVGADGV (KRAS G12D)
LLVVGADGA

SEQ ID NO: 8449 - protein, 9 aa, Artificial Sequence
  Description of Artificial Sequence: Synthetic peptide
  Seed: LVVVGADGV (KRAS G12D)
LLVVGADGI

SEQ ID NO: 8450 - protein, 9 aa, Artificial Sequence
  Description of Artificial Sequence: Synthetic peptide
  Seed: LVVVGADGV (KRAS G12D)
LLVVGADGL

SEQ ID NO: 8451 - protein, 9 aa, Artificial Sequence
  Description of Artificial Sequence: Synthetic peptide
  Seed: LVVVGADGV (KRAS G12D)
LLVVGADGM

SEQ ID NO: 8452 - protein, 9 aa, Artificial Sequence
  Description of Artificial Sequence: Synthetic peptide
  Seed: LVVVGADGV (KRAS G12D)
LMVVGADGA

SEQ ID NO: 8453 - protein, 9 aa, Artificial Sequence
  Description of Artificial Sequence: Synthetic peptide
  Seed: LVVVGADGV (KRAS G12D)
LMVVGADGI

SEQ ID NO: 8454 - protein, 9 aa, Artificial Sequence
  Description of Artificial Sequence: Synthetic peptide
  Seed: LVVVGADGV (KRAS G12D)
LMVVGADGL

SEQ ID NO: 8455 - protein, 9 aa, Artificial Sequence
  Description of Artificial Sequence: Synthetic peptide
  Seed: LVVVGADGV (KRAS G12D)
LMVVGADGM

SEQ ID NO: 8456 - protein, 9 aa, Artificial Sequence
  Description of Artificial Sequence: Synthetic peptide
  Seed: LVVVGADGV (KRAS G12D)
LQVVGADGI

SEQ ID NO: 8457 - protein, 9 aa, Artificial Sequence
  Description of Artificial Sequence: Synthetic peptide
  Seed: LVVVGADGV (KRAS G12D)
LQVVGADGL

SEQ ID NO: 8458 - protein, 9 aa, Artificial Sequence
  Description of Artificial Sequence: Synthetic peptide
  Seed: LVVVGADGV (KRAS G12D)
LQVVGADGV

SEQ ID NO: 8459 - protein, 9 aa, Artificial Sequence
  Description of Artificial Sequence: Synthetic peptide
  Seed: LVVVGADGV (KRAS G12D)
LSVVGADGV

SEQ ID NO: 8460 - protein, 9 aa, Artificial Sequence
  Description of Artificial Sequence: Synthetic peptide
  Seed: LVVVGADGV (KRAS G12D)
LTVVGADGI

SEQ ID NO: 8461 - protein, 9 aa, Artificial Sequence
  Description of Artificial Sequence: Synthetic peptide
  Seed: LVVVGADGV (KRAS G12D)
LTVVGADGL

SEQ ID NO: 8462 - protein, 9 aa, Artificial Sequence
  Description of Artificial Sequence: Synthetic peptide
  Seed: LVVVGADGV (KRAS G12D)
LVVVGADGI

SEQ ID NO: 8463 - protein, 9 aa, Artificial Sequence
  Description of Artificial Sequence: Synthetic peptide
  Seed: LVVVGADGV (KRAS G12D)
LVVVGADGL

SEQ ID NO: 8464 - protein, 10 aa, Artificial Sequence
  Description of Artificial Sequence: Synthetic peptide
  Seed: VVVGADGVGK (KRAS G12D)
VAVGADGVGK

SEQ ID NO: 8465 - protein, 10 aa, Artificial Sequence
  Description of Artificial Sequence: Synthetic peptide
  Seed: VVVGADGVGK (KRAS G12D)
VAVGADGVGR

SEQ ID NO: 8466 - protein, 9 aa, Artificial Sequence
  Description of Artificial Sequence: Synthetic peptide
  Seed: VVGADGVGK (KRAS G12D)
VIGADGVGK

SEQ ID NO: 8467 - protein, 10 aa, Artificial Sequence
  Description of Artificial Sequence: Synthetic peptide
  Seed: VVVGADGVGK (KRAS G12D)
VIVGADGVGK

SEQ ID NO: 8468 - protein, 10 aa, Artificial Sequence
  Description of Artificial Sequence: Synthetic peptide
  Seed: VVVGADGVGK (KRAS G12D)
VIVGADGVGR

SEQ ID NO: 8469 - protein, 9 aa, Artificial Sequence
  Description of Artificial Sequence: Synthetic peptide
  Seed: VVGADGVGK (KRAS G12D)
VLGADGVGK

SEQ ID NO: 8470 - protein, 9 aa, Artificial Sequence
  Description of Artificial Sequence: Synthetic peptide
  Seed: VVGADGVGK (KRAS G12D)
VMGADGVGK

SEQ ID NO: 8471 - protein, 10 aa, Artificial Sequence
  Description of Artificial Sequence: Synthetic peptide
  Seed: VVVGADGVGK (KRAS G12D)
VMVGADGVGK

SEQ ID NO: 8472 - protein, 10 aa, Artificial Sequence
  Description of Artificial Sequence: Synthetic peptide
  Seed: VVVGADGVGK (KRAS G12D)
VMVGADGVGR

SEQ ID NO: 8473 - protein, 9 aa, Artificial Sequence
  Description of Artificial Sequence: Synthetic peptide
  Seed: VVGADGVGK (KRAS G12D)
VSGADGVGK

SEQ ID NO: 8474 - protein, 10 aa, Artificial Sequence
  Description of Artificial Sequence: Synthetic peptide
  Seed: VVVGADGVGK (KRAS G12D)
VSVGADGVGK

SEQ ID NO: 8475 - protein, 10 aa, Artificial Sequence
  Description of Artificial Sequence: Synthetic peptide
  Seed: VVVGADGVGK (KRAS G12D)
VSVGADGVGR

SEQ ID NO: 8476 - protein, 9 aa, Artificial Sequence
  Description of Artificial Sequence: Synthetic peptide
  Seed: VVGADGVGK (KRAS G12D)
VTGADGVGK

SEQ ID NO: 8477 - protein, 8 aa, Artificial Sequence
  Description of Artificial Sequence: Synthetic peptide
  Seed: DGVGKSAL (KRAS G12D)
DAVGKSAL

SEQ ID NO: 8478 - protein, 8 aa, Artificial Sequence
  Description of Artificial Sequence: Synthetic peptide
  Seed: DGVGKSAL (KRAS G12D)
DEVGKSAL

SEQ ID NO: 8479 - protein, 8 aa, Artificial Sequence
  Description of Artificial Sequence: Synthetic peptide
  Seed: DGVGKSAL (KRAS G12D)
DFVGKSAL

SEQ ID NO: 8480 - protein, 8 aa, Artificial Sequence
  Description of Artificial Sequence: Synthetic peptide
  Seed: DGVGKSAL (KRAS G12D)
DHVGKSAF

SEQ ID NO: 8481 - protein, 8 aa, Artificial Sequence
  Description of Artificial Sequence: Synthetic peptide
  Seed: DGVGKSAL (KRAS G12D)
DHVGKSAI

SEQ ID NO: 8482 - protein, 8 aa, Artificial Sequence
  Description of Artificial Sequence: Synthetic peptide
  Seed: DGVGKSAL (KRAS G12D)
DHVGKSAL

SEQ ID NO: 8483 - protein, 8 aa, Artificial Sequence
  Description of Artificial Sequence: Synthetic peptide
  Seed: DGVGKSAL (KRAS G12D)
DHVGKSAM

SEQ ID NO: 8484 - protein, 8 aa, Artificial Sequence
  Description of Artificial Sequence: Synthetic peptide
  Seed: DGVGKSAL (KRAS G12D)
DHVGKSAV

SEQ ID NO: 8485 - protein, 8 aa, Artificial Sequence
  Description of Artificial Sequence: Synthetic peptide
  Seed: DGVGKSAL (KRAS G12D)
DIVGKSAL

SEQ ID NO: 8486 - protein, 8 aa, Artificial Sequence
  Description of Artificial Sequence: Synthetic peptide
  Seed: DGVGKSAL (KRAS G12D)
DKVGKSAL

SEQ ID NO: 8487 - protein, 8 aa, Artificial Sequence
  Description of Artificial Sequence: Synthetic peptide
  Seed: DGVGKSAL (KRAS G12D)
DLVGKSAL

SEQ ID NO: 8488 - protein, 8 aa, Artificial Sequence
  Description of Artificial Sequence: Synthetic peptide
  Seed: DGVGKSAL (KRAS G12D)
DMVGKSAL

SEQ ID NO: 8489 - protein, 8 aa, Artificial Sequence
  Description of Artificial Sequence: Synthetic peptide
  Seed: DGVGKSAL (KRAS G12D)
DMVGKSAM

SEQ ID NO: 8490 - protein, 8 aa, Artificial Sequence
  Description of Artificial Sequence: Synthetic peptide
  Seed: DGVGKSAL (KRAS G12D)
DNVGKSAL

SEQ ID NO: 8491 - protein, 8 aa, Artificial Sequence
  Description of Artificial Sequence: Synthetic peptide
  Seed: DGVGKSAL (KRAS G12D)
DPVGKSAL

SEQ ID NO: 8492 - protein, 8 aa, Artificial Sequence
  Description of Artificial Sequence: Synthetic peptide
  Seed: DGVGKSAL (KRAS G12D)
DQVGKSAI

SEQ ID NO: 8493 - protein, 8 aa, Artificial Sequence
  Description of Artificial Sequence: Synthetic peptide
  Seed: DGVGKSAL (KRAS G12D)
DQVGKSAL

SEQ ID NO: 8494 - protein, 8 aa, Artificial Sequence
  Description of Artificial Sequence: Synthetic peptide
  Seed: DGVGKSAL (KRAS G12D)
DQVGKSAM

SEQ ID NO: 8495 - protein, 8 aa, Artificial Sequence
  Description of Artificial Sequence: Synthetic peptide
  Seed: DGVGKSAL (KRAS G12D)
DQVGKSAV

SEQ ID NO: 8496 - protein, 8 aa, Artificial Sequence
  Description of Artificial Sequence: Synthetic peptide
  Seed: DGVGKSAL (KRAS G12D)
DRVGKSAF

SEQ ID NO: 8497 - protein, 8 aa, Artificial Sequence
  Description of Artificial Sequence: Synthetic peptide
  Seed: DGVGKSAL (KRAS G12D)
DRVGKSAI

SEQ ID NO: 8498 - protein, 8 aa, Artificial Sequence
  Description of Artificial Sequence: Synthetic peptide
  Seed: DGVGKSAL (KRAS G12D)
DRVGKSAL

SEQ ID NO: 8499 - protein, 8 aa, Artificial Sequence
  Description of Artificial Sequence: Synthetic peptide
  Seed: DGVGKSAL (KRAS G12D)
DRVGKSAM

SEQ ID NO: 8500 - protein, 8 aa, Artificial Sequence
  Description of Artificial Sequence: Synthetic peptide
  Seed: DGVGKSAL (KRAS G12D)
DRVGKSAV

SEQ ID NO: 8501 - protein, 8 aa, Artificial Sequence
  Description of Artificial Sequence: Synthetic peptide
  Seed: DGVGKSAL (KRAS G12D)
DSVGKSAL

SEQ ID NO: 8502 - protein, 10 aa, Artificial Sequence
  Description of Artificial Sequence: Synthetic peptide
  Seed: GADGVGKSAL (KRAS G12D)
GADGVGKSAA

SEQ ID NO: 8503 - protein, 10 aa, Artificial Sequence
  Description of Artificial Sequence: Synthetic peptide
  Seed: GADGVGKSAL (KRAS G12D)
GADGVGKSAC

SEQ ID NO: 8504 - protein, 10 aa, Artificial Sequence
  Description of Artificial Sequence: Synthetic peptide
  Seed: GADGVGKSAL (KRAS G12D)
GADGVGKSAF

SEQ ID NO: 8505 - protein, 10 aa, Artificial Sequence
  Description of Artificial Sequence: Synthetic peptide
  Seed: GADGVGKSAL (KRAS G12D)
GADGVGKSAH

SEQ ID NO: 8506 - protein, 10 aa, Artificial Sequence
  Description of Artificial Sequence: Synthetic peptide
  Seed: GADGVGKSAL (KRAS G12D)
GADGVGKSAI

SEQ ID NO: 8507 - protein, 10 aa, Artificial Sequence
  Description of Artificial Sequence: Synthetic peptide
  Seed: GADGVGKSAL (KRAS G12D)
GADGVGKSAK

SEQ ID NO: 8508 - protein, 11 aa, Artificial Sequence
  Description of Artificial Sequence: Synthetic peptide
  Seed: GADGVGKSALT (KRAS G12D)
GADGVGKSALA

SEQ ID NO: 8509 - protein, 11 aa, Artificial Sequence
  Description of Artificial Sequence: Synthetic peptide
  Seed: GADGVGKSALT (KRAS G12D)
GADGVGKSALC

SEQ ID NO: 8510 - protein, 11 aa, Artificial Sequence
  Description of Artificial Sequence: Synthetic peptide
  Seed: GADGVGKSALT (KRAS G12D)
GADGVGKSALF

SEQ ID NO: 8511 - protein, 11 aa, Artificial Sequence
  Description of Artificial Sequence: Synthetic peptide
  Seed: GADGVGKSALT (KRAS G12D)
GADGVGKSALI

SEQ ID NO: 8512 - protein, 11 aa, Artificial Sequence
  Description of Artificial Sequence: Synthetic peptide
  Seed: GADGVGKSALT (KRAS G12D)
GADGVGKSALK

SEQ ID NO: 8513 - protein, 11 aa, Artificial Sequence
  Description of Artificial Sequence: Synthetic peptide
  Seed: GADGVGKSALT (KRAS G12D)
GADGVGKSALL

SEQ ID NO: 8514 - protein, 11 aa, Artificial Sequence
  Description of Artificial Sequence: Synthetic peptide
  Seed: GADGVGKSALT (KRAS G12D)
GADGVGKSALM

SEQ ID NO: 8515 - protein, 11 aa, Artificial Sequence
  Description of Artificial Sequence: Synthetic peptide
  Seed: GADGVGKSALT (KRAS G12D)
GADGVGKSALV

SEQ ID NO: 8516 - protein, 11 aa, Artificial Sequence
  Description of Artificial Sequence: Synthetic peptide
  Seed: GADGVGKSALT (KRAS G12D)
GADGVGKSALW

SEQ ID NO: 8517 - protein, 11 aa, Artificial Sequence
  Description of Artificial Sequence: Synthetic peptide
  Seed: GADGVGKSALT (KRAS G12D)
GADGVGKSALY

SEQ ID NO: 8518 - protein, 10 aa, Artificial Sequence
  Description of Artificial Sequence: Synthetic peptide
  Seed: GADGVGKSAL (KRAS G12D)
GADGVGKSAM

SEQ ID NO: 8519 - protein, 10 aa, Artificial Sequence
  Description of Artificial Sequence: Synthetic peptide
  Seed: GADGVGKSAL (KRAS G12D)
GADGVGKSAR

SEQ ID NO: 8520 - protein, 10 aa, Artificial Sequence
  Description of Artificial Sequence: Synthetic peptide
  Seed: GADGVGKSAL (KRAS G12D)
GADGVGKSAV

SEQ ID NO: 8521 - protein, 10 aa, Artificial Sequence
  Description of Artificial Sequence: Synthetic peptide
  Seed: GADGVGKSAL (KRAS G12D)
GADGVGKSAW

SEQ ID NO: 8522 - protein, 10 aa, Artificial Sequence
  Description of Artificial Sequence: Synthetic peptide
  Seed: GADGVGKSAL (KRAS G12D)
GADGVGKSAY

SEQ ID NO: 8523 - protein, 9 aa, Artificial Sequence
  Description of Artificial Sequence: Synthetic peptide
  Seed: GADGVGKSA (KRAS G12D)
GADGVGKSC

SEQ ID NO: 8524 - protein, 9 aa, Artificial Sequence
  Description of Artificial Sequence: Synthetic peptide
  Seed: GADGVGKSA (KRAS G12D)
GADGVGKSF

SEQ ID NO: 8525 - protein, 9 aa, Artificial Sequence
  Description of Artificial Sequence: Synthetic peptide
  Seed: GADGVGKSA (KRAS G12D)
GADGVGKSH

SEQ ID NO: 8526 - protein, 9 aa, Artificial Sequence
  Description of Artificial Sequence: Synthetic peptide
  Seed: GADGVGKSA (KRAS G12D)
GADGVGKSI

SEQ ID NO: 8527 - protein, 9 aa, Artificial Sequence
  Description of Artificial Sequence: Synthetic peptide
  Seed: GADGVGKSA (KRAS G12D)
GADGVGKSK

SEQ ID NO: 8528 - protein, 9 aa, Artificial Sequence
  Description of Artificial Sequence: Synthetic peptide
  Seed: GADGVGKSA (KRAS G12D)
GADGVGKSL

SEQ ID NO: 8529 - protein, 9 aa, Artificial Sequence
  Description of Artificial Sequence: Synthetic peptide
  Seed: GADGVGKSA (KRAS G12D)
GADGVGKSM

SEQ ID NO: 8530 - protein, 9 aa, Artificial Sequence
  Description of Artificial Sequence: Synthetic peptide
  Seed: GADGVGKSA (KRAS G12D)
GADGVGKSP

SEQ ID NO: 8531 - protein, 9 aa, Artificial Sequence
  Description of Artificial Sequence: Synthetic peptide
  Seed: GADGVGKSA (KRAS G12D)
GADGVGKSR

SEQ ID NO: 8532 - protein, 9 aa, Artificial Sequence
  Description of Artificial Sequence: Synthetic peptide
  Seed: GADGVGKSA (KRAS G12D)
GADGVGKSS

SEQ ID NO: 8533 - protein, 9 aa, Artificial Sequence
  Description of Artificial Sequence: Synthetic peptide
  Seed: GADGVGKSA (KRAS G12D)
GADGVGKST

SEQ ID NO: 8534 - protein, 9 aa, Artificial Sequence
  Description of Artificial Sequence: Synthetic peptide
  Seed: GADGVGKSA (KRAS G12D)
GADGVGKSV

SEQ ID NO: 8535 - protein, 9 aa, Artificial Sequence
  Description of Artificial Sequence: Synthetic peptide
  Seed: GADGVGKSA (KRAS G12D)
GADGVGKSW

SEQ ID NO: 8536 - protein, 9 aa, Artificial Sequence
  Description of Artificial Sequence: Synthetic peptide
  Seed: GADGVGKSA (KRAS G12D)
GADGVGKSY

SEQ ID NO: 8537 - protein, 9 aa, Artificial Sequence
  Description of Artificial Sequence: Synthetic peptide
  Seed: GADGVGKSA (KRAS G12D)
GCDGVGKSA

SEQ ID NO: 8538 - protein, 10 aa, Artificial Sequence
  Description of Artificial Sequence: Synthetic peptide
  Seed: GADGVGKSAL (KRAS G12D)
GCDGVGKSAF

SEQ ID NO: 8539 - protein, 10 aa, Artificial Sequence
  Description of Artificial Sequence: Synthetic peptide
  Seed: GADGVGKSAL (KRAS G12D)
GCDGVGKSAI

SEQ ID NO: 8540 - protein, 10 aa, Artificial Sequence
  Description of Artificial Sequence: Synthetic peptide
  Seed: GADGVGKSAL (KRAS G12D)
GCDGVGKSAK

SEQ ID NO: 8541 - protein, 10 aa, Artificial Sequence
  Description of Artificial Sequence: Synthetic peptide
  Seed: GADGVGKSAL (KRAS G12D)
GCDGVGKSAL

SEQ ID NO: 8542 - protein, 11 aa, Artificial Sequence
  Description of Artificial Sequence: Synthetic peptide
  Seed: GADGVGKSALT (KRAS G12D)
GCDGVGKSALF

SEQ ID NO: 8543 - protein, 11 aa, Artificial Sequence
  Description of Artificial Sequence: Synthetic peptide
  Seed: GADGVGKSALT (KRAS G12D)
GCDGVGKSALI

SEQ ID NO: 8544 - protein, 11 aa, Artificial Sequence
  Description of Artificial Sequence: Synthetic peptide
  Seed: GADGVGKSALT (KRAS G12D)
GCDGVGKSALL

SEQ ID NO: 8545 - protein, 11 aa, Artificial Sequence
  Description of Artificial Sequence: Synthetic peptide
  Seed: GADGVGKSALT (KRAS G12D)
GCDGVGKSALM

SEQ ID NO: 8546 - protein, 11 aa, Artificial Sequence
  Description of Artificial Sequence: Synthetic peptide
  Seed: GADGVGKSALT (KRAS G12D)
GCDGVGKSALV

SEQ ID NO: 8547 - protein, 10 aa, Artificial Sequence
  Description of Artificial Sequence: Synthetic peptide
  Seed: GADGVGKSAL (KRAS G12D)
GCDGVGKSAM

SEQ ID NO: 8548 - protein, 10 aa, Artificial Sequence
  Description of Artificial Sequence: Synthetic peptide
  Seed: GADGVGKSAL (KRAS G12D)
GCDGVGKSAR

SEQ ID NO: 8549 - protein, 10 aa, Artificial Sequence
  Description of Artificial Sequence: Synthetic peptide
  Seed: GADGVGKSAL (KRAS G12D)
GCDGVGKSAV

SEQ ID NO: 8550 - protein, 10 aa, Artificial Sequence
  Description of Artificial Sequence: Synthetic peptide
  Seed: GADGVGKSAL (KRAS G12D)
GCDGVGKSAY

SEQ ID NO: 8551 - protein, 9 aa, Artificial Sequence
  Description of Artificial Sequence: Synthetic peptide
  Seed: GADGVGKSA (KRAS G12D)
GCDGVGKSF

SEQ ID NO: 8552 - protein, 9 aa, Artificial Sequence
  Description of Artificial Sequence: Synthetic peptide
  Seed: GADGVGKSA (KRAS G12D)
GCDGVGKSI

SEQ ID NO: 8553 - protein, 9 aa, Artificial Sequence
  Description of Artificial Sequence: Synthetic peptide
  Seed: GADGVGKSA (KRAS G12D)
GCDGVGKSK

SEQ ID NO: 8554 - protein, 9 aa, Artificial Sequence
  Description of Artificial Sequence: Synthetic peptide
  Seed: GADGVGKSA (KRAS G12D)
GCDGVGKSL

SEQ ID NO: 8555 - protein, 9 aa, Artificial Sequence
  Description of Artificial Sequence: Synthetic peptide
  Seed: GADGVGKSA (KRAS G12D)
GCDGVGKSM

SEQ ID NO: 8556 - protein, 9 aa, Artificial Sequence
  Description of Artificial Sequence: Synthetic peptide
  Seed: GADGVGKSA (KRAS G12D)
GCDGVGKSR

SEQ ID NO: 8557 - protein, 9 aa, Artificial Sequence
  Description of Artificial Sequence: Synthetic peptide
  Seed: GADGVGKSA (KRAS G12D)
GCDGVGKSV

SEQ ID NO: 8558 - protein, 9 aa, Artificial Sequence
  Description of Artificial Sequence: Synthetic peptide
  Seed: GADGVGKSA (KRAS G12D)
GCDGVGKSW

SEQ ID NO: 8559 - protein, 9 aa, Artificial Sequence
  Description of Artificial Sequence: Synthetic peptide
  Seed: GADGVGKSA (KRAS G12D)
GCDGVGKSY

SEQ ID NO: 8560 - protein, 10 aa, Artificial Sequence
  Description of Artificial Sequence: Synthetic peptide
  Seed: GADGVGKSAL (KRAS G12D)
GDDGVGKSAK

SEQ ID NO: 8561 - protein, 10 aa, Artificial Sequence
  Description of Artificial Sequence: Synthetic peptide
  Seed: GADGVGKSAL (KRAS G12D)
GDDGVGKSAL

SEQ ID NO: 8562 - protein, 10 aa, Artificial Sequence
  Description of Artificial Sequence: Synthetic peptide
  Seed: GADGVGKSAL (KRAS G12D)
GDDGVGKSAR

SEQ ID NO: 8563 - protein, 9 aa, Artificial Sequence
  Description of Artificial Sequence: Synthetic peptide
  Seed: GADGVGKSA (KRAS G12D)
GDDGVGKSF

SEQ ID NO: 8564 - protein, 9 aa, Artificial Sequence
  Description of Artificial Sequence: Synthetic peptide
  Seed: GADGVGKSA (KRAS G12D)
GDDGVGKSI

SEQ ID NO: 8565 - protein, 9 aa, Artificial Sequence
  Description of Artificial Sequence: Synthetic peptide
  Seed: GADGVGKSA (KRAS G12D)
GDDGVGKSK

SEQ ID NO: 8566 - protein, 9 aa, Artificial Sequence
  Description of Artificial Sequence: Synthetic peptide
  Seed: GADGVGKSA (KRAS G12D)
GDDGVGKSL

SEQ ID NO: 8567 - protein, 9 aa, Artificial Sequence
  Description of Artificial Sequence: Synthetic peptide
  Seed: GADGVGKSA (KRAS G12D)
GDDGVGKSM

SEQ ID NO: 8568 - protein, 9 aa, Artificial Sequence
  Description of Artificial Sequence: Synthetic peptide
  Seed: GADGVGKSA (KRAS G12D)
GDDGVGKSR

SEQ ID NO: 8569 - protein, 9 aa, Artificial Sequence
  Description of Artificial Sequence: Synthetic peptide
  Seed: GADGVGKSA (KRAS G12D)
GDDGVGKSV

SEQ ID NO: 8570 - protein, 9 aa, Artificial Sequence
  Description of Artificial Sequence: Synthetic peptide
  Seed: GADGVGKSA (KRAS G12D)
GDDGVGKSY

SEQ ID NO: 8571 - protein, 10 aa, Artificial Sequence
  Description of Artificial Sequence: Synthetic peptide
  Seed: GADGVGKSAL (KRAS G12D)
GEDGVGKSAF

SEQ ID NO: 8572 - protein, 10 aa, Artificial Sequence
  Description of Artificial Sequence: Synthetic peptide
  Seed: GADGVGKSAL (KRAS G12D)
GEDGVGKSAK

SEQ ID NO: 8573 - protein, 10 aa, Artificial Sequence
  Description of Artificial Sequence: Synthetic peptide
  Seed: GADGVGKSAL (KRAS G12D)
GEDGVGKSAL

SEQ ID NO: 8574 - protein, 10 aa, Artificial Sequence
  Description of Artificial Sequence: Synthetic peptide
  Seed: GADGVGKSAL (KRAS G12D)
GEDGVGKSAM

SEQ ID NO: 8575 - protein, 10 aa, Artificial Sequence
  Description of Artificial Sequence: Synthetic peptide
  Seed: GADGVGKSAL (KRAS G12D)
GEDGVGKSAR

SEQ ID NO: 8576 - protein, 10 aa, Artificial Sequence
  Description of Artificial Sequence: Synthetic peptide
  Seed: GADGVGKSAL (KRAS G12D)
GEDGVGKSAY

SEQ ID NO: 8577 - protein, 9 aa, Artificial Sequence
  Description of Artificial Sequence: Synthetic peptide
  Seed: GADGVGKSA (KRAS G12D)
GEDGVGKSF

SEQ ID NO: 8578 - protein, 9 aa, Artificial Sequence
  Description of Artificial Sequence: Synthetic peptide
  Seed: GADGVGKSA (KRAS G12D)
GEDGVGKSI

SEQ ID NO: 8579 - protein, 9 aa, Artificial Sequence
  Description of Artificial Sequence: Synthetic peptide
  Seed: GADGVGKSA (KRAS G12D)
GEDGVGKSK

SEQ ID NO: 8580 - protein, 9 aa, Artificial Sequence
  Description of Artificial Sequence: Synthetic peptide
  Seed: GADGVGKSA (KRAS G12D)
GEDGVGKSL

SEQ ID NO: 8581 - protein, 9 aa, Artificial Sequence
  Description of Artificial Sequence: Synthetic peptide
  Seed: GADGVGKSA (KRAS G12D)
GEDGVGKSM

SEQ ID NO: 8582 - protein, 9 aa, Artificial Sequence
  Description of Artificial Sequence: Synthetic peptide
  Seed: GADGVGKSA (KRAS G12D)
GEDGVGKSR

SEQ ID NO: 8583 - protein, 9 aa, Artificial Sequence
  Description of Artificial Sequence: Synthetic peptide
  Seed: GADGVGKSA (KRAS G12D)
GEDGVGKSV

SEQ ID NO: 8584 - protein, 9 aa, Artificial Sequence
  Description of Artificial Sequence: Synthetic peptide
  Seed: GADGVGKSA (KRAS G12D)
GEDGVGKSY

SEQ ID NO: 8585 - protein, 9 aa, Artificial Sequence
  Description of Artificial Sequence: Synthetic peptide
  Seed: GADGVGKSA (KRAS G12D)
GFDGVGKSA

SEQ ID NO: 8586 - protein, 10 aa, Artificial Sequence
  Description of Artificial Sequence: Synthetic peptide
  Seed: GADGVGKSAL (KRAS G12D)
GFDGVGKSAC

SEQ ID NO: 8587 - protein, 10 aa, Artificial Sequence
  Description of Artificial Sequence: Synthetic peptide
  Seed: GADGVGKSAL (KRAS G12D)
GFDGVGKSAF

SEQ ID NO: 8588 - protein, 10 aa, Artificial Sequence
  Description of Artificial Sequence: Synthetic peptide
  Seed: GADGVGKSAL (KRAS G12D)
GFDGVGKSAI

SEQ ID NO: 8589 - protein, 10 aa, Artificial Sequence
  Description of Artificial Sequence: Synthetic peptide
  Seed: GADGVGKSAL (KRAS G12D)
GFDGVGKSAK

SEQ ID NO: 8590 - protein, 10 aa, Artificial Sequence
  Description of Artificial Sequence: Synthetic peptide
  Seed: GADGVGKSAL (KRAS G12D)
GFDGVGKSAL

SEQ ID NO: 8591 - protein, 11 aa, Artificial Sequence
  Description of Artificial Sequence: Synthetic peptide
  Seed: GADGVGKSALT (KRAS G12D)
GFDGVGKSALF

SEQ ID NO: 8592 - protein, 11 aa, Artificial Sequence
  Description of Artificial Sequence: Synthetic peptide
  Seed: GADGVGKSALT (KRAS G12D)
GFDGVGKSALI

SEQ ID NO: 8593 - protein, 11 aa, Artificial Sequence
  Description of Artificial Sequence: Synthetic peptide
  Seed: GADGVGKSALT (KRAS G12D)
GFDGVGKSALL

SEQ ID NO: 8594 - protein, 11 aa, Artificial Sequence
  Description of Artificial Sequence: Synthetic peptide
  Seed: GADGVGKSALT (KRAS G12D)
GFDGVGKSALM

SEQ ID NO: 8595 - protein, 11 aa, Artificial Sequence
  Description of Artificial Sequence: Synthetic peptide
  Seed: GADGVGKSALT (KRAS G12D)
GFDGVGKSALV

SEQ ID NO: 8596 - protein, 10 aa, Artificial Sequence
  Description of Artificial Sequence: Synthetic peptide
  Seed: GADGVGKSAL (KRAS G12D)
GFDGVGKSAM

SEQ ID NO: 8597 - protein, 10 aa, Artificial Sequence
  Description of Artificial Sequence: Synthetic peptide
  Seed: GADGVGKSAL (KRAS G12D)
GFDGVGKSAR

SEQ ID NO: 8598 - protein, 10 aa, Artificial Sequence
  Description of Artificial Sequence: Synthetic peptide
  Seed: GADGVGKSAL (KRAS G12D)
GFDGVGKSAV

SEQ ID NO: 8599 - protein, 10 aa, Artificial Sequence
  Description of Artificial Sequence: Synthetic peptide
  Seed: GADGVGKSAL (KRAS G12D)
GFDGVGKSAW

SEQ ID NO: 8600 - protein, 10 aa, Artificial Sequence
  Description of Artificial Sequence: Synthetic peptide
  Seed: GADGVGKSAL (KRAS G12D)
GFDGVGKSAY

SEQ ID NO: 8601 - protein, 9 aa, Artificial Sequence
  Description of Artificial Sequence: Synthetic peptide
  Seed: GADGVGKSA (KRAS G12D)
GFDGVGKSC

SEQ ID NO: 8602 - protein, 9 aa, Artificial Sequence
  Description of Artificial Sequence: Synthetic peptide
  Seed: GADGVGKSA (KRAS G12D)
GFDGVGKSF

SEQ ID NO: 8603 - protein, 9 aa, Artificial Sequence
  Description of Artificial Sequence: Synthetic peptide
  Seed: GADGVGKSA (KRAS G12D)
GFDGVGKSI

SEQ ID NO: 8604 - protein, 9 aa, Artificial Sequence
  Description of Artificial Sequence: Synthetic peptide
  Seed: GADGVGKSA (KRAS G12D)
GFDGVGKSK

SEQ ID NO: 8605 - protein, 9 aa, Artificial Sequence
  Description of Artificial Sequence: Synthetic peptide
  Seed: GADGVGKSA (KRAS G12D)
GFDGVGKSM

SEQ ID NO: 8606 - protein, 9 aa, Artificial Sequence
  Description of Artificial Sequence: Synthetic peptide
  Seed: GADGVGKSA (KRAS G12D)
GFDGVGKSR

SEQ ID NO: 8607 - protein, 9 aa, Artificial Sequence
  Description of Artificial Sequence: Synthetic peptide
  Seed: GADGVGKSA (KRAS G12D)
GFDGVGKSV

SEQ ID NO: 8608 - protein, 9 aa, Artificial Sequence
  Description of Artificial Sequence: Synthetic peptide
  Seed: GADGVGKSA (KRAS G12D)
GFDGVGKSW

SEQ ID NO: 8609 - protein, 9 aa, Artificial Sequence
  Description of Artificial Sequence: Synthetic peptide
  Seed: GADGVGKSA (KRAS G12D)
GFDGVGKSY

SEQ ID NO: 8610 - protein, 9 aa, Artificial Sequence
  Description of Artificial Sequence: Synthetic peptide
  Seed: GADGVGKSA (KRAS G12D)
GGDGVGKSA

SEQ ID NO: 8611 - protein, 10 aa, Artificial Sequence
  Description of Artificial Sequence: Synthetic peptide
  Seed: GADGVGKSAL (KRAS G12D)
GGDGVGKSAF

SEQ ID NO: 8612 - protein, 10 aa, Artificial Sequence
  Description of Artificial Sequence: Synthetic peptide
  Seed: GADGVGKSAL (KRAS G12D)
GGDGVGKSAI

SEQ ID NO: 8613 - protein, 10 aa, Artificial Sequence
  Description of Artificial Sequence: Synthetic peptide
  Seed: GADGVGKSAL (KRAS G12D)
GGDGVGKSAK

SEQ ID NO: 8614 - protein, 10 aa, Artificial Sequence
  Description of Artificial Sequence: Synthetic peptide
  Seed: GADGVGKSAL (KRAS G12D)
GGDGVGKSAL

SEQ ID NO: 8615 - protein, 11 aa, Artificial Sequence
  Description of Artificial Sequence: Synthetic peptide
  Seed: GADGVGKSALT (KRAS G12D)
GGDGVGKSALF

SEQ ID NO: 8616 - protein, 11 aa, Artificial Sequence
  Description of Artificial Sequence: Synthetic peptide
  Seed: GADGVGKSALT (KRAS G12D)
GGDGVGKSALI

SEQ ID NO: 8617 - protein, 11 aa, Artificial Sequence
  Description of Artificial Sequence: Synthetic peptide
  Seed: GADGVGKSALT (KRAS G12D)
GGDGVGKSALL

SEQ ID NO: 8618 - protein, 11 aa, Artificial Sequence
  Description of Artificial Sequence: Synthetic peptide
  Seed: GADGVGKSALT (KRAS G12D)
GGDGVGKSALM

SEQ ID NO: 8619 - protein, 11 aa, Artificial Sequence
  Description of Artificial Sequence: Synthetic peptide
  Seed: GADGVGKSALT (KRAS G12D)
GGDGVGKSALV

SEQ ID NO: 8620 - protein, 11 aa, Artificial Sequence
  Description of Artificial Sequence: Synthetic peptide
  Seed: GADGVGKSALT (KRAS G12D)
GGDGVGKSALW

SEQ ID NO: 8621 - protein, 11 aa, Artificial Sequence
  Description of Artificial Sequence: Synthetic peptide
  Seed: GADGVGKSALT (KRAS G12D)
GGDGVGKSALY

SEQ ID NO: 8622 - protein, 10 aa, Artificial Sequence
  Description of Artificial Sequence: Synthetic peptide
  Seed: GADGVGKSAL (KRAS G12D)
GGDGVGKSAM

SEQ ID NO: 8623 - protein, 10 aa, Artificial Sequence
  Description of Artificial Sequence: Synthetic peptide
  Seed: GADGVGKSAL (KRAS G12D)
GGDGVGKSAR

SEQ ID NO: 8624 - protein, 10 aa, Artificial Sequence
  Description of Artificial Sequence: Synthetic peptide
  Seed: GADGVGKSAL (KRAS G12D)
GGDGVGKSAV

SEQ ID NO: 8625 - protein, 10 aa, Artificial Sequence
  Description of Artificial Sequence: Synthetic peptide
  Seed: GADGVGKSAL (KRAS G12D)
GGDGVGKSAY

SEQ ID NO: 8626 - protein, 9 aa, Artificial Sequence
  Description of Artificial Sequence: Synthetic peptide
  Seed: GADGVGKSA (KRAS G12D)
GGDGVGKSC

SEQ ID NO: 8627 - protein, 9 aa, Artificial Sequence
  Description of Artificial Sequence: Synthetic peptide
  Seed: GADGVGKSA (KRAS G12D)
GGDGVGKSF

SEQ ID NO: 8628 - protein, 9 aa, Artificial Sequence
  Description of Artificial Sequence: Synthetic peptide
  Seed: GADGVGKSA (KRAS G12D)
GGDGVGKSI

SEQ ID NO: 8629 - protein, 9 aa, Artificial Sequence
  Description of Artificial Sequence: Synthetic peptide
  Seed: GADGVGKSA (KRAS G12D)
GGDGVGKSK

SEQ ID NO: 8630 - protein, 9 aa, Artificial Sequence
  Description of Artificial Sequence: Synthetic peptide
  Seed: GADGVGKSA (KRAS G12D)
GGDGVGKSL

SEQ ID NO: 8631 - protein, 9 aa, Artificial Sequence
  Description of Artificial Sequence: Synthetic peptide
  Seed: GADGVGKSA (KRAS G12D)
GGDGVGKSM

SEQ ID NO: 8632 - protein, 9 aa, Artificial Sequence
  Description of Artificial Sequence: Synthetic peptide
  Seed: GADGVGKSA (KRAS G12D)
GGDGVGKSR

SEQ ID NO: 8633 - protein, 9 aa, Artificial Sequence
  Description of Artificial Sequence: Synthetic peptide
  Seed: GADGVGKSA (KRAS G12D)
GGDGVGKSV

SEQ ID NO: 8634 - protein, 9 aa, Artificial Sequence
  Description of Artificial Sequence: Synthetic peptide
  Seed: GADGVGKSA (KRAS G12D)
GGDGVGKSW

SEQ ID NO: 8635 - protein, 9 aa, Artificial Sequence
  Description of Artificial Sequence: Synthetic peptide
  Seed: GADGVGKSA (KRAS G12D)
GGDGVGKSY

SEQ ID NO: 8636 - protein, 10 aa, Artificial Sequence
  Description of Artificial Sequence: Synthetic peptide
  Seed: GADGVGKSAL (KRAS G12D)
GHDGVGKSAF

SEQ ID NO: 8637 - protein, 10 aa, Artificial Sequence
  Description of Artificial Sequence: Synthetic peptide
  Seed: GADGVGKSAL (KRAS G12D)
GHDGVGKSAI

SEQ ID NO: 8638 - protein, 10 aa, Artificial Sequence
  Description of Artificial Sequence: Synthetic peptide
  Seed: GADGVGKSAL (KRAS G12D)
GHDGVGKSAK

SEQ ID NO: 8639 - protein, 10 aa, Artificial Sequence
  Description of Artificial Sequence: Synthetic peptide
  Seed: GADGVGKSAL (KRAS G12D)
GHDGVGKSAL

SEQ ID NO: 8640 - protein, 10 aa, Artificial Sequence
  Description of Artificial Sequence: Synthetic peptide
  Seed: GADGVGKSAL (KRAS G12D)
GHDGVGKSAM

SEQ ID NO: 8641 - protein, 10 aa, Artificial Sequence
  Description of Artificial Sequence: Synthetic peptide
  Seed: GADGVGKSAL (KRAS G12D)
GHDGVGKSAV

SEQ ID NO: 8642 - protein, 9 aa, Artificial Sequence
  Description of Artificial Sequence: Synthetic peptide
  Seed: GADGVGKSA (KRAS G12D)
GHDGVGKSF

SEQ ID NO: 8643 - protein, 9 aa, Artificial Sequence
  Description of Artificial Sequence: Synthetic peptide
  Seed: GADGVGKSA (KRAS G12D)
GHDGVGKSI

SEQ ID NO: 8644 - protein, 9 aa, Artificial Sequence
  Description of Artificial Sequence: Synthetic peptide
  Seed: GADGVGKSA (KRAS G12D)
GHDGVGKSK

SEQ ID NO: 8645 - protein, 9 aa, Artificial Sequence
  Description of Artificial Sequence: Synthetic peptide
  Seed: GADGVGKSA (KRAS G12D)
GHDGVGKSL

SEQ ID NO: 8646 - protein, 9 aa, Artificial Sequence
  Description of Artificial Sequence: Synthetic peptide
  Seed: GADGVGKSA (KRAS G12D)
GHDGVGKSM

SEQ ID NO: 8647 - protein, 9 aa, Artificial Sequence
  Description of Artificial Sequence: Synthetic peptide
  Seed: GADGVGKSA (KRAS G12D)
GHDGVGKSV

SEQ ID NO: 8648 - protein, 9 aa, Artificial Sequence
  Description of Artificial Sequence: Synthetic peptide
  Seed: GADGVGKSA (KRAS G12D)
GHDGVGKSY

SEQ ID NO: 8649 - protein, 9 aa, Artificial Sequence
  Description of Artificial Sequence: Synthetic peptide
  Seed: GADGVGKSA (KRAS G12D)
GIDGVGKSA

SEQ ID NO: 8650 - protein, 10 aa, Artificial Sequence
  Description of Artificial Sequence: Synthetic peptide
  Seed: GADGVGKSAL (KRAS G12D)
GIDGVGKSAF

SEQ ID NO: 8651 - protein, 10 aa, Artificial Sequence
  Description of Artificial Sequence: Synthetic peptide
  Seed: GADGVGKSAL (KRAS G12D)
GIDGVGKSAI

SEQ ID NO: 8652 - protein, 10 aa, Artificial Sequence
  Description of Artificial Sequence: Synthetic peptide
  Seed: GADGVGKSAL (KRAS G12D)
GIDGVGKSAK

SEQ ID NO: 8653 - protein, 10 aa, Artificial Sequence
  Description of Artificial Sequence: Synthetic peptide
  Seed: GADGVGKSAL (KRAS G12D)
GIDGVGKSAL

SEQ ID NO: 8654 - protein, 11 aa, Artificial Sequence
  Description of Artificial Sequence: Synthetic peptide
  Seed: GADGVGKSALT (KRAS G12D)
GIDGVGKSALC

SEQ ID NO: 8655 - protein, 11 aa, Artificial Sequence
  Description of Artificial Sequence: Synthetic peptide
  Seed: GADGVGKSALT (KRAS G12D)
GIDGVGKSALF

SEQ ID NO: 8656 - protein, 11 aa, Artificial Sequence
  Description of Artificial Sequence: Synthetic peptide
  Seed: GADGVGKSALT (KRAS G12D)
GIDGVGKSALI

SEQ ID NO: 8657 - protein, 11 aa, Artificial Sequence
  Description of Artificial Sequence: Synthetic peptide
  Seed: GADGVGKSALT (KRAS G12D)
GIDGVGKSALL

SEQ ID NO: 8658 - protein, 11 aa, Artificial Sequence
  Description of Artificial Sequence: Synthetic peptide
  Seed: GADGVGKSALT (KRAS G12D)
GIDGVGKSALM

SEQ ID NO: 8659 - protein, 11 aa, Artificial Sequence
  Description of Artificial Sequence: Synthetic peptide
  Seed: GADGVGKSALT (KRAS G12D)
GIDGVGKSALV

SEQ ID NO: 8660 - protein, 11 aa, Artificial Sequence
  Description of Artificial Sequence: Synthetic peptide
  Seed: GADGVGKSALT (KRAS G12D)
GIDGVGKSALW

SEQ ID NO: 8661 - protein, 10 aa, Artificial Sequence
  Description of Artificial Sequence: Synthetic peptide
  Seed: GADGVGKSAL (KRAS G12D)
GIDGVGKSAM

SEQ ID NO: 8662 - protein, 10 aa, Artificial Sequence
  Description of Artificial Sequence: Synthetic peptide
  Seed: GADGVGKSAL (KRAS G12D)
GIDGVGKSAR

SEQ ID NO: 8663 - protein, 10 aa, Artificial Sequence
  Description of Artificial Sequence: Synthetic peptide
  Seed: GADGVGKSAL (KRAS G12D)
GIDGVGKSAV

SEQ ID NO: 8664 - protein, 10 aa, Artificial Sequence
  Description of Artificial Sequence: Synthetic peptide
  Seed: GADGVGKSAL (KRAS G12D)
GIDGVGKSAW

SEQ ID NO: 8665 - protein, 10 aa, Artificial Sequence
  Description of Artificial Sequence: Synthetic peptide
  Seed: GADGVGKSAL (KRAS G12D)
GIDGVGKSAY

SEQ ID NO: 8666 - protein, 9 aa, Artificial Sequence
  Description of Artificial Sequence: Synthetic peptide
  Seed: GADGVGKSA (KRAS G12D)
GIDGVGKSC

SEQ ID NO: 8667 - protein, 9 aa, Artificial Sequence
  Description of Artificial Sequence: Synthetic peptide
  Seed: GADGVGKSA (KRAS G12D)
GIDGVGKSF

SEQ ID NO: 8668 - protein, 9 aa, Artificial Sequence
  Description of Artificial Sequence: Synthetic peptide
  Seed: GADGVGKSA (KRAS G12D)
GIDGVGKSH

SEQ ID NO: 8669 - protein, 9 aa, Artificial Sequence
  Description of Artificial Sequence: Synthetic peptide
  Seed: GADGVGKSA (KRAS G12D)
GIDGVGKSI

SEQ ID NO: 8670 - protein, 9 aa, Artificial Sequence
  Description of Artificial Sequence: Synthetic peptide
  Seed: GADGVGKSA (KRAS G12D)
GIDGVGKSK

SEQ ID NO: 8671 - protein, 9 aa, Artificial Sequence
  Description of Artificial Sequence: Synthetic peptide
  Seed: GADGVGKSA (KRAS G12D)
GIDGVGKSL

SEQ ID NO: 8672 - protein, 9 aa, Artificial Sequence
  Description of Artificial Sequence: Synthetic peptide
  Seed: GADGVGKSA (KRAS G12D)
GIDGVGKSM

SEQ ID NO: 8673 - protein, 9 aa, Artificial Sequence
  Description of Artificial Sequence: Synthetic peptide
  Seed: GADGVGKSA (KRAS G12D)
GIDGVGKSR

SEQ ID NO: 8674 - protein, 9 aa, Artificial Sequence
  Description of Artificial Sequence: Synthetic peptide
  Seed: GADGVGKSA (KRAS G12D)
GIDGVGKST

SEQ ID NO: 8675 - protein, 9 aa, Artificial Sequence
  Description of Artificial Sequence: Synthetic peptide
  Seed: GADGVGKSA (KRAS G12D)
GIDGVGKSV

SEQ ID NO: 8676 - protein, 9 aa, Artificial Sequence
  Description of Artificial Sequence: Synthetic peptide
  Seed: GADGVGKSA (KRAS G12D)
GIDGVGKSW

SEQ ID NO: 8677 - protein, 9 aa, Artificial Sequence
  Description of Artificial Sequence: Synthetic peptide
  Seed: GADGVGKSA (KRAS G12D)
GIDGVGKSY

SEQ ID NO: 8678 - protein, 10 aa, Artificial Sequence
  Description of Artificial Sequence: Synthetic peptide
  Seed: GADGVGKSAL (KRAS G12D)
GKDGVGKSAF

SEQ ID NO: 8679 - protein, 10 aa, Artificial Sequence
  Description of Artificial Sequence: Synthetic peptide
  Seed: GADGVGKSAL (KRAS G12D)
GKDGVGKSAL

SEQ ID NO: 8680 - protein, 10 aa, Artificial Sequence
  Description of Artificial Sequence: Synthetic peptide
  Seed: GADGVGKSAL (KRAS G12D)
GKDGVGKSAM

SEQ ID NO: 8681 - protein, 9 aa, Artificial Sequence
  Description of Artificial Sequence: Synthetic peptide
  Seed: GADGVGKSA (KRAS G12D)
GKDGVGKSF

SEQ ID NO: 8682 - protein, 9 aa, Artificial Sequence
  Description of Artificial Sequence: Synthetic peptide
  Seed: GADGVGKSA (KRAS G12D)
GKDGVGKSI

SEQ ID NO: 8683 - protein, 9 aa, Artificial Sequence
  Description of Artificial Sequence: Synthetic peptide
  Seed: GADGVGKSA (KRAS G12D)
GKDGVGKSL

SEQ ID NO: 8684 - protein, 9 aa, Artificial Sequence
  Description of Artificial Sequence: Synthetic peptide
  Seed: GADGVGKSA (KRAS G12D)
GKDGVGKSM

SEQ ID NO: 8685 - protein, 9 aa, Artificial Sequence
  Description of Artificial Sequence: Synthetic peptide
  Seed: GADGVGKSA (KRAS G12D)
GKDGVGKSV

SEQ ID NO: 8686 - protein, 9 aa, Artificial Sequence
  Description of Artificial Sequence: Synthetic peptide
  Seed: GADGVGKSA (KRAS G12D)
GLDGVGKSA

SEQ ID NO: 8687 - protein, 10 aa, Artificial Sequence
  Description of Artificial Sequence: Synthetic peptide
  Seed: GADGVGKSAL (KRAS G12D)
GLDGVGKSAA

SEQ ID NO: 8688 - protein, 10 aa, Artificial Sequence
  Description of Artificial Sequence: Synthetic peptide
  Seed: GADGVGKSAL (KRAS G12D)
GLDGVGKSAF

SEQ ID NO: 8689 - protein, 10 aa, Artificial Sequence
  Description of Artificial Sequence: Synthetic peptide
  Seed: GADGVGKSAL (KRAS G12D)
GLDGVGKSAI

SEQ ID NO: 8690 - protein, 10 aa, Artificial Sequence
  Description of Artificial Sequence: Synthetic peptide
  Seed: GADGVGKSAL (KRAS G12D)
GLDGVGKSAK

SEQ ID NO: 8691 - protein, 10 aa, Artificial Sequence
  Description of Artificial Sequence: Synthetic peptide
  Seed: GADGVGKSAL (KRAS G12D)
GLDGVGKSAL

SEQ ID NO: 8692 - protein, 11 aa, Artificial Sequence
  Description of Artificial Sequence: Synthetic peptide
  Seed: GADGVGKSALT (KRAS G12D)
GLDGVGKSALF

SEQ ID NO: 8693 - protein, 11 aa, Artificial Sequence
  Description of Artificial Sequence: Synthetic peptide
  Seed: GADGVGKSALT (KRAS G12D)
GLDGVGKSALI

SEQ ID NO: 8694 - protein, 11 aa, Artificial Sequence
  Description of Artificial Sequence: Synthetic peptide
  Seed: GADGVGKSALT (KRAS G12D)
GLDGVGKSALL

SEQ ID NO: 8695 - protein, 11 aa, Artificial Sequence
  Description of Artificial Sequence: Synthetic peptide
  Seed: GADGVGKSALT (KRAS G12D)
GLDGVGKSALM

SEQ ID NO: 8696 - protein, 11 aa, Artificial Sequence
  Description of Artificial Sequence: Synthetic peptide
  Seed: GADGVGKSALT (KRAS G12D)
GLDGVGKSALV

SEQ ID NO: 8697 - protein, 11 aa, Artificial Sequence
  Description of Artificial Sequence: Synthetic peptide
  Seed: GADGVGKSALT (KRAS G12D)
GLDGVGKSALW

SEQ ID NO: 8698 - protein, 10 aa, Artificial Sequence
  Description of Artificial Sequence: Synthetic peptide
  Seed: GADGVGKSAL (KRAS G12D)
GLDGVGKSAM

SEQ ID NO: 8699 - protein, 10 aa, Artificial Sequence
  Description of Artificial Sequence: Synthetic peptide
  Seed: GADGVGKSAL (KRAS G12D)
GLDGVGKSAR

SEQ ID NO: 8700 - protein, 10 aa, Artificial Sequence
  Description of Artificial Sequence: Synthetic peptide
  Seed: GADGVGKSAL (KRAS G12D)
GLDGVGKSAV

SEQ ID NO: 8701 - protein, 10 aa, Artificial Sequence
  Description of Artificial Sequence: Synthetic peptide
  Seed: GADGVGKSAL (KRAS G12D)
GLDGVGKSAW

SEQ ID NO: 8702 - protein, 10 aa, Artificial Sequence
  Description of Artificial Sequence: Synthetic peptide
  Seed: GADGVGKSAL (KRAS G12D)
GLDGVGKSAY

SEQ ID NO: 8703 - protein, 9 aa, Artificial Sequence
  Description of Artificial Sequence: Synthetic peptide
  Seed: GADGVGKSA (KRAS G12D)
GLDGVGKSC

SEQ ID NO: 8704 - protein, 9 aa, Artificial Sequence
  Description of Artificial Sequence: Synthetic peptide
  Seed: GADGVGKSA (KRAS G12D)
GLDGVGKSF

SEQ ID NO: 8705 - protein, 9 aa, Artificial Sequence
  Description of Artificial Sequence: Synthetic peptide
  Seed: GADGVGKSA (KRAS G12D)
GLDGVGKSI

SEQ ID NO: 8706 - protein, 9 aa, Artificial Sequence
  Description of Artificial Sequence: Synthetic peptide
  Seed: GADGVGKSA (KRAS G12D)
GLDGVGKSK

SEQ ID NO: 8707 - protein, 9 aa, Artificial Sequence
  Description of Artificial Sequence: Synthetic peptide
  Seed: GADGVGKSA (KRAS G12D)
GLDGVGKSL

SEQ ID NO: 8708 - protein, 9 aa, Artificial Sequence
  Description of Artificial Sequence: Synthetic peptide
  Seed: GADGVGKSA (KRAS G12D)
GLDGVGKSM

SEQ ID NO: 8709 - protein, 9 aa, Artificial Sequence
  Description of Artificial Sequence: Synthetic peptide
  Seed: GADGVGKSA (KRAS G12D)
GLDGVGKSR

SEQ ID NO: 8710 - protein, 9 aa, Artificial Sequence
  Description of Artificial Sequence: Synthetic peptide
  Seed: GADGVGKSA (KRAS G12D)
GLDGVGKSV

SEQ ID NO: 8711 - protein, 9 aa, Artificial Sequence
  Description of Artificial Sequence: Synthetic peptide
  Seed: GADGVGKSA (KRAS G12D)
GLDGVGKSW

SEQ ID NO: 8712 - protein, 9 aa, Artificial Sequence
  Description of Artificial Sequence: Synthetic peptide
  Seed: GADGVGKSA (KRAS G12D)
GLDGVGKSY

SEQ ID NO: 8713 - protein, 9 aa, Artificial Sequence
  Description of Artificial Sequence: Synthetic peptide
  Seed: GADGVGKSA (KRAS G12D)
GMDGVGKSA

SEQ ID NO: 8714 - protein, 10 aa, Artificial Sequence
  Description of Artificial Sequence: Synthetic peptide
  Seed: GADGVGKSAL (KRAS G12D)
GMDGVGKSAA

SEQ ID NO: 8715 - protein, 10 aa, Artificial Sequence
  Description of Artificial Sequence: Synthetic peptide
  Seed: GADGVGKSAL (KRAS G12D)
GMDGVGKSAF

SEQ ID NO: 8716 - protein, 10 aa, Artificial Sequence
  Description of Artificial Sequence: Synthetic peptide
  Seed: GADGVGKSAL (KRAS G12D)
GMDGVGKSAI

SEQ ID NO: 8717 - protein, 10 aa, Artificial Sequence
  Description of Artificial Sequence: Synthetic peptide
  Seed: GADGVGKSAL (KRAS G12D)
GMDGVGKSAK

SEQ ID NO: 8718 - protein, 10 aa, Artificial Sequence
  Description of Artificial Sequence: Synthetic peptide
  Seed: GADGVGKSAL (KRAS G12D)
GMDGVGKSAL

SEQ ID NO: 8719 - protein, 11 aa, Artificial Sequence
  Description of Artificial Sequence: Synthetic peptide
  Seed: GADGVGKSALT (KRAS G12D)
GMDGVGKSALF

SEQ ID NO: 8720 - protein, 11 aa, Artificial Sequence
  Description of Artificial Sequence: Synthetic peptide
  Seed: GADGVGKSALT (KRAS G12D)
GMDGVGKSALI

SEQ ID NO: 8721 - protein, 11 aa, Artificial Sequence
  Description of Artificial Sequence: Synthetic peptide
  Seed: GADGVGKSALT (KRAS G12D)
GMDGVGKSALL

SEQ ID NO: 8722 - protein, 11 aa, Artificial Sequence
  Description of Artificial Sequence: Synthetic peptide
  Seed: GADGVGKSALT (KRAS G12D)
GMDGVGKSALM

SEQ ID NO: 8723 - protein, 11 aa, Artificial Sequence
  Description of Artificial Sequence: Synthetic peptide
  Seed: GADGVGKSALT (KRAS G12D)
GMDGVGKSALV

SEQ ID NO: 8724 - protein, 10 aa, Artificial Sequence
  Description of Artificial Sequence: Synthetic peptide
  Seed: GADGVGKSAL (KRAS G12D)
GMDGVGKSAM

SEQ ID NO: 8725 - protein, 10 aa, Artificial Sequence
  Description of Artificial Sequence: Synthetic peptide
  Seed: GADGVGKSAL (KRAS G12D)
GMDGVGKSAR

SEQ ID NO: 8726 - protein, 10 aa, Artificial Sequence
  Description of Artificial Sequence: Synthetic peptide
  Seed: GADGVGKSAL (KRAS G12D)
GMDGVGKSAV

SEQ ID NO: 8727 - protein, 10 aa, Artificial Sequence
  Description of Artificial Sequence: Synthetic peptide
  Seed: GADGVGKSAL (KRAS G12D)
GMDGVGKSAW

SEQ ID NO: 8728 - protein, 10 aa, Artificial Sequence
  Description of Artificial Sequence: Synthetic peptide
  Seed: GADGVGKSAL (KRAS G12D)
GMDGVGKSAY

SEQ ID NO: 8729 - protein, 9 aa, Artificial Sequence
  Description of Artificial Sequence: Synthetic peptide
  Seed: GADGVGKSA (KRAS G12D)
GMDGVGKSC

SEQ ID NO: 8730 - protein, 9 aa, Artificial Sequence
  Description of Artificial Sequence: Synthetic peptide
  Seed: GADGVGKSA (KRAS G12D)
GMDGVGKSF

SEQ ID NO: 8731 - protein, 9 aa, Artificial Sequence
  Description of Artificial Sequence: Synthetic peptide
  Seed: GADGVGKSA (KRAS G12D)
GMDGVGKSI

SEQ ID NO: 8732 - protein, 9 aa, Artificial Sequence
  Description of Artificial Sequence: Synthetic peptide
  Seed: GADGVGKSA (KRAS G12D)
GMDGVGKSK

SEQ ID NO: 8733 - protein, 9 aa, Artificial Sequence
  Description of Artificial Sequence: Synthetic peptide
  Seed: GADGVGKSA (KRAS G12D)
GMDGVGKSL

SEQ ID NO: 8734 - protein, 9 aa, Artificial Sequence
  Description of Artificial Sequence: Synthetic peptide
  Seed: GADGVGKSA (KRAS G12D)
GMDGVGKSM

SEQ ID NO: 8735 - protein, 9 aa, Artificial Sequence
  Description of Artificial Sequence: Synthetic peptide
  Seed: GADGVGKSA (KRAS G12D)
GMDGVGKSR

SEQ ID NO: 8736 - protein, 9 aa, Artificial Sequence
  Description of Artificial Sequence: Synthetic peptide
  Seed: GADGVGKSA (KRAS G12D)
GMDGVGKSV

SEQ ID NO: 8737 - protein, 9 aa, Artificial Sequence
  Description of Artificial Sequence: Synthetic peptide
  Seed: GADGVGKSA (KRAS G12D)
GMDGVGKSW

SEQ ID NO: 8738 - protein, 9 aa, Artificial Sequence
  Description of Artificial Sequence: Synthetic peptide
  Seed: GADGVGKSA (KRAS G12D)
GMDGVGKSY

SEQ ID NO: 8739 - protein, 10 aa, Artificial Sequence
  Description of Artificial Sequence: Synthetic peptide
  Seed: GADGVGKSAL (KRAS G12D)
GNDGVGKSAF

SEQ ID NO: 8740 - protein, 10 aa, Artificial Sequence
  Description of Artificial Sequence: Synthetic peptide
  Seed: GADGVGKSAL (KRAS G12D)
GNDGVGKSAI

SEQ ID NO: 8741 - protein, 10 aa, Artificial Sequence
  Description of Artificial Sequence: Synthetic peptide
  Seed: GADGVGKSAL (KRAS G12D)
GNDGVGKSAK

SEQ ID NO: 8742 - protein, 10 aa, Artificial Sequence
  Description of Artificial Sequence: Synthetic peptide
  Seed: GADGVGKSAL (KRAS G12D)
GNDGVGKSAL

SEQ ID NO: 8743 - protein, 11 aa, Artificial Sequence
  Description of Artificial Sequence: Synthetic peptide
  Seed: GADGVGKSALT (KRAS G12D)
GNDGVGKSALF

SEQ ID NO: 8744 - protein, 11 aa, Artificial Sequence
  Description of Artificial Sequence: Synthetic peptide
  Seed: GADGVGKSALT (KRAS G12D)
GNDGVGKSALL

SEQ ID NO: 8745 - protein, 11 aa, Artificial Sequence
  Description of Artificial Sequence: Synthetic peptide
  Seed: GADGVGKSALT (KRAS G12D)
GNDGVGKSALM

SEQ ID NO: 8746 - protein, 10 aa, Artificial Sequence
  Description of Artificial Sequence: Synthetic peptide
  Seed: GADGVGKSAL (KRAS G12D)
GNDGVGKSAM

SEQ ID NO: 8747 - protein, 10 aa, Artificial Sequence
  Description of Artificial Sequence: Synthetic peptide
  Seed: GADGVGKSAL (KRAS G12D)
GNDGVGKSAR

SEQ ID NO: 8748 - protein, 10 aa, Artificial Sequence
  Description of Artificial Sequence: Synthetic peptide
  Seed: GADGVGKSAL (KRAS G12D)
GNDGVGKSAV

SEQ ID NO: 8749 - protein, 10 aa, Artificial Sequence
  Description of Artificial Sequence: Synthetic peptide
  Seed: GADGVGKSAL (KRAS G12D)
GNDGVGKSAY

SEQ ID NO: 8750 - protein, 9 aa, Artificial Sequence
  Description of Artificial Sequence: Synthetic peptide
  Seed: GADGVGKSA (KRAS G12D)
GNDGVGKSF

SEQ ID NO: 8751 - protein, 9 aa, Artificial Sequence
  Description of Artificial Sequence: Synthetic peptide
  Seed: GADGVGKSA (KRAS G12D)
GNDGVGKSI

SEQ ID NO: 8752 - protein, 9 aa, Artificial Sequence
  Description of Artificial Sequence: Synthetic peptide
  Seed: GADGVGKSA (KRAS G12D)
GNDGVGKSK

SEQ ID NO: 8753 - protein, 9 aa, Artificial Sequence
  Description of Artificial Sequence: Synthetic peptide
  Seed: GADGVGKSA (KRAS G12D)
GNDGVGKSL

SEQ ID NO: 8754 - protein, 9 aa, Artificial Sequence
  Description of Artificial Sequence: Synthetic peptide
  Seed: GADGVGKSA (KRAS G12D)
GNDGVGKSM

SEQ ID NO: 8755 - protein, 9 aa, Artificial Sequence
  Description of Artificial Sequence: Synthetic peptide
  Seed: GADGVGKSA (KRAS G12D)
GNDGVGKSR

SEQ ID NO: 8756 - protein, 9 aa, Artificial Sequence
  Description of Artificial Sequence: Synthetic peptide
  Seed: GADGVGKSA (KRAS G12D)
GNDGVGKSV

SEQ ID NO: 8757 - protein, 9 aa, Artificial Sequence
  Description of Artificial Sequence: Synthetic peptide
  Seed: GADGVGKSA (KRAS G12D)
GNDGVGKSY

SEQ ID NO: 8758 - protein, 9 aa, Artificial Sequence
  Description of Artificial Sequence: Synthetic peptide
  Seed: GADGVGKSA (KRAS G12D)
GPDGVGKSA

SEQ ID NO: 8759 - protein, 10 aa, Artificial Sequence
  Description of Artificial Sequence: Synthetic peptide
  Seed: GADGVGKSAL (KRAS G12D)
GPDGVGKSAA

SEQ ID NO: 8760 - protein, 10 aa, Artificial Sequence
  Description of Artificial Sequence: Synthetic peptide
  Seed: GADGVGKSAL (KRAS G12D)
GPDGVGKSAC

SEQ ID NO: 8761 - protein, 10 aa, Artificial Sequence
  Description of Artificial Sequence: Synthetic peptide
  Seed: GADGVGKSAL (KRAS G12D)
GPDGVGKSAF

SEQ ID NO: 8762 - protein, 10 aa, Artificial Sequence
  Description of Artificial Sequence: Synthetic peptide
  Seed: GADGVGKSAL (KRAS G12D)
GPDGVGKSAI

SEQ ID NO: 8763 - protein, 10 aa, Artificial Sequence
  Description of Artificial Sequence: Synthetic peptide
  Seed: GADGVGKSAL (KRAS G12D)
GPDGVGKSAK

SEQ ID NO: 8764 - protein, 10 aa, Artificial Sequence
  Description of Artificial Sequence: Synthetic peptide
  Seed: GADGVGKSAL (KRAS G12D)
GPDGVGKSAL

SEQ ID NO: 8765 - protein, 11 aa, Artificial Sequence
  Description of Artificial Sequence: Synthetic peptide
  Seed: GADGVGKSALT (KRAS G12D)
GPDGVGKSALF

SEQ ID NO: 8766 - protein, 11 aa, Artificial Sequence
  Description of Artificial Sequence: Synthetic peptide
  Seed: GADGVGKSALT (KRAS G12D)
GPDGVGKSALI

SEQ ID NO: 8767 - protein, 11 aa, Artificial Sequence
  Description of Artificial Sequence: Synthetic peptide
  Seed: GADGVGKSALT (KRAS G12D)
GPDGVGKSALL

SEQ ID NO: 8768 - protein, 11 aa, Artificial Sequence
  Description of Artificial Sequence: Synthetic peptide
  Seed: GADGVGKSALT (KRAS G12D)
GPDGVGKSALM

SEQ ID NO: 8769 - protein, 10 aa, Artificial Sequence
  Description of Artificial Sequence: Synthetic peptide
  Seed: GADGVGKSAL (KRAS G12D)
GPDGVGKSAM

SEQ ID NO: 8770 - protein, 10 aa, Artificial Sequence
  Description of Artificial Sequence: Synthetic peptide
  Seed: GADGVGKSAL (KRAS G12D)
GPDGVGKSAP

SEQ ID NO: 8771 - protein, 10 aa, Artificial Sequence
  Description of Artificial Sequence: Synthetic peptide
  Seed: GADGVGKSAL (KRAS G12D)
GPDGVGKSAT

SEQ ID NO: 8772 - protein, 10 aa, Artificial Sequence
  Description of Artificial Sequence: Synthetic peptide
  Seed: GADGVGKSAL (KRAS G12D)
GPDGVGKSAV

SEQ ID NO: 8773 - protein, 10 aa, Artificial Sequence
  Description of Artificial Sequence: Synthetic peptide
  Seed: GADGVGKSAL (KRAS G12D)
GPDGVGKSAW

SEQ ID NO: 8774 - protein, 10 aa, Artificial Sequence
  Description of Artificial Sequence: Synthetic peptide
  Seed: GADGVGKSAL (KRAS G12D)
GPDGVGKSAY

SEQ ID NO: 8775 - protein, 9 aa, Artificial Sequence
  Description of Artificial Sequence: Synthetic peptide
  Seed: GADGVGKSA (KRAS G12D)
GPDGVGKSC

SEQ ID NO: 8776 - protein, 9 aa, Artificial Sequence
  Description of Artificial Sequence: Synthetic peptide
  Seed: GADGVGKSA (KRAS G12D)
GPDGVGKSF

SEQ ID NO: 8777 - protein, 9 aa, Artificial Sequence
  Description of Artificial Sequence: Synthetic peptide
  Seed: GADGVGKSA (KRAS G12D)
GPDGVGKSG

SEQ ID NO: 8778 - protein, 9 aa, Artificial Sequence
  Description of Artificial Sequence: Synthetic peptide
  Seed: GADGVGKSA (KRAS G12D)
GPDGVGKSI

SEQ ID NO: 8779 - protein, 9 aa, Artificial Sequence
  Description of Artificial Sequence: Synthetic peptide
  Seed: GADGVGKSA (KRAS G12D)
GPDGVGKSK

SEQ ID NO: 8780 - protein, 9 aa, Artificial Sequence
  Description of Artificial Sequence: Synthetic peptide
  Seed: GADGVGKSA (KRAS G12D)
GPDGVGKSL

SEQ ID NO: 8781 - protein, 9 aa, Artificial Sequence
  Description of Artificial Sequence: Synthetic peptide
  Seed: GADGVGKSA (KRAS G12D)
GPDGVGKSM

SEQ ID NO: 8782 - protein, 9 aa, Artificial Sequence
  Description of Artificial Sequence: Synthetic peptide
  Seed: GADGVGKSA (KRAS G12D)
GPDGVGKSP

SEQ ID NO: 8783 - protein, 9 aa, Artificial Sequence
  Description of Artificial Sequence: Synthetic peptide
  Seed: GADGVGKSA (KRAS G12D)
GPDGVGKSR

SEQ ID NO: 8784 - protein, 9 aa, Artificial Sequence
  Description of Artificial Sequence: Synthetic peptide
  Seed: GADGVGKSA (KRAS G12D)
GPDGVGKSS

SEQ ID NO: 8785 - protein, 9 aa, Artificial Sequence
  Description of Artificial Sequence: Synthetic peptide
  Seed: GADGVGKSA (KRAS G12D)
GPDGVGKST

SEQ ID NO: 8786 - protein, 9 aa, Artificial Sequence
  Description of Artificial Sequence: Synthetic peptide
  Seed: GADGVGKSA (KRAS G12D)
GPDGVGKSV

SEQ ID NO: 8787 - protein, 9 aa, Artificial Sequence
  Description of Artificial Sequence: Synthetic peptide
  Seed: GADGVGKSA (KRAS G12D)
GPDGVGKSY

SEQ ID NO: 8788 - protein, 10 aa, Artificial Sequence
  Description of Artificial Sequence: Synthetic peptide
  Seed: GADGVGKSAL (KRAS G12D)
GQDGVGKSAF

SEQ ID NO: 8789 - protein, 10 aa, Artificial Sequence
  Description of Artificial Sequence: Synthetic peptide
  Seed: GADGVGKSAL (KRAS G12D)
GQDGVGKSAI

SEQ ID NO: 8790 - protein, 10 aa, Artificial Sequence
  Description of Artificial Sequence: Synthetic peptide
  Seed: GADGVGKSAL (KRAS G12D)
GQDGVGKSAK

SEQ ID NO: 8791 - protein, 10 aa, Artificial Sequence
  Description of Artificial Sequence: Synthetic peptide
  Seed: GADGVGKSAL (KRAS G12D)
GQDGVGKSAL

SEQ ID NO: 8792 - protein, 11 aa, Artificial Sequence
  Description of Artificial Sequence: Synthetic peptide
  Seed: GADGVGKSALT (KRAS G12D)
GQDGVGKSALF

SEQ ID NO: 8793 - protein, 11 aa, Artificial Sequence
  Description of Artificial Sequence: Synthetic peptide
  Seed: GADGVGKSALT (KRAS G12D)
GQDGVGKSALL

SEQ ID NO: 8794 - protein, 11 aa, Artificial Sequence
  Description of Artificial Sequence: Synthetic peptide
  Seed: GADGVGKSALT (KRAS G12D)
GQDGVGKSALM

SEQ ID NO: 8795 - protein, 10 aa, Artificial Sequence
  Description of Artificial Sequence: Synthetic peptide
  Seed: GADGVGKSAL (KRAS G12D)
GQDGVGKSAM

SEQ ID NO: 8796 - protein, 10 aa, Artificial Sequence
  Description of Artificial Sequence: Synthetic peptide
  Seed: GADGVGKSAL (KRAS G12D)
GQDGVGKSAR

SEQ ID NO: 8797 - protein, 10 aa, Artificial Sequence
  Description of Artificial Sequence: Synthetic peptide
  Seed: GADGVGKSAL (KRAS G12D)
GQDGVGKSAV

SEQ ID NO: 8798 - protein, 10 aa, Artificial Sequence
  Description of Artificial Sequence: Synthetic peptide
  Seed: GADGVGKSAL (KRAS G12D)
GQDGVGKSAY

SEQ ID NO: 8799 - protein, 9 aa, Artificial Sequence
  Description of Artificial Sequence: Synthetic peptide
  Seed: GADGVGKSA (KRAS G12D)
GQDGVGKSF

SEQ ID NO: 8800 - protein, 9 aa, Artificial Sequence
  Description of Artificial Sequence: Synthetic peptide
  Seed: GADGVGKSA (KRAS G12D)
GQDGVGKSI

SEQ ID NO: 8801 - protein, 9 aa, Artificial Sequence
  Description of Artificial Sequence: Synthetic peptide
  Seed: GADGVGKSA (KRAS G12D)
GQDGVGKSK

SEQ ID NO: 8802 - protein, 9 aa, Artificial Sequence
  Description of Artificial Sequence: Synthetic peptide
  Seed: GADGVGKSA (KRAS G12D)
GQDGVGKSL

SEQ ID NO: 8803 - protein, 9 aa, Artificial Sequence
  Description of Artificial Sequence: Synthetic peptide
  Seed: GADGVGKSA (KRAS G12D)
GQDGVGKSM

SEQ ID NO: 8804 - protein, 9 aa, Artificial Sequence
  Description of Artificial Sequence: Synthetic peptide
  Seed: GADGVGKSA (KRAS G12D)
GQDGVGKSR

SEQ ID NO: 8805 - protein, 9 aa, Artificial Sequence
  Description of Artificial Sequence: Synthetic peptide
  Seed: GADGVGKSA (KRAS G12D)
GQDGVGKSV

SEQ ID NO: 8806 - protein, 9 aa, Artificial Sequence
  Description of Artificial Sequence: Synthetic peptide
  Seed: GADGVGKSA (KRAS G12D)
GQDGVGKSW

SEQ ID NO: 8807 - protein, 9 aa, Artificial Sequence
  Description of Artificial Sequence: Synthetic peptide
  Seed: GADGVGKSA (KRAS G12D)
GQDGVGKSY

SEQ ID NO: 8808 - protein, 9 aa, Artificial Sequence
  Description of Artificial Sequence: Synthetic peptide
  Seed: GADGVGKSA (KRAS G12D)
GRDGVGKSA

SEQ ID NO: 8809 - protein, 10 aa, Artificial Sequence
  Description of Artificial Sequence: Synthetic peptide
  Seed: GADGVGKSAL (KRAS G12D)
GRDGVGKSAC

SEQ ID NO: 8810 - protein, 10 aa, Artificial Sequence
  Description of Artificial Sequence: Synthetic peptide
  Seed: GADGVGKSAL (KRAS G12D)
GRDGVGKSAF

SEQ ID NO: 8811 - protein, 10 aa, Artificial Sequence
  Description of Artificial Sequence: Synthetic peptide
  Seed: GADGVGKSAL (KRAS G12D)
GRDGVGKSAI

SEQ ID NO: 8812 - protein, 10 aa, Artificial Sequence
  Description of Artificial Sequence: Synthetic peptide
  Seed: GADGVGKSAL (KRAS G12D)
GRDGVGKSAL

SEQ ID NO: 8813 - protein, 10 aa, Artificial Sequence
  Description of Artificial Sequence: Synthetic peptide
  Seed: GADGVGKSAL (KRAS G12D)
GRDGVGKSAM

SEQ ID NO: 8814 - protein, 10 aa, Artificial Sequence
  Description of Artificial Sequence: Synthetic peptide
  Seed: GADGVGKSAL (KRAS G12D)
GRDGVGKSAV

SEQ ID NO: 8815 - protein, 10 aa, Artificial Sequence
  Description of Artificial Sequence: Synthetic peptide
  Seed: GADGVGKSAL (KRAS G12D)
GRDGVGKSAW

SEQ ID NO: 8816 - protein, 10 aa, Artificial Sequence
  Description of Artificial Sequence: Synthetic peptide
  Seed: GADGVGKSAL (KRAS G12D)
GRDGVGKSAY

SEQ ID NO: 8817 - protein, 9 aa, Artificial Sequence
  Description of Artificial Sequence: Synthetic peptide
  Seed: GADGVGKSA (KRAS G12D)
GRDGVGKSC

SEQ ID NO: 8818 - protein, 9 aa, Artificial Sequence
  Description of Artificial Sequence: Synthetic peptide
  Seed: GADGVGKSA (KRAS G12D)
GRDGVGKSF

SEQ ID NO: 8819 - protein, 9 aa, Artificial Sequence
  Description of Artificial Sequence: Synthetic peptide
  Seed: GADGVGKSA (KRAS G12D)
GRDGVGKSI

SEQ ID NO: 8820 - protein, 9 aa, Artificial Sequence
  Description of Artificial Sequence: Synthetic peptide
  Seed: GADGVGKSA (KRAS G12D)
GRDGVGKSL

SEQ ID NO: 8821 - protein, 9 aa, Artificial Sequence
  Description of Artificial Sequence: Synthetic peptide
  Seed: GADGVGKSA (KRAS G12D)
GRDGVGKSM

SEQ ID NO: 8822 - protein, 9 aa, Artificial Sequence
  Description of Artificial Sequence: Synthetic peptide
  Seed: GADGVGKSA (KRAS G12D)
GRDGVGKSV

SEQ ID NO: 8823 - protein, 9 aa, Artificial Sequence
  Description of Artificial Sequence: Synthetic peptide
  Seed: GADGVGKSA (KRAS G12D)
GRDGVGKSW

SEQ ID NO: 8824 - protein, 9 aa, Artificial Sequence
  Description of Artificial Sequence: Synthetic peptide
  Seed: GADGVGKSA (KRAS G12D)
GRDGVGKSY

SEQ ID NO: 8825 - protein, 9 aa, Artificial Sequence
  Description of Artificial Sequence: Synthetic peptide
  Seed: GADGVGKSA (KRAS G12D)
GSDGVGKSA

SEQ ID NO: 8826 - protein, 10 aa, Artificial Sequence
  Description of Artificial Sequence: Synthetic peptide
  Seed: GADGVGKSAL (KRAS G12D)
GSDGVGKSAA

SEQ ID NO: 8827 - protein, 10 aa, Artificial Sequence
  Description of Artificial Sequence: Synthetic peptide
  Seed: GADGVGKSAL (KRAS G12D)
GSDGVGKSAC

SEQ ID NO: 8828 - protein, 10 aa, Artificial Sequence
  Description of Artificial Sequence: Synthetic peptide
  Seed: GADGVGKSAL (KRAS G12D)
GSDGVGKSAF

SEQ ID NO: 8829 - protein, 10 aa, Artificial Sequence
  Description of Artificial Sequence: Synthetic peptide
  Seed: GADGVGKSAL (KRAS G12D)
GSDGVGKSAI

SEQ ID NO: 8830 - protein, 10 aa, Artificial Sequence
  Description of Artificial Sequence: Synthetic peptide
  Seed: GADGVGKSAL (KRAS G12D)
GSDGVGKSAK

SEQ ID NO: 8831 - protein, 10 aa, Artificial Sequence
  Description of Artificial Sequence: Synthetic peptide
  Seed: GADGVGKSAL (KRAS G12D)
GSDGVGKSAL

SEQ ID NO: 8832 - protein, 11 aa, Artificial Sequence
  Description of Artificial Sequence: Synthetic peptide
  Seed: GADGVGKSALT (KRAS G12D)
GSDGVGKSALA

SEQ ID NO: 8833 - protein, 11 aa, Artificial Sequence
  Description of Artificial Sequence: Synthetic peptide
  Seed: GADGVGKSALT (KRAS G12D)
GSDGVGKSALC

SEQ ID NO: 8834 - protein, 11 aa, Artificial Sequence
  Description of Artificial Sequence: Synthetic peptide
  Seed: GADGVGKSALT (KRAS G12D)
GSDGVGKSALF

SEQ ID NO: 8835 - protein, 11 aa, Artificial Sequence
  Description of Artificial Sequence: Synthetic peptide
  Seed: GADGVGKSALT (KRAS G12D)
GSDGVGKSALI

SEQ ID NO: 8836 - protein, 11 aa, Artificial Sequence
  Description of Artificial Sequence: Synthetic peptide
  Seed: GADGVGKSALT (KRAS G12D)
GSDGVGKSALL

SEQ ID NO: 8837 - protein, 11 aa, Artificial Sequence
  Description of Artificial Sequence: Synthetic peptide
  Seed: GADGVGKSALT (KRAS G12D)
GSDGVGKSALM

SEQ ID NO: 8838 - protein, 11 aa, Artificial Sequence
  Description of Artificial Sequence: Synthetic peptide
  Seed: GADGVGKSALT (KRAS G12D)
GSDGVGKSALV

SEQ ID NO: 8839 - protein, 11 aa, Artificial Sequence
  Description of Artificial Sequence: Synthetic peptide
  Seed: GADGVGKSALT (KRAS G12D)
GSDGVGKSALW

SEQ ID NO: 8840 - protein, 11 aa, Artificial Sequence
  Description of Artificial Sequence: Synthetic peptide
  Seed: GADGVGKSALT (KRAS G12D)
GSDGVGKSALY

SEQ ID NO: 8841 - protein, 10 aa, Artificial Sequence
  Description of Artificial Sequence: Synthetic peptide
  Seed: GADGVGKSAL (KRAS G12D)
GSDGVGKSAM

SEQ ID NO: 8842 - protein, 10 aa, Artificial Sequence
  Description of Artificial Sequence: Synthetic peptide
  Seed: GADGVGKSAL (KRAS G12D)
GSDGVGKSAR

SEQ ID NO: 8843 - protein, 10 aa, Artificial Sequence
  Description of Artificial Sequence: Synthetic peptide
  Seed: GADGVGKSAL (KRAS G12D)
GSDGVGKSAV

SEQ ID NO: 8844 - protein, 10 aa, Artificial Sequence
  Description of Artificial Sequence: Synthetic peptide
  Seed: GADGVGKSAL (KRAS G12D)
GSDGVGKSAW

SEQ ID NO: 8845 - protein, 10 aa, Artificial Sequence
  Description of Artificial Sequence: Synthetic peptide
  Seed: GADGVGKSAL (KRAS G12D)
GSDGVGKSAY

SEQ ID NO: 8846 - protein, 9 aa, Artificial Sequence
  Description of Artificial Sequence: Synthetic peptide
  Seed: GADGVGKSA (KRAS G12D)
GSDGVGKSC

SEQ ID NO: 8847 - protein, 9 aa, Artificial Sequence
  Description of Artificial Sequence: Synthetic peptide
  Seed: GADGVGKSA (KRAS G12D)
GSDGVGKSF

SEQ ID NO: 8848 - protein, 9 aa, Artificial Sequence
  Description of Artificial Sequence: Synthetic peptide
  Seed: GADGVGKSA (KRAS G12D)
GSDGVGKSH

SEQ ID NO: 8849 - protein, 9 aa, Artificial Sequence
  Description of Artificial Sequence: Synthetic peptide
  Seed: GADGVGKSA (KRAS G12D)
GSDGVGKSI

SEQ ID NO: 8850 - protein, 9 aa, Artificial Sequence
  Description of Artificial Sequence: Synthetic peptide
  Seed: GADGVGKSA (KRAS G12D)
GSDGVGKSK

SEQ ID NO: 8851 - protein, 9 aa, Artificial Sequence
  Description of Artificial Sequence: Synthetic peptide
  Seed: GADGVGKSA (KRAS G12D)
GSDGVGKSL

SEQ ID NO: 8852 - protein, 9 aa, Artificial Sequence
  Description of Artificial Sequence: Synthetic peptide
  Seed: GADGVGKSA (KRAS G12D)
GSDGVGKSM

SEQ ID NO: 8853 - protein, 9 aa, Artificial Sequence
  Description of Artificial Sequence: Synthetic peptide
  Seed: GADGVGKSA (KRAS G12D)
GSDGVGKSR

SEQ ID NO: 8854 - protein, 9 aa, Artificial Sequence
  Description of Artificial Sequence: Synthetic peptide
  Seed: GADGVGKSA (KRAS G12D)
GSDGVGKST

SEQ ID NO: 8855 - protein, 9 aa, Artificial Sequence
  Description of Artificial Sequence: Synthetic peptide
  Seed: GADGVGKSA (KRAS G12D)
GSDGVGKSV

SEQ ID NO: 8856 - protein, 9 aa, Artificial Sequence
  Description of Artificial Sequence: Synthetic peptide
  Seed: GADGVGKSA (KRAS G12D)
GSDGVGKSW

SEQ ID NO: 8857 - protein, 9 aa, Artificial Sequence
  Description of Artificial Sequence: Synthetic peptide
  Seed: GADGVGKSA (KRAS G12D)
GSDGVGKSY

SEQ ID NO: 8858 - protein, 9 aa, Artificial Sequence
  Description of Artificial Sequence: Synthetic peptide
  Seed: GADGVGKSA (KRAS G12D)
GTDGVGKSA

SEQ ID NO: 8859 - protein, 10 aa, Artificial Sequence
  Description of Artificial Sequence: Synthetic peptide
  Seed: GADGVGKSAL (KRAS G12D)
GTDGVGKSAC

SEQ ID NO: 8860 - protein, 10 aa, Artificial Sequence
  Description of Artificial Sequence: Synthetic peptide
  Seed: GADGVGKSAL (KRAS G12D)
GTDGVGKSAF

SEQ ID NO: 8861 - protein, 10 aa, Artificial Sequence
  Description of Artificial Sequence: Synthetic peptide
  Seed: GADGVGKSAL (KRAS G12D)
GTDGVGKSAI

SEQ ID NO: 8862 - protein, 10 aa, Artificial Sequence
  Description of Artificial Sequence: Synthetic peptide
  Seed: GADGVGKSAL (KRAS G12D)
GTDGVGKSAK

SEQ ID NO: 8863 - protein, 10 aa, Artificial Sequence
  Description of Artificial Sequence: Synthetic peptide
  Seed: GADGVGKSAL (KRAS G12D)
GTDGVGKSAL

SEQ ID NO: 8864 - protein, 11 aa, Artificial Sequence
  Description of Artificial Sequence: Synthetic peptide
  Seed: GADGVGKSALT (KRAS G12D)
GTDGVGKSALC

SEQ ID NO: 8865 - protein, 11 aa, Artificial Sequence
  Description of Artificial Sequence: Synthetic peptide
  Seed: GADGVGKSALT (KRAS G12D)
GTDGVGKSALF

SEQ ID NO: 8866 - protein, 11 aa, Artificial Sequence
  Description of Artificial Sequence: Synthetic peptide
  Seed: GADGVGKSALT (KRAS G12D)
GTDGVGKSALI

SEQ ID NO: 8867 - protein, 11 aa, Artificial Sequence
  Description of Artificial Sequence: Synthetic peptide
  Seed: GADGVGKSALT (KRAS G12D)
GTDGVGKSALL

SEQ ID NO: 8868 - protein, 11 aa, Artificial Sequence
  Description of Artificial Sequence: Synthetic peptide
  Seed: GADGVGKSALT (KRAS G12D)
GTDGVGKSALM

SEQ ID NO: 8869 - protein, 11 aa, Artificial Sequence
  Description of Artificial Sequence: Synthetic peptide
  Seed: GADGVGKSALT (KRAS G12D)
GTDGVGKSALV

SEQ ID NO: 8870 - protein, 11 aa, Artificial Sequence
  Description of Artificial Sequence: Synthetic peptide
  Seed: GADGVGKSALT (KRAS G12D)
GTDGVGKSALW

SEQ ID NO: 8871 - protein, 11 aa, Artificial Sequence
  Description of Artificial Sequence: Synthetic peptide
  Seed: GADGVGKSALT (KRAS G12D)
GTDGVGKSALY

SEQ ID NO: 8872 - protein, 10 aa, Artificial Sequence
  Description of Artificial Sequence: Synthetic peptide
  Seed: GADGVGKSAL (KRAS G12D)
GTDGVGKSAM

SEQ ID NO: 8873 - protein, 10 aa, Artificial Sequence
  Description of Artificial Sequence: Synthetic peptide
  Seed: GADGVGKSAL (KRAS G12D)
GTDGVGKSAR

SEQ ID NO: 8874 - protein, 10 aa, Artificial Sequence
  Description of Artificial Sequence: Synthetic peptide
  Seed: GADGVGKSAL (KRAS G12D)
GTDGVGKSAV

SEQ ID NO: 8875 - protein, 10 aa, Artificial Sequence
  Description of Artificial Sequence: Synthetic peptide
  Seed: GADGVGKSAL (KRAS G12D)
GTDGVGKSAW

SEQ ID NO: 8876 - protein, 10 aa, Artificial Sequence
  Description of Artificial Sequence: Synthetic peptide
  Seed: GADGVGKSAL (KRAS G12D)
GTDGVGKSAY

SEQ ID NO: 8877 - protein, 9 aa, Artificial Sequence
  Description of Artificial Sequence: Synthetic peptide
  Seed: GADGVGKSA (KRAS G12D)
GTDGVGKSC

SEQ ID NO: 8878 - protein, 9 aa, Artificial Sequence
  Description of Artificial Sequence: Synthetic peptide
  Seed: GADGVGKSA (KRAS G12D)
GTDGVGKSF

SEQ ID NO: 8879 - protein, 9 aa, Artificial Sequence
  Description of Artificial Sequence: Synthetic peptide
  Seed: GADGVGKSA (KRAS G12D)
GTDGVGKSH

SEQ ID NO: 8880 - protein, 9 aa, Artificial Sequence
  Description of Artificial Sequence: Synthetic peptide
  Seed: GADGVGKSA (KRAS G12D)
GTDGVGKSI

SEQ ID NO: 8881 - protein, 9 aa, Artificial Sequence
  Description of Artificial Sequence: Synthetic peptide
  Seed: GADGVGKSA (KRAS G12D)
GTDGVGKSK

SEQ ID NO: 8882 - protein, 9 aa, Artificial Sequence
  Description of Artificial Sequence: Synthetic peptide
  Seed: GADGVGKSA (KRAS G12D)
GTDGVGKSL

SEQ ID NO: 8883 - protein, 9 aa, Artificial Sequence
  Description of Artificial Sequence: Synthetic peptide
  Seed: GADGVGKSA (KRAS G12D)
GTDGVGKSM

SEQ ID NO: 8884 - protein, 9 aa, Artificial Sequence
  Description of Artificial Sequence: Synthetic peptide
  Seed: GADGVGKSA (KRAS G12D)
GTDGVGKSR

SEQ ID NO: 8885 - protein, 9 aa, Artificial Sequence
  Description of Artificial Sequence: Synthetic peptide
  Seed: GADGVGKSA (KRAS G12D)
GTDGVGKST

SEQ ID NO: 8886 - protein, 9 aa, Artificial Sequence
  Description of Artificial Sequence: Synthetic peptide
  Seed: GADGVGKSA (KRAS G12D)
GTDGVGKSV

SEQ ID NO: 8887 - protein, 9 aa, Artificial Sequence
  Description of Artificial Sequence: Synthetic peptide
  Seed: GADGVGKSA (KRAS G12D)
GTDGVGKSW

SEQ ID NO: 8888 - protein, 9 aa, Artificial Sequence
  Description of Artificial Sequence: Synthetic peptide
  Seed: GADGVGKSA (KRAS G12D)
GTDGVGKSY

SEQ ID NO: 8889 - protein, 9 aa, Artificial Sequence
  Description of Artificial Sequence: Synthetic peptide
  Seed: GADGVGKSA (KRAS G12D)
GVDGVGKSA

SEQ ID NO: 8890 - protein, 10 aa, Artificial Sequence
  Description of Artificial Sequence: Synthetic peptide
  Seed: GADGVGKSAL (KRAS G12D)
GVDGVGKSAC

SEQ ID NO: 8891 - protein, 10 aa, Artificial Sequence
  Description of Artificial Sequence: Synthetic peptide
  Seed: GADGVGKSAL (KRAS G12D)
GVDGVGKSAF

SEQ ID NO: 8892 - protein, 10 aa, Artificial Sequence
  Description of Artificial Sequence: Synthetic peptide
  Seed: GADGVGKSAL (KRAS G12D)
GVDGVGKSAI

SEQ ID NO: 8893 - protein, 10 aa, Artificial Sequence
  Description of Artificial Sequence: Synthetic peptide
  Seed: GADGVGKSAL (KRAS G12D)
GVDGVGKSAK

SEQ ID NO: 8894 - protein, 10 aa, Artificial Sequence
  Description of Artificial Sequence: Synthetic peptide
  Seed: GADGVGKSAL (KRAS G12D)
GVDGVGKSAL

SEQ ID NO: 8895 - protein, 11 aa, Artificial Sequence
  Description of Artificial Sequence: Synthetic peptide
  Seed: GADGVGKSALT (KRAS G12D)
GVDGVGKSALC

SEQ ID NO: 8896 - protein, 11 aa, Artificial Sequence
  Description of Artificial Sequence: Synthetic peptide
  Seed: GADGVGKSALT (KRAS G12D)
GVDGVGKSALF

SEQ ID NO: 8897 - protein, 11 aa, Artificial Sequence
  Description of Artificial Sequence: Synthetic peptide
  Seed: GADGVGKSALT (KRAS G12D)
GVDGVGKSALI

SEQ ID NO: 8898 - protein, 11 aa, Artificial Sequence
  Description of Artificial Sequence: Synthetic peptide
  Seed: GADGVGKSALT (KRAS G12D)
GVDGVGKSALL

SEQ ID NO: 8899 - protein, 11 aa, Artificial Sequence
  Description of Artificial Sequence: Synthetic peptide
  Seed: GADGVGKSALT (KRAS G12D)
GVDGVGKSALM

SEQ ID NO: 8900 - protein, 11 aa, Artificial Sequence
  Description of Artificial Sequence: Synthetic peptide
  Seed: GADGVGKSALT (KRAS G12D)
GVDGVGKSALV

SEQ ID NO: 8901 - protein, 11 aa, Artificial Sequence
  Description of Artificial Sequence: Synthetic peptide
  Seed: GADGVGKSALT (KRAS G12D)
GVDGVGKSALW

SEQ ID NO: 8902 - protein, 11 aa, Artificial Sequence
  Description of Artificial Sequence: Synthetic peptide
  Seed: GADGVGKSALT (KRAS G12D)
GVDGVGKSALY

SEQ ID NO: 8903 - protein, 10 aa, Artificial Sequence
  Description of Artificial Sequence: Synthetic peptide
  Seed: GADGVGKSAL (KRAS G12D)
GVDGVGKSAM

SEQ ID NO: 8904 - protein, 10 aa, Artificial Sequence
  Description of Artificial Sequence: Synthetic peptide
  Seed: GADGVGKSAL (KRAS G12D)
GVDGVGKSAR

SEQ ID NO: 8905 - protein, 10 aa, Artificial Sequence
  Description of Artificial Sequence: Synthetic peptide
  Seed: GADGVGKSAL (KRAS G12D)
GVDGVGKSAV

SEQ ID NO: 8906 - protein, 10 aa, Artificial Sequence
  Description of Artificial Sequence: Synthetic peptide
  Seed: GADGVGKSAL (KRAS G12D)
GVDGVGKSAW

SEQ ID NO: 8907 - protein, 10 aa, Artificial Sequence
  Description of Artificial Sequence: Synthetic peptide
  Seed: GADGVGKSAL (KRAS G12D)
GVDGVGKSAY

SEQ ID NO: 8908 - protein, 9 aa, Artificial Sequence
  Description of Artificial Sequence: Synthetic peptide
  Seed: GADGVGKSA (KRAS G12D)
GVDGVGKSC

SEQ ID NO: 8909 - protein, 9 aa, Artificial Sequence
  Description of Artificial Sequence: Synthetic peptide
  Seed: GADGVGKSA (KRAS G12D)
GVDGVGKSF

SEQ ID NO: 8910 - protein, 9 aa, Artificial Sequence
  Description of Artificial Sequence: Synthetic peptide
  Seed: GADGVGKSA (KRAS G12D)
GVDGVGKSH

SEQ ID NO: 8911 - protein, 9 aa, Artificial Sequence
  Description of Artificial Sequence: Synthetic peptide
  Seed: GADGVGKSA (KRAS G12D)
GVDGVGKSI

SEQ ID NO: 8912 - protein, 9 aa, Artificial Sequence
  Description of Artificial Sequence: Synthetic peptide
  Seed: GADGVGKSA (KRAS G12D)
GVDGVGKSK

SEQ ID NO: 8913 - protein, 9 aa, Artificial Sequence
  Description of Artificial Sequence: Synthetic peptide
  Seed: GADGVGKSA (KRAS G12D)
GVDGVGKSL

SEQ ID NO: 8914 - protein, 9 aa, Artificial Sequence
  Description of Artificial Sequence: Synthetic peptide
  Seed: GADGVGKSA (KRAS G12D)
GVDGVGKSM

SEQ ID NO: 8915 - protein, 9 aa, Artificial Sequence
  Description of Artificial Sequence: Synthetic peptide
  Seed: GADGVGKSA (KRAS G12D)
GVDGVGKSR

SEQ ID NO: 8916 - protein, 9 aa, Artificial Sequence
  Description of Artificial Sequence: Synthetic peptide
  Seed: GADGVGKSA (KRAS G12D)
GVDGVGKST

SEQ ID NO: 8917 - protein, 9 aa, Artificial Sequence
  Description of Artificial Sequence: Synthetic peptide
  Seed: GADGVGKSA (KRAS G12D)
GVDGVGKSV

SEQ ID NO: 8918 - protein, 9 aa, Artificial Sequence
  Description of Artificial Sequence: Synthetic peptide
  Seed: GADGVGKSA (KRAS G12D)
GVDGVGKSW

SEQ ID NO: 8919 - protein, 9 aa, Artificial Sequence
  Description of Artificial Sequence: Synthetic peptide
  Seed: GADGVGKSA (KRAS G12D)
GVDGVGKSY

SEQ ID NO: 8920 - protein, 10 aa, Artificial Sequence
  Description of Artificial Sequence: Synthetic peptide
  Seed: GADGVGKSAL (KRAS G12D)
GWDGVGKSAC

SEQ ID NO: 8921 - protein, 10 aa, Artificial Sequence
  Description of Artificial Sequence: Synthetic peptide
  Seed: GADGVGKSAL (KRAS G12D)
GWDGVGKSAF

SEQ ID NO: 8922 - protein, 10 aa, Artificial Sequence
  Description of Artificial Sequence: Synthetic peptide
  Seed: GADGVGKSAL (KRAS G12D)
GWDGVGKSAI

SEQ ID NO: 8923 - protein, 10 aa, Artificial Sequence
  Description of Artificial Sequence: Synthetic peptide
  Seed: GADGVGKSAL (KRAS G12D)
GWDGVGKSAK

SEQ ID NO: 8924 - protein, 10 aa, Artificial Sequence
  Description of Artificial Sequence: Synthetic peptide
  Seed: GADGVGKSAL (KRAS G12D)
GWDGVGKSAL

SEQ ID NO: 8925 - protein, 11 aa, Artificial Sequence
  Description of Artificial Sequence: Synthetic peptide
  Seed: GADGVGKSALT (KRAS G12D)
GWDGVGKSALL

SEQ ID NO: 8926 - protein, 11 aa, Artificial Sequence
  Description of Artificial Sequence: Synthetic peptide
  Seed: GADGVGKSALT (KRAS G12D)
GWDGVGKSALM

SEQ ID NO: 8927 - protein, 10 aa, Artificial Sequence
  Description of Artificial Sequence: Synthetic peptide
  Seed: GADGVGKSAL (KRAS G12D)
GWDGVGKSAM

SEQ ID NO: 8928 - protein, 10 aa, Artificial Sequence
  Description of Artificial Sequence: Synthetic peptide
  Seed: GADGVGKSAL (KRAS G12D)
GWDGVGKSAR

SEQ ID NO: 8929 - protein, 10 aa, Artificial Sequence
  Description of Artificial Sequence: Synthetic peptide
  Seed: GADGVGKSAL (KRAS G12D)
GWDGVGKSAV

SEQ ID NO: 8930 - protein, 10 aa, Artificial Sequence
  Description of Artificial Sequence: Synthetic peptide
  Seed: GADGVGKSAL (KRAS G12D)
GWDGVGKSAW

SEQ ID NO: 8931 - protein, 10 aa, Artificial Sequence
  Description of Artificial Sequence: Synthetic peptide
  Seed: GADGVGKSAL (KRAS G12D)
GWDGVGKSAY

SEQ ID NO: 8932 - protein, 9 aa, Artificial Sequence
  Description of Artificial Sequence: Synthetic peptide
  Seed: GADGVGKSA (KRAS G12D)
GWDGVGKSC

SEQ ID NO: 8933 - protein, 9 aa, Artificial Sequence
  Description of Artificial Sequence: Synthetic peptide
  Seed: GADGVGKSA (KRAS G12D)
GWDGVGKSF

SEQ ID NO: 8934 - protein, 9 aa, Artificial Sequence
  Description of Artificial Sequence: Synthetic peptide
  Seed: GADGVGKSA (KRAS G12D)
GWDGVGKSI

SEQ ID NO: 8935 - protein, 9 aa, Artificial Sequence
  Description of Artificial Sequence: Synthetic peptide
  Seed: GADGVGKSA (KRAS G12D)
GWDGVGKSK

SEQ ID NO: 8936 - protein, 9 aa, Artificial Sequence
  Description of Artificial Sequence: Synthetic peptide
  Seed: GADGVGKSA (KRAS G12D)
GWDGVGKSL

SEQ ID NO: 8937 - protein, 9 aa, Artificial Sequence
  Description of Artificial Sequence: Synthetic peptide
  Seed: GADGVGKSA (KRAS G12D)
GWDGVGKSM

SEQ ID NO: 8938 - protein, 9 aa, Artificial Sequence
  Description of Artificial Sequence: Synthetic peptide
  Seed: GADGVGKSA (KRAS G12D)
GWDGVGKSR

SEQ ID NO: 8939 - protein, 9 aa, Artificial Sequence
  Description of Artificial Sequence: Synthetic peptide
  Seed: GADGVGKSA (KRAS G12D)
GWDGVGKSV

SEQ ID NO: 8940 - protein, 9 aa, Artificial Sequence
  Description of Artificial Sequence: Synthetic peptide
  Seed: GADGVGKSA (KRAS G12D)
GWDGVGKSY

SEQ ID NO: 8941 - protein, 9 aa, Artificial Sequence
  Description of Artificial Sequence: Synthetic peptide
  Seed: GADGVGKSA (KRAS G12D)
GYDGVGKSA

SEQ ID NO: 8942 - protein, 10 aa, Artificial Sequence
  Description of Artificial Sequence: Synthetic peptide
  Seed: GADGVGKSAL (KRAS G12D)
GYDGVGKSAC

SEQ ID NO: 8943 - protein, 10 aa, Artificial Sequence
  Description of Artificial Sequence: Synthetic peptide
  Seed: GADGVGKSAL (KRAS G12D)
GYDGVGKSAF

SEQ ID NO: 8944 - protein, 10 aa, Artificial Sequence
  Description of Artificial Sequence: Synthetic peptide
  Seed: GADGVGKSAL (KRAS G12D)
GYDGVGKSAI

SEQ ID NO: 8945 - protein, 10 aa, Artificial Sequence
  Description of Artificial Sequence: Synthetic peptide
  Seed: GADGVGKSAL (KRAS G12D)
GYDGVGKSAK

SEQ ID NO: 8946 - protein, 10 aa, Artificial Sequence
  Description of Artificial Sequence: Synthetic peptide
  Seed: GADGVGKSAL (KRAS G12D)
GYDGVGKSAL

SEQ ID NO: 8947 - protein, 11 aa, Artificial Sequence
  Description of Artificial Sequence: Synthetic peptide
  Seed: GADGVGKSALT (KRAS G12D)
GYDGVGKSALL

SEQ ID NO: 8948 - protein, 11 aa, Artificial Sequence
  Description of Artificial Sequence: Synthetic peptide
  Seed: GADGVGKSALT (KRAS G12D)
GYDGVGKSALM

SEQ ID NO: 8949 - protein, 10 aa, Artificial Sequence
  Description of Artificial Sequence: Synthetic peptide
  Seed: GADGVGKSAL (KRAS G12D)
GYDGVGKSAM

SEQ ID NO: 8950 - protein, 10 aa, Artificial Sequence
  Description of Artificial Sequence: Synthetic peptide
  Seed: GADGVGKSAL (KRAS G12D)
GYDGVGKSAR

SEQ ID NO: 8951 - protein, 10 aa, Artificial Sequence
  Description of Artificial Sequence: Synthetic peptide
  Seed: GADGVGKSAL (KRAS G12D)
GYDGVGKSAV

SEQ ID NO: 8952 - protein, 10 aa, Artificial Sequence
  Description of Artificial Sequence: Synthetic peptide
  Seed: GADGVGKSAL (KRAS G12D)
GYDGVGKSAW

SEQ ID NO: 8953 - protein, 10 aa, Artificial Sequence
  Description of Artificial Sequence: Synthetic peptide
  Seed: GADGVGKSAL (KRAS G12D)
GYDGVGKSAY

SEQ ID NO: 8954 - protein, 9 aa, Artificial Sequence
  Description of Artificial Sequence: Synthetic peptide
  Seed: GADGVGKSA (KRAS G12D)
GYDGVGKSC

SEQ ID NO: 8955 - protein, 9 aa, Artificial Sequence
  Description of Artificial Sequence: Synthetic peptide
  Seed: GADGVGKSA (KRAS G12D)
GYDGVGKSF

SEQ ID NO: 8956 - protein, 9 aa, Artificial Sequence
  Description of Artificial Sequence: Synthetic peptide
  Seed: GADGVGKSA (KRAS G12D)
GYDGVGKSI

SEQ ID NO: 8957 - protein, 9 aa, Artificial Sequence
  Description of Artificial Sequence: Synthetic peptide
  Seed: GADGVGKSA (KRAS G12D)
GYDGVGKSK

SEQ ID NO: 8958 - protein, 9 aa, Artificial Sequence
  Description of Artificial Sequence: Synthetic peptide
  Seed: GADGVGKSA (KRAS G12D)
GYDGVGKSL

SEQ ID NO: 8959 - protein, 9 aa, Artificial Sequence
  Description of Artificial Sequence: Synthetic peptide
  Seed: GADGVGKSA (KRAS G12D)
GYDGVGKSM

SEQ ID NO: 8960 - protein, 9 aa, Artificial Sequence
  Description of Artificial Sequence: Synthetic peptide
  Seed: GADGVGKSA (KRAS G12D)
GYDGVGKSR

SEQ ID NO: 8961 - protein, 9 aa, Artificial Sequence
  Description of Artificial Sequence: Synthetic peptide
  Seed: GADGVGKSA (KRAS G12D)
GYDGVGKST

SEQ ID NO: 8962 - protein, 9 aa, Artificial Sequence
  Description of Artificial Sequence: Synthetic peptide
  Seed: GADGVGKSA (KRAS G12D)
GYDGVGKSV

SEQ ID NO: 8963 - protein, 9 aa, Artificial Sequence
  Description of Artificial Sequence: Synthetic peptide
  Seed: GADGVGKSA (KRAS G12D)
GYDGVGKSW

SEQ ID NO: 8964 - protein, 9 aa, Artificial Sequence
  Description of Artificial Sequence: Synthetic peptide
  Seed: GADGVGKSA (KRAS G12D)
GYDGVGKSY

SEQ ID NO: 8965 - protein, 10 aa, Artificial Sequence
  Description of Artificial Sequence: Synthetic peptide
  Seed: KLVVVGADGV (KRAS G12D)
KAVVVGADGV

SEQ ID NO: 8966 - protein, 10 aa, Artificial Sequence
  Description of Artificial Sequence: Synthetic peptide
  Seed: KLVVVGADGV (KRAS G12D)
KIVVVGADGI

SEQ ID NO: 8967 - protein, 10 aa, Artificial Sequence
  Description of Artificial Sequence: Synthetic peptide
  Seed: KLVVVGADGV (KRAS G12D)
KIVVVGADGL

SEQ ID NO: 8968 - protein, 10 aa, Artificial Sequence
  Description of Artificial Sequence: Synthetic peptide
  Seed: KLVVVGADGV (KRAS G12D)
KLVVVGADGM

SEQ ID NO: 8969 - protein, 10 aa, Artificial Sequence
  Description of Artificial Sequence: Synthetic peptide
  Seed: KLVVVGADGV (KRAS G12D)
KQVVVGADGF

SEQ ID NO: 8970 - protein, 10 aa, Artificial Sequence
  Description of Artificial Sequence: Synthetic peptide
  Seed: KLVVVGADGV (KRAS G12D)
KQVVVGADGM

SEQ ID NO: 8971 - protein, 10 aa, Artificial Sequence
  Description of Artificial Sequence: Synthetic peptide
  Seed: KLVVVGADGV (KRAS G12D)
KQVVVGADGW

SEQ ID NO: 8972 - protein, 10 aa, Artificial Sequence
  Description of Artificial Sequence: Synthetic peptide
  Seed: KLVVVGADGV (KRAS G12D)
KVVVVGADGI

SEQ ID NO: 8973 - protein, 10 aa, Artificial Sequence
  Description of Artificial Sequence: Synthetic peptide
  Seed: KLVVVGADGV (KRAS G12D)
KVVVVGADGL

SEQ ID NO: 8974 - protein, 9 aa, Artificial Sequence
  Description of Artificial Sequence: Synthetic peptide
  Seed: LVVVGADGV (KRAS G12D)
LAVVGADGL

SEQ ID NO: 8975 - protein, 11 aa, Artificial Sequence
  Description of Artificial Sequence: Synthetic peptide
  Seed: LVVVGADGVGK (KRAS G12D)
LAVVGADGVGF

SEQ ID NO: 8976 - protein, 11 aa, Artificial Sequence
  Description of Artificial Sequence: Synthetic peptide
  Seed: LVVVGADGVGK (KRAS G12D)
LAVVGADGVGH

SEQ ID NO: 8977 - protein, 11 aa, Artificial Sequence
  Description of Artificial Sequence: Synthetic peptide
  Seed: LVVVGADGVGK (KRAS G12D)
LAVVGADGVGI

SEQ ID NO: 8978 - protein, 11 aa, Artificial Sequence
  Description of Artificial Sequence: Synthetic peptide
  Seed: LVVVGADGVGK (KRAS G12D)
LAVVGADGVGK

SEQ ID NO: 8979 - protein, 11 aa, Artificial Sequence
  Description of Artificial Sequence: Synthetic peptide
  Seed: LVVVGADGVGK (KRAS G12D)
LAVVGADGVGL

SEQ ID NO: 8980 - protein, 11 aa, Artificial Sequence
  Description of Artificial Sequence: Synthetic peptide
  Seed: LVVVGADGVGK (KRAS G12D)
LAVVGADGVGM

SEQ ID NO: 8981 - protein, 11 aa, Artificial Sequence
  Description of Artificial Sequence: Synthetic peptide
  Seed: LVVVGADGVGK (KRAS G12D)
LAVVGADGVGQ

SEQ ID NO: 8982 - protein, 11 aa, Artificial Sequence
  Description of Artificial Sequence: Synthetic peptide
  Seed: LVVVGADGVGK (KRAS G12D)
LAVVGADGVGR

SEQ ID NO: 8983 - protein, 11 aa, Artificial Sequence
  Description of Artificial Sequence: Synthetic peptide
  Seed: LVVVGADGVGK (KRAS G12D)
LAVVGADGVGW

SEQ ID NO: 8984 - protein, 11 aa, Artificial Sequence
  Description of Artificial Sequence: Synthetic peptide
  Seed: LVVVGADGVGK (KRAS G12D)
LAVVGADGVGY

SEQ ID NO: 8985 - protein, 11 aa, Artificial Sequence
  Description of Artificial Sequence: Synthetic peptide
  Seed: LVVVGADGVGK (KRAS G12D)
LCVVGADGVGK

SEQ ID NO: 8986 - protein, 11 aa, Artificial Sequence
  Description of Artificial Sequence: Synthetic peptide
  Seed: LVVVGADGVGK (KRAS G12D)
LCVVGADGVGR

SEQ ID NO: 8987 - protein, 11 aa, Artificial Sequence
  Description of Artificial Sequence: Synthetic peptide
  Seed: LVVVGADGVGK (KRAS G12D)
LDVVGADGVGK

SEQ ID NO: 8988 - protein, 11 aa, Artificial Sequence
  Description of Artificial Sequence: Synthetic peptide
  Seed: LVVVGADGVGK (KRAS G12D)
LDVVGADGVGR

SEQ ID NO: 8989 - protein, 11 aa, Artificial Sequence
  Description of Artificial Sequence: Synthetic peptide
  Seed: LVVVGADGVGK (KRAS G12D)
LEVVGADGVGK

SEQ ID NO: 8990 - protein, 11 aa, Artificial Sequence
  Description of Artificial Sequence: Synthetic peptide
  Seed: LVVVGADGVGK (KRAS G12D)
LEVVGADGVGR

SEQ ID NO: 8991 - protein, 11 aa, Artificial Sequence
  Description of Artificial Sequence: Synthetic peptide
  Seed: LVVVGADGVGK (KRAS G12D)
LFVVGADGVGK

SEQ ID NO: 8992 - protein, 11 aa, Artificial Sequence
  Description of Artificial Sequence: Synthetic peptide
  Seed: LVVVGADGVGK (KRAS G12D)
LFVVGADGVGR

SEQ ID NO: 8993 - protein, 11 aa, Artificial Sequence
  Description of Artificial Sequence: Synthetic peptide
  Seed: LVVVGADGVGK (KRAS G12D)
LGVVGADGVGF

SEQ ID NO: 8994 - protein, 11 aa, Artificial Sequence
  Description of Artificial Sequence: Synthetic peptide
  Seed: LVVVGADGVGK (KRAS G12D)
LGVVGADGVGH

SEQ ID NO: 8995 - protein, 11 aa, Artificial Sequence
  Description of Artificial Sequence: Synthetic peptide
  Seed: LVVVGADGVGK (KRAS G12D)
LGVVGADGVGK

SEQ ID NO: 8996 - protein, 11 aa, Artificial Sequence
  Description of Artificial Sequence: Synthetic peptide
  Seed: LVVVGADGVGK (KRAS G12D)
LGVVGADGVGL

SEQ ID NO: 8997 - protein, 11 aa, Artificial Sequence
  Description of Artificial Sequence: Synthetic peptide
  Seed: LVVVGADGVGK (KRAS G12D)
LGVVGADGVGM

SEQ ID NO: 8998 - protein, 11 aa, Artificial Sequence
  Description of Artificial Sequence: Synthetic peptide
  Seed: LVVVGADGVGK (KRAS G12D)
LGVVGADGVGQ

SEQ ID NO: 8999 - protein, 11 aa, Artificial Sequence
  Description of Artificial Sequence: Synthetic peptide
  Seed: LVVVGADGVGK (KRAS G12D)
LGVVGADGVGR

SEQ ID NO: 9000 - protein, 11 aa, Artificial Sequence
  Description of Artificial Sequence: Synthetic peptide
  Seed: LVVVGADGVGK (KRAS G12D)
LGVVGADGVGY

SEQ ID NO: 9001 - protein, 11 aa, Artificial Sequence
  Description of Artificial Sequence: Synthetic peptide
  Seed: LVVVGADGVGK (KRAS G12D)
LHVVGADGVGK

SEQ ID NO: 9002 - protein, 11 aa, Artificial Sequence
  Description of Artificial Sequence: Synthetic peptide
  Seed: LVVVGADGVGK (KRAS G12D)
LHVVGADGVGR

SEQ ID NO: 9003 - protein, 9 aa, Artificial Sequence
  Description of Artificial Sequence: Synthetic peptide
  Seed: LVVVGADGV (KRAS G12D)
LIVVGADGA

SEQ ID NO: 9004 - protein, 9 aa, Artificial Sequence
  Description of Artificial Sequence: Synthetic peptide
  Seed: LVVVGADGV (KRAS G12D)
LIVVGADGI

SEQ ID NO: 9005 - protein, 11 aa, Artificial Sequence
  Description of Artificial Sequence: Synthetic peptide
  Seed: LVVVGADGVGK (KRAS G12D)
LIVVGADGVGK

SEQ ID NO: 9006 - protein, 11 aa, Artificial Sequence
  Description of Artificial Sequence: Synthetic peptide
  Seed: LVVVGADGVGK (KRAS G12D)
LIVVGADGVGR

SEQ ID NO: 9007 - protein, 11 aa, Artificial Sequence
  Description of Artificial Sequence: Synthetic peptide
  Seed: LVVVGADGVGK (KRAS G12D)
LIVVGADGVGY

SEQ ID NO: 9008 - protein, 11 aa, Artificial Sequence
  Description of Artificial Sequence: Synthetic peptide
  Seed: LVVVGADGVGK (KRAS G12D)
LKVVGADGVGK

SEQ ID NO: 9009 - protein, 11 aa, Artificial Sequence
  Description of Artificial Sequence: Synthetic peptide
  Seed: LVVVGADGVGK (KRAS G12D)
LKVVGADGVGR

SEQ ID NO: 9010 - protein, 11 aa, Artificial Sequence
  Description of Artificial Sequence: Synthetic peptide
  Seed: LVVVGADGVGK (KRAS G12D)
LLVVGADGVGK

SEQ ID NO: 9011 - protein, 11 aa, Artificial Sequence
  Description of Artificial Sequence: Synthetic peptide
  Seed: LVVVGADGVGK (KRAS G12D)
LLVVGADGVGR

SEQ ID NO: 9012 - protein, 11 aa, Artificial Sequence
  Description of Artificial Sequence: Synthetic peptide
  Seed: LVVVGADGVGK (KRAS G12D)
LLVVGADGVGY

SEQ ID NO: 9013 - protein, 11 aa, Artificial Sequence
  Description of Artificial Sequence: Synthetic peptide
  Seed: LVVVGADGVGK (KRAS G12D)
LMVVGADGVGK

SEQ ID NO: 9014 - protein, 11 aa, Artificial Sequence
  Description of Artificial Sequence: Synthetic peptide
  Seed: LVVVGADGVGK (KRAS G12D)
LMVVGADGVGR

SEQ ID NO: 9015 - protein, 11 aa, Artificial Sequence
  Description of Artificial Sequence: Synthetic peptide
  Seed: LVVVGADGVGK (KRAS G12D)
LMVVGADGVGY

SEQ ID NO: 9016 - protein, 11 aa, Artificial Sequence
  Description of Artificial Sequence: Synthetic peptide
  Seed: LVVVGADGVGK (KRAS G12D)
LNVVGADGVGK

SEQ ID NO: 9017 - protein, 11 aa, Artificial Sequence
  Description of Artificial Sequence: Synthetic peptide
  Seed: LVVVGADGVGK (KRAS G12D)
LNVVGADGVGR

SEQ ID NO: 9018 - protein, 11 aa, Artificial Sequence
  Description of Artificial Sequence: Synthetic peptide
  Seed: LVVVGADGVGK (KRAS G12D)
LPVVGADGVGK

SEQ ID NO: 9019 - protein, 11 aa, Artificial Sequence
  Description of Artificial Sequence: Synthetic peptide
  Seed: LVVVGADGVGK (KRAS G12D)
LPVVGADGVGR

SEQ ID NO: 9020 - protein, 11 aa, Artificial Sequence
  Description of Artificial Sequence: Synthetic peptide
  Seed: LVVVGADGVGK (KRAS G12D)
LQVVGADGVGK

SEQ ID NO: 9021 - protein, 11 aa, Artificial Sequence
  Description of Artificial Sequence: Synthetic peptide
  Seed: LVVVGADGVGK (KRAS G12D)
LQVVGADGVGR

SEQ ID NO: 9022 - protein, 11 aa, Artificial Sequence
  Description of Artificial Sequence: Synthetic peptide
  Seed: LVVVGADGVGK (KRAS G12D)
LQVVGADGVGY

SEQ ID NO: 9023 - protein, 11 aa, Artificial Sequence
  Description of Artificial Sequence: Synthetic peptide
  Seed: LVVVGADGVGK (KRAS G12D)
LSVVGADGVGF

SEQ ID NO: 9024 - protein, 11 aa, Artificial Sequence
  Description of Artificial Sequence: Synthetic peptide
  Seed: LVVVGADGVGK (KRAS G12D)
LSVVGADGVGH

SEQ ID NO: 9025 - protein, 11 aa, Artificial Sequence
  Description of Artificial Sequence: Synthetic peptide
  Seed: LVVVGADGVGK (KRAS G12D)
LSVVGADGVGK

SEQ ID NO: 9026 - protein, 11 aa, Artificial Sequence
  Description of Artificial Sequence: Synthetic peptide
  Seed: LVVVGADGVGK (KRAS G12D)
LSVVGADGVGL

SEQ ID NO: 9027 - protein, 11 aa, Artificial Sequence
  Description of Artificial Sequence: Synthetic peptide
  Seed: LVVVGADGVGK (KRAS G12D)
LSVVGADGVGM

SEQ ID NO: 9028 - protein, 11 aa, Artificial Sequence
  Description of Artificial Sequence: Synthetic peptide
  Seed: LVVVGADGVGK (KRAS G12D)
LSVVGADGVGR

SEQ ID NO: 9029 - protein, 11 aa, Artificial Sequence
  Description of Artificial Sequence: Synthetic peptide
  Seed: LVVVGADGVGK (KRAS G12D)
LSVVGADGVGY

SEQ ID NO: 9030 - protein, 11 aa, Artificial Sequence
  Description of Artificial Sequence: Synthetic peptide
  Seed: LVVVGADGVGK (KRAS G12D)
LTVVGADGVGF

SEQ ID NO: 9031 - protein, 11 aa, Artificial Sequence
  Description of Artificial Sequence: Synthetic peptide
  Seed: LVVVGADGVGK (KRAS G12D)
LTVVGADGVGH

SEQ ID NO: 9032 - protein, 11 aa, Artificial Sequence
  Description of Artificial Sequence: Synthetic peptide
  Seed: LVVVGADGVGK (KRAS G12D)
LTVVGADGVGK

SEQ ID NO: 9033 - protein, 11 aa, Artificial Sequence
  Description of Artificial Sequence: Synthetic peptide
  Seed: LVVVGADGVGK (KRAS G12D)
LTVVGADGVGL

SEQ ID NO: 9034 - protein, 11 aa, Artificial Sequence
  Description of Artificial Sequence: Synthetic peptide
  Seed: LVVVGADGVGK (KRAS G12D)
LTVVGADGVGM

SEQ ID NO: 9035 - protein, 11 aa, Artificial Sequence
  Description of Artificial Sequence: Synthetic peptide
  Seed: LVVVGADGVGK (KRAS G12D)
LTVVGADGVGR

SEQ ID NO: 9036 - protein, 11 aa, Artificial Sequence
  Description of Artificial Sequence: Synthetic peptide
  Seed: LVVVGADGVGK (KRAS G12D)
LTVVGADGVGY

SEQ ID NO: 9037 - protein, 9 aa, Artificial Sequence
  Description of Artificial Sequence: Synthetic peptide
  Seed: LVVVGADGV (KRAS G12D)
LVVVGADGA

SEQ ID NO: 9038 - protein, 11 aa, Artificial Sequence
  Description of Artificial Sequence: Synthetic peptide
  Seed: LVVVGADGVGK (KRAS G12D)
LVVVGADGVGF

SEQ ID NO: 9039 - protein, 11 aa, Artificial Sequence
  Description of Artificial Sequence: Synthetic peptide
  Seed: LVVVGADGVGK (KRAS G12D)
LVVVGADGVGH

SEQ ID NO: 9040 - protein, 11 aa, Artificial Sequence
  Description of Artificial Sequence: Synthetic peptide
  Seed: LVVVGADGVGK (KRAS G12D)
LVVVGADGVGL

SEQ ID NO: 9041 - protein, 11 aa, Artificial Sequence
  Description of Artificial Sequence: Synthetic peptide
  Seed: LVVVGADGVGK (KRAS G12D)
LVVVGADGVGM

SEQ ID NO: 9042 - protein, 11 aa, Artificial Sequence
  Description of Artificial Sequence: Synthetic peptide
  Seed: LVVVGADGVGK (KRAS G12D)
LVVVGADGVGQ

SEQ ID NO: 9043 - protein, 11 aa, Artificial Sequence
  Description of Artificial Sequence: Synthetic peptide
  Seed: LVVVGADGVGK (KRAS G12D)
LVVVGADGVGR

SEQ ID NO: 9044 - protein, 11 aa, Artificial Sequence
  Description of Artificial Sequence: Synthetic peptide
  Seed: LVVVGADGVGK (KRAS G12D)
LVVVGADGVGY

SEQ ID NO: 9045 - protein, 11 aa, Artificial Sequence
  Description of Artificial Sequence: Synthetic peptide
  Seed: LVVVGADGVGK (KRAS G12D)
LWVVGADGVGK

SEQ ID NO: 9046 - protein, 11 aa, Artificial Sequence
  Description of Artificial Sequence: Synthetic peptide
  Seed: LVVVGADGVGK (KRAS G12D)
LWVVGADGVGR

SEQ ID NO: 9047 - protein, 11 aa, Artificial Sequence
  Description of Artificial Sequence: Synthetic peptide
  Seed: LVVVGADGVGK (KRAS G12D)
LYVVGADGVGK

SEQ ID NO: 9048 - protein, 11 aa, Artificial Sequence
  Description of Artificial Sequence: Synthetic peptide
  Seed: LVVVGADGVGK (KRAS G12D)
LYVVGADGVGR

SEQ ID NO: 9049 - protein, 8 aa, Artificial Sequence
  Description of Artificial Sequence: Synthetic peptide
  Seed: VGADGVGK (KRAS G12D)
VAADGVGF

SEQ ID NO: 9050 - protein, 8 aa, Artificial Sequence
  Description of Artificial Sequence: Synthetic peptide
  Seed: VGADGVGK (KRAS G12D)
VAADGVGH

SEQ ID NO: 9051 - protein, 8 aa, Artificial Sequence
  Description of Artificial Sequence: Synthetic peptide
  Seed: VGADGVGK (KRAS G12D)
VAADGVGI

SEQ ID NO: 9052 - protein, 8 aa, Artificial Sequence
  Description of Artificial Sequence: Synthetic peptide
  Seed: VGADGVGK (KRAS G12D)
VAADGVGK

SEQ ID NO: 9053 - protein, 10 aa, Artificial Sequence
  Description of Artificial Sequence: Synthetic peptide
  Seed: VGADGVGKSA (KRAS G12D)
VAADGVGKSA

SEQ ID NO: 9054 - protein, 11 aa, Artificial Sequence
  Description of Artificial Sequence: Synthetic peptide
  Seed: VGADGVGKSAL (KRAS G12D)
VAADGVGKSAA

SEQ ID NO: 9055 - protein, 11 aa, Artificial Sequence
  Description of Artificial Sequence: Synthetic peptide
  Seed: VGADGVGKSAL (KRAS G12D)
VAADGVGKSAC

SEQ ID NO: 9056 - protein, 11 aa, Artificial Sequence
  Description of Artificial Sequence: Synthetic peptide
  Seed: VGADGVGKSAL (KRAS G12D)
VAADGVGKSAH

SEQ ID NO: 9057 - protein, 11 aa, Artificial Sequence
  Description of Artificial Sequence: Synthetic peptide
  Seed: VGADGVGKSAL (KRAS G12D)
VAADGVGKSAI

SEQ ID NO: 9058 - protein, 11 aa, Artificial Sequence
  Description of Artificial Sequence: Synthetic peptide
  Seed: VGADGVGKSAL (KRAS G12D)
VAADGVGKSAK

SEQ ID NO: 9059 - protein, 11 aa, Artificial Sequence
  Description of Artificial Sequence: Synthetic peptide
  Seed: VGADGVGKSAL (KRAS G12D)
VAADGVGKSAM

SEQ ID NO: 9060 - protein, 11 aa, Artificial Sequence
  Description of Artificial Sequence: Synthetic peptide
  Seed: VGADGVGKSAL (KRAS G12D)
VAADGVGKSAN

SEQ ID NO: 9061 - protein, 11 aa, Artificial Sequence
  Description of Artificial Sequence: Synthetic peptide
  Seed: VGADGVGKSAL (KRAS G12D)
VAADGVGKSAQ

SEQ ID NO: 9062 - protein, 11 aa, Artificial Sequence
  Description of Artificial Sequence: Synthetic peptide
  Seed: VGADGVGKSAL (KRAS G12D)
VAADGVGKSAR

SEQ ID NO: 9063 - protein, 11 aa, Artificial Sequence
  Description of Artificial Sequence: Synthetic peptide
  Seed: VGADGVGKSAL (KRAS G12D)
VAADGVGKSAS

SEQ ID NO: 9064 - protein, 11 aa, Artificial Sequence
  Description of Artificial Sequence: Synthetic peptide
  Seed: VGADGVGKSAL (KRAS G12D)
VAADGVGKSAT

SEQ ID NO: 9065 - protein, 11 aa, Artificial Sequence
  Description of Artificial Sequence: Synthetic peptide
  Seed: VGADGVGKSAL (KRAS G12D)
VAADGVGKSAV

SEQ ID NO: 9066 - protein, 11 aa, Artificial Sequence
  Description of Artificial Sequence: Synthetic peptide
  Seed: VGADGVGKSAL (KRAS G12D)
VAADGVGKSAW

SEQ ID NO: 9067 - protein, 11 aa, Artificial Sequence
  Description of Artificial Sequence: Synthetic peptide
  Seed: VGADGVGKSAL (KRAS G12D)
VAADGVGKSAY

SEQ ID NO: 9068 - protein, 10 aa, Artificial Sequence
  Description of Artificial Sequence: Synthetic peptide
  Seed: VGADGVGKSA (KRAS G12D)
VAADGVGKSC

SEQ ID NO: 9069 - protein, 10 aa, Artificial Sequence
  Description of Artificial Sequence: Synthetic peptide
  Seed: VGADGVGKSA (KRAS G12D)
VAADGVGKSE

SEQ ID NO: 9070 - protein, 10 aa, Artificial Sequence
  Description of Artificial Sequence: Synthetic peptide
  Seed: VGADGVGKSA (KRAS G12D)
VAADGVGKSF

SEQ ID NO: 9071 - protein, 10 aa, Artificial Sequence
  Description of Artificial Sequence: Synthetic peptide
  Seed: VGADGVGKSA (KRAS G12D)
VAADGVGKSG

SEQ ID NO: 9072 - protein, 10 aa, Artificial Sequence
  Description of Artificial Sequence: Synthetic peptide
  Seed: VGADGVGKSA (KRAS G12D)
VAADGVGKSH

SEQ ID NO: 9073 - protein, 10 aa, Artificial Sequence
  Description of Artificial Sequence: Synthetic peptide
  Seed: VGADGVGKSA (KRAS G12D)
VAADGVGKSI

SEQ ID NO: 9074 - protein, 10 aa, Artificial Sequence
  Description of Artificial Sequence: Synthetic peptide
  Seed: VGADGVGKSA (KRAS G12D)
VAADGVGKSK

SEQ ID NO: 9075 - protein, 10 aa, Artificial Sequence
  Description of Artificial Sequence: Synthetic peptide
  Seed: VGADGVGKSA (KRAS G12D)
VAADGVGKSL

SEQ ID NO: 9076 - protein, 10 aa, Artificial Sequence
  Description of Artificial Sequence: Synthetic peptide
  Seed: VGADGVGKSA (KRAS G12D)
VAADGVGKSM

SEQ ID NO: 9077 - protein, 10 aa, Artificial Sequence
  Description of Artificial Sequence: Synthetic peptide
  Seed: VGADGVGKSA (KRAS G12D)
VAADGVGKSN

SEQ ID NO: 9078 - protein, 10 aa, Artificial Sequence
  Description of Artificial Sequence: Synthetic peptide
  Seed: VGADGVGKSA (KRAS G12D)
VAADGVGKSP

SEQ ID NO: 9079 - protein, 10 aa, Artificial Sequence
  Description of Artificial Sequence: Synthetic peptide
  Seed: VGADGVGKSA (KRAS G12D)
VAADGVGKSQ

SEQ ID NO: 9080 - protein, 10 aa, Artificial Sequence
  Description of Artificial Sequence: Synthetic peptide
  Seed: VGADGVGKSA (KRAS G12D)
VAADGVGKSR

SEQ ID NO: 9081 - protein, 10 aa, Artificial Sequence
  Description of Artificial Sequence: Synthetic peptide
  Seed: VGADGVGKSA (KRAS G12D)
VAADGVGKSS

SEQ ID NO: 9082 - protein, 10 aa, Artificial Sequence
  Description of Artificial Sequence: Synthetic peptide
  Seed: VGADGVGKSA (KRAS G12D)
VAADGVGKST

SEQ ID NO: 9083 - protein, 10 aa, Artificial Sequence
  Description of Artificial Sequence: Synthetic peptide
  Seed: VGADGVGKSA (KRAS G12D)
VAADGVGKSV

SEQ ID NO: 9084 - protein, 10 aa, Artificial Sequence
  Description of Artificial Sequence: Synthetic peptide
  Seed: VGADGVGKSA (KRAS G12D)
VAADGVGKSW

SEQ ID NO: 9085 - protein, 10 aa, Artificial Sequence
  Description of Artificial Sequence: Synthetic peptide
  Seed: VGADGVGKSA (KRAS G12D)
VAADGVGKSY

SEQ ID NO: 9086 - protein, 8 aa, Artificial Sequence
  Description of Artificial Sequence: Synthetic peptide
  Seed: VGADGVGK (KRAS G12D)
VAADGVGL

SEQ ID NO: 9087 - protein, 8 aa, Artificial Sequence
  Description of Artificial Sequence: Synthetic peptide
  Seed: VGADGVGK (KRAS G12D)
VAADGVGM

SEQ ID NO: 9088 - protein, 8 aa, Artificial Sequence
  Description of Artificial Sequence: Synthetic peptide
  Seed: VGADGVGK (KRAS G12D)
VAADGVGR

SEQ ID NO: 9089 - protein, 8 aa, Artificial Sequence
  Description of Artificial Sequence: Synthetic peptide
  Seed: VGADGVGK (KRAS G12D)
VAADGVGV

SEQ ID NO: 9090 - protein, 8 aa, Artificial Sequence
  Description of Artificial Sequence: Synthetic peptide
  Seed: VGADGVGK (KRAS G12D)
VAADGVGY

SEQ ID NO: 9091 - protein, 9 aa, Artificial Sequence
  Description of Artificial Sequence: Synthetic peptide
  Seed: VVGADGVGK (KRAS G12D)
VAGADGVGF

SEQ ID NO: 9092 - protein, 9 aa, Artificial Sequence
  Description of Artificial Sequence: Synthetic peptide
  Seed: VVGADGVGK (KRAS G12D)
VAGADGVGH

SEQ ID NO: 9093 - protein, 9 aa, Artificial Sequence
  Description of Artificial Sequence: Synthetic peptide
  Seed: VVGADGVGK (KRAS G12D)
VAGADGVGI

SEQ ID NO: 9094 - protein, 9 aa, Artificial Sequence
  Description of Artificial Sequence: Synthetic peptide
  Seed: VVGADGVGK (KRAS G12D)
VAGADGVGK

SEQ ID NO: 9095 - protein, 9 aa, Artificial Sequence
  Description of Artificial Sequence: Synthetic peptide
  Seed: VVGADGVGK (KRAS G12D)
VAGADGVGL

SEQ ID NO: 9096 - protein, 9 aa, Artificial Sequence
  Description of Artificial Sequence: Synthetic peptide
  Seed: VVGADGVGK (KRAS G12D)
VAGADGVGM

SEQ ID NO: 9097 - protein, 9 aa, Artificial Sequence
  Description of Artificial Sequence: Synthetic peptide
  Seed: VVGADGVGK (KRAS G12D)
VAGADGVGR

SEQ ID NO: 9098 - protein, 9 aa, Artificial Sequence
  Description of Artificial Sequence: Synthetic peptide
  Seed: VVGADGVGK (KRAS G12D)
VAGADGVGV

SEQ ID NO: 9099 - protein, 9 aa, Artificial Sequence
  Description of Artificial Sequence: Synthetic peptide
  Seed: VVGADGVGK (KRAS G12D)
VAGADGVGY

SEQ ID NO: 9100 - protein, 10 aa, Artificial Sequence
  Description of Artificial Sequence: Synthetic peptide
  Seed: VVVGADGVGK (KRAS G12D)
VAVGADGVGA

SEQ ID NO: 9101 - protein, 10 aa, Artificial Sequence
  Description of Artificial Sequence: Synthetic peptide
  Seed: VVVGADGVGK (KRAS G12D)
VAVGADGVGC

SEQ ID NO: 9102 - protein, 10 aa, Artificial Sequence
  Description of Artificial Sequence: Synthetic peptide
  Seed: VVVGADGVGK (KRAS G12D)
VAVGADGVGE

SEQ ID NO: 9103 - protein, 10 aa, Artificial Sequence
  Description of Artificial Sequence: Synthetic peptide
  Seed: VVVGADGVGK (KRAS G12D)
VAVGADGVGF

SEQ ID NO: 9104 - protein, 10 aa, Artificial Sequence
  Description of Artificial Sequence: Synthetic peptide
  Seed: VVVGADGVGK (KRAS G12D)
VAVGADGVGH

SEQ ID NO: 9105 - protein, 10 aa, Artificial Sequence
  Description of Artificial Sequence: Synthetic peptide
  Seed: VVVGADGVGK (KRAS G12D)
VAVGADGVGI

SEQ ID NO: 9106 - protein, 10 aa, Artificial Sequence
  Description of Artificial Sequence: Synthetic peptide
  Seed: VVVGADGVGK (KRAS G12D)
VAVGADGVGL

SEQ ID NO: 9107 - protein, 10 aa, Artificial Sequence
  Description of Artificial Sequence: Synthetic peptide
  Seed: VVVGADGVGK (KRAS G12D)
VAVGADGVGM

SEQ ID NO: 9108 - protein, 10 aa, Artificial Sequence
  Description of Artificial Sequence: Synthetic peptide
  Seed: VVVGADGVGK (KRAS G12D)
VAVGADGVGN

SEQ ID NO: 9109 - protein, 10 aa, Artificial Sequence
  Description of Artificial Sequence: Synthetic peptide
  Seed: VVVGADGVGK (KRAS G12D)
VAVGADGVGQ

SEQ ID NO: 9110 - protein, 10 aa, Artificial Sequence
  Description of Artificial Sequence: Synthetic peptide
  Seed: VVVGADGVGK (KRAS G12D)
VAVGADGVGV

SEQ ID NO: 9111 - protein, 10 aa, Artificial Sequence
  Description of Artificial Sequence: Synthetic peptide
  Seed: VVVGADGVGK (KRAS G12D)
VAVGADGVGW

SEQ ID NO: 9112 - protein, 10 aa, Artificial Sequence
  Description of Artificial Sequence: Synthetic peptide
  Seed: VVVGADGVGK (KRAS G12D)
VAVGADGVGY

SEQ ID NO: 9113 - protein, 8 aa, Artificial Sequence
  Description of Artificial Sequence: Synthetic peptide
  Seed: VGADGVGK (KRAS G12D)
VCADGVGK

SEQ ID NO: 9114 - protein, 11 aa, Artificial Sequence
  Description of Artificial Sequence: Synthetic peptide
  Seed: VGADGVGKSAL (KRAS G12D)
VCADGVGKSAF

SEQ ID NO: 9115 - protein, 11 aa, Artificial Sequence
  Description of Artificial Sequence: Synthetic peptide
  Seed: VGADGVGKSAL (KRAS G12D)
VCADGVGKSAI

SEQ ID NO: 9116 - protein, 11 aa, Artificial Sequence
  Description of Artificial Sequence: Synthetic peptide
  Seed: VGADGVGKSAL (KRAS G12D)
VCADGVGKSAK

SEQ ID NO: 9117 - protein, 11 aa, Artificial Sequence
  Description of Artificial Sequence: Synthetic peptide
  Seed: VGADGVGKSAL (KRAS G12D)
VCADGVGKSAL

SEQ ID NO: 9118 - protein, 11 aa, Artificial Sequence
  Description of Artificial Sequence: Synthetic peptide
  Seed: VGADGVGKSAL (KRAS G12D)
VCADGVGKSAM

SEQ ID NO: 9119 - protein, 11 aa, Artificial Sequence
  Description of Artificial Sequence: Synthetic peptide
  Seed: VGADGVGKSAL (KRAS G12D)
VCADGVGKSAR

SEQ ID NO: 9120 - protein, 11 aa, Artificial Sequence
  Description of Artificial Sequence: Synthetic peptide
  Seed: VGADGVGKSAL (KRAS G12D)
VCADGVGKSAW

SEQ ID NO: 9121 - protein, 11 aa, Artificial Sequence
  Description of Artificial Sequence: Synthetic peptide
  Seed: VGADGVGKSAL (KRAS G12D)
VCADGVGKSAY

SEQ ID NO: 9122 - protein, 10 aa, Artificial Sequence
  Description of Artificial Sequence: Synthetic peptide
  Seed: VGADGVGKSA (KRAS G12D)
VCADGVGKSF

SEQ ID NO: 9123 - protein, 10 aa, Artificial Sequence
  Description of Artificial Sequence: Synthetic peptide
  Seed: VGADGVGKSA (KRAS G12D)
VCADGVGKSH

SEQ ID NO: 9124 - protein, 10 aa, Artificial Sequence
  Description of Artificial Sequence: Synthetic peptide
  Seed: VGADGVGKSA (KRAS G12D)
VCADGVGKSI

SEQ ID NO: 9125 - protein, 10 aa, Artificial Sequence
  Description of Artificial Sequence: Synthetic peptide
  Seed: VGADGVGKSA (KRAS G12D)
VCADGVGKSK

SEQ ID NO: 9126 - protein, 10 aa, Artificial Sequence
  Description of Artificial Sequence: Synthetic peptide
  Seed: VGADGVGKSA (KRAS G12D)
VCADGVGKSL

SEQ ID NO: 9127 - protein, 10 aa, Artificial Sequence
  Description of Artificial Sequence: Synthetic peptide
  Seed: VGADGVGKSA (KRAS G12D)
VCADGVGKSM

SEQ ID NO: 9128 - protein, 10 aa, Artificial Sequence
  Description of Artificial Sequence: Synthetic peptide
  Seed: VGADGVGKSA (KRAS G12D)
VCADGVGKSV

SEQ ID NO: 9129 - protein, 10 aa, Artificial Sequence
  Description of Artificial Sequence: Synthetic peptide
  Seed: VGADGVGKSA (KRAS G12D)
VCADGVGKSW

SEQ ID NO: 9130 - protein, 10 aa, Artificial Sequence
  Description of Artificial Sequence: Synthetic peptide
  Seed: VGADGVGKSA (KRAS G12D)
VCADGVGKSY

SEQ ID NO: 9131 - protein, 8 aa, Artificial Sequence
  Description of Artificial Sequence: Synthetic peptide
  Seed: VGADGVGK (KRAS G12D)
VCADGVGR

SEQ ID NO: 9132 - protein, 9 aa, Artificial Sequence
  Description of Artificial Sequence: Synthetic peptide
  Seed: VVGADGVGK (KRAS G12D)
VCGADGVGK

SEQ ID NO: 9133 - protein, 9 aa, Artificial Sequence
  Description of Artificial Sequence: Synthetic peptide
  Seed: VVGADGVGK (KRAS G12D)
VCGADGVGR

SEQ ID NO: 9134 - protein, 9 aa, Artificial Sequence
  Description of Artificial Sequence: Synthetic peptide
  Seed: VVGADGVGK (KRAS G12D)
VCGADGVGY

SEQ ID NO: 9135 - protein, 10 aa, Artificial Sequence
  Description of Artificial Sequence: Synthetic peptide
  Seed: VVVGADGVGK (KRAS G12D)
VCVGADGVGF

SEQ ID NO: 9136 - protein, 10 aa, Artificial Sequence
  Description of Artificial Sequence: Synthetic peptide
  Seed: VVVGADGVGK (KRAS G12D)
VCVGADGVGK

SEQ ID NO: 9137 - protein, 10 aa, Artificial Sequence
  Description of Artificial Sequence: Synthetic peptide
  Seed: VVVGADGVGK (KRAS G12D)
VCVGADGVGL

SEQ ID NO: 9138 - protein, 10 aa, Artificial Sequence
  Description of Artificial Sequence: Synthetic peptide
  Seed: VVVGADGVGK (KRAS G12D)
VCVGADGVGM

SEQ ID NO: 9139 - protein, 10 aa, Artificial Sequence
  Description of Artificial Sequence: Synthetic peptide
  Seed: VVVGADGVGK (KRAS G12D)
VCVGADGVGR

SEQ ID NO: 9140 - protein, 10 aa, Artificial Sequence
  Description of Artificial Sequence: Synthetic peptide
  Seed: VVVGADGVGK (KRAS G12D)
VCVGADGVGY

SEQ ID NO: 9141 - protein, 8 aa, Artificial Sequence
  Description of Artificial Sequence: Synthetic peptide
  Seed: VGADGVGK (KRAS G12D)
VDADGVGK

SEQ ID NO: 9142 - protein, 11 aa, Artificial Sequence
  Description of Artificial Sequence: Synthetic peptide
  Seed: VGADGVGKSAL (KRAS G12D)
VDADGVGKSAF

SEQ ID NO: 9143 - protein, 11 aa, Artificial Sequence
  Description of Artificial Sequence: Synthetic peptide
  Seed: VGADGVGKSAL (KRAS G12D)
VDADGVGKSAK

SEQ ID NO: 9144 - protein, 11 aa, Artificial Sequence
  Description of Artificial Sequence: Synthetic peptide
  Seed: VGADGVGKSAL (KRAS G12D)
VDADGVGKSAL

SEQ ID NO: 9145 - protein, 11 aa, Artificial Sequence
  Description of Artificial Sequence: Synthetic peptide
  Seed: VGADGVGKSAL (KRAS G12D)
VDADGVGKSAR

SEQ ID NO: 9146 - protein, 11 aa, Artificial Sequence
  Description of Artificial Sequence: Synthetic peptide
  Seed: VGADGVGKSAL (KRAS G12D)
VDADGVGKSAW

SEQ ID NO: 9147 - protein, 11 aa, Artificial Sequence
  Description of Artificial Sequence: Synthetic peptide
  Seed: VGADGVGKSAL (KRAS G12D)
VDADGVGKSAY

SEQ ID NO: 9148 - protein, 10 aa, Artificial Sequence
  Description of Artificial Sequence: Synthetic peptide
  Seed: VGADGVGKSA (KRAS G12D)
VDADGVGKSF

SEQ ID NO: 9149 - protein, 10 aa, Artificial Sequence
  Description of Artificial Sequence: Synthetic peptide
  Seed: VGADGVGKSA (KRAS G12D)
VDADGVGKSK

SEQ ID NO: 9150 - protein, 10 aa, Artificial Sequence
  Description of Artificial Sequence: Synthetic peptide
  Seed: VGADGVGKSA (KRAS G12D)
VDADGVGKSL

SEQ ID NO: 9151 - protein, 10 aa, Artificial Sequence
  Description of Artificial Sequence: Synthetic peptide
  Seed: VGADGVGKSA (KRAS G12D)
VDADGVGKSM

SEQ ID NO: 9152 - protein, 10 aa, Artificial Sequence
  Description of Artificial Sequence: Synthetic peptide
  Seed: VGADGVGKSA (KRAS G12D)
VDADGVGKSR

SEQ ID NO: 9153 - protein, 10 aa, Artificial Sequence
  Description of Artificial Sequence: Synthetic peptide
  Seed: VGADGVGKSA (KRAS G12D)
VDADGVGKSY

SEQ ID NO: 9154 - protein, 8 aa, Artificial Sequence
  Description of Artificial Sequence: Synthetic peptide
  Seed: VGADGVGK (KRAS G12D)
VDADGVGR

SEQ ID NO: 9155 - protein, 9 aa, Artificial Sequence
  Description of Artificial Sequence: Synthetic peptide
  Seed: VVGADGVGK (KRAS G12D)
VDGADGVGK

SEQ ID NO: 9156 - protein, 9 aa, Artificial Sequence
  Description of Artificial Sequence: Synthetic peptide
  Seed: VVGADGVGK (KRAS G12D)
VDGADGVGR

SEQ ID NO: 9157 - protein, 9 aa, Artificial Sequence
  Description of Artificial Sequence: Synthetic peptide
  Seed: VVGADGVGK (KRAS G12D)
VDGADGVGY

SEQ ID NO: 9158 - protein, 10 aa, Artificial Sequence
  Description of Artificial Sequence: Synthetic peptide
  Seed: VVVGADGVGK (KRAS G12D)
VDVGADGVGK

SEQ ID NO: 9159 - protein, 10 aa, Artificial Sequence
  Description of Artificial Sequence: Synthetic peptide
  Seed: VVVGADGVGK (KRAS G12D)
VDVGADGVGR

SEQ ID NO: 9160 - protein, 10 aa, Artificial Sequence
  Description of Artificial Sequence: Synthetic peptide
  Seed: VVVGADGVGK (KRAS G12D)
VDVGADGVGY

SEQ ID NO: 9161 - protein, 8 aa, Artificial Sequence
  Description of Artificial Sequence: Synthetic peptide
  Seed: VGADGVGK (KRAS G12D)
VEADGVGK

SEQ ID NO: 9162 - protein, 11 aa, Artificial Sequence
  Description of Artificial Sequence: Synthetic peptide
  Seed: VGADGVGKSAL (KRAS G12D)
VEADGVGKSAF

SEQ ID NO: 9163 - protein, 11 aa, Artificial Sequence
  Description of Artificial Sequence: Synthetic peptide
  Seed: VGADGVGKSAL (KRAS G12D)
VEADGVGKSAH

SEQ ID NO: 9164 - protein, 11 aa, Artificial Sequence
  Description of Artificial Sequence: Synthetic peptide
  Seed: VGADGVGKSAL (KRAS G12D)
VEADGVGKSAI

SEQ ID NO: 9165 - protein, 11 aa, Artificial Sequence
  Description of Artificial Sequence: Synthetic peptide
  Seed: VGADGVGKSAL (KRAS G12D)
VEADGVGKSAK

SEQ ID NO: 9166 - protein, 11 aa, Artificial Sequence
  Description of Artificial Sequence: Synthetic peptide
  Seed: VGADGVGKSAL (KRAS G12D)
VEADGVGKSAL

SEQ ID NO: 9167 - protein, 11 aa, Artificial Sequence
  Description of Artificial Sequence: Synthetic peptide
  Seed: VGADGVGKSAL (KRAS G12D)
VEADGVGKSAM

SEQ ID NO: 9168 - protein, 11 aa, Artificial Sequence
  Description of Artificial Sequence: Synthetic peptide
  Seed: VGADGVGKSAL (KRAS G12D)
VEADGVGKSAR

SEQ ID NO: 9169 - protein, 11 aa, Artificial Sequence
  Description of Artificial Sequence: Synthetic peptide
  Seed: VGADGVGKSAL (KRAS G12D)
VEADGVGKSAW

SEQ ID NO: 9170 - protein, 11 aa, Artificial Sequence
  Description of Artificial Sequence: Synthetic peptide
  Seed: VGADGVGKSAL (KRAS G12D)
VEADGVGKSAY

SEQ ID NO: 9171 - protein, 10 aa, Artificial Sequence
  Description of Artificial Sequence: Synthetic peptide
  Seed: VGADGVGKSA (KRAS G12D)
VEADGVGKSF

SEQ ID NO: 9172 - protein, 10 aa, Artificial Sequence
  Description of Artificial Sequence: Synthetic peptide
  Seed: VGADGVGKSA (KRAS G12D)
VEADGVGKSH

SEQ ID NO: 9173 - protein, 10 aa, Artificial Sequence
  Description of Artificial Sequence: Synthetic peptide
  Seed: VGADGVGKSA (KRAS G12D)
VEADGVGKSI

SEQ ID NO: 9174 - protein, 10 aa, Artificial Sequence
  Description of Artificial Sequence: Synthetic peptide
  Seed: VGADGVGKSA (KRAS G12D)
VEADGVGKSK

SEQ ID NO: 9175 - protein, 10 aa, Artificial Sequence
  Description of Artificial Sequence: Synthetic peptide
  Seed: VGADGVGKSA (KRAS G12D)
VEADGVGKSL

SEQ ID NO: 9176 - protein, 10 aa, Artificial Sequence
  Description of Artificial Sequence: Synthetic peptide
  Seed: VGADGVGKSA (KRAS G12D)
VEADGVGKSM

SEQ ID NO: 9177 - protein, 10 aa, Artificial Sequence
  Description of Artificial Sequence: Synthetic peptide
  Seed: VGADGVGKSA (KRAS G12D)
VEADGVGKSR

SEQ ID NO: 9178 - protein, 10 aa, Artificial Sequence
  Description of Artificial Sequence: Synthetic peptide
  Seed: VGADGVGKSA (KRAS G12D)
VEADGVGKSV

SEQ ID NO: 9179 - protein, 10 aa, Artificial Sequence
  Description of Artificial Sequence: Synthetic peptide
  Seed: VGADGVGKSA (KRAS G12D)
VEADGVGKSW

SEQ ID NO: 9180 - protein, 10 aa, Artificial Sequence
  Description of Artificial Sequence: Synthetic peptide
  Seed: VGADGVGKSA (KRAS G12D)
VEADGVGKSY

SEQ ID NO: 9181 - protein, 8 aa, Artificial Sequence
  Description of Artificial Sequence: Synthetic peptide
  Seed: VGADGVGK (KRAS G12D)
VEADGVGR

SEQ ID NO: 9182 - protein, 9 aa, Artificial Sequence
  Description of Artificial Sequence: Synthetic peptide
  Seed: VVGADGVGK (KRAS G12D)
VEGADGVGK

SEQ ID NO: 9183 - protein, 9 aa, Artificial Sequence
  Description of Artificial Sequence: Synthetic peptide
  Seed: VVGADGVGK (KRAS G12D)
VEGADGVGR

SEQ ID NO: 9184 - protein, 10 aa, Artificial Sequence
  Description of Artificial Sequence: Synthetic peptide
  Seed: VVVGADGVGK (KRAS G12D)
VEVGADGVGF

SEQ ID NO: 9185 - protein, 10 aa, Artificial Sequence
  Description of Artificial Sequence: Synthetic peptide
  Seed: VVVGADGVGK (KRAS G12D)
VEVGADGVGK

SEQ ID NO: 9186 - protein, 10 aa, Artificial Sequence
  Description of Artificial Sequence: Synthetic peptide
  Seed: VVVGADGVGK (KRAS G12D)
VEVGADGVGR

SEQ ID NO: 9187 - protein, 10 aa, Artificial Sequence
  Description of Artificial Sequence: Synthetic peptide
  Seed: VVVGADGVGK (KRAS G12D)
VEVGADGVGY

SEQ ID NO: 9188 - protein, 8 aa, Artificial Sequence
  Description of Artificial Sequence: Synthetic peptide
  Seed: VGADGVGK (KRAS G12D)
VFADGVGK

SEQ ID NO: 9189 - protein, 11 aa, Artificial Sequence
  Description of Artificial Sequence: Synthetic peptide
  Seed: VGADGVGKSAL (KRAS G12D)
VFADGVGKSAF

SEQ ID NO: 9190 - protein, 11 aa, Artificial Sequence
  Description of Artificial Sequence: Synthetic peptide
  Seed: VGADGVGKSAL (KRAS G12D)
VFADGVGKSAI

SEQ ID NO: 9191 - protein, 11 aa, Artificial Sequence
  Description of Artificial Sequence: Synthetic peptide
  Seed: VGADGVGKSAL (KRAS G12D)
VFADGVGKSAK

SEQ ID NO: 9192 - protein, 11 aa, Artificial Sequence
  Description of Artificial Sequence: Synthetic peptide
  Seed: VGADGVGKSAL (KRAS G12D)
VFADGVGKSAL

SEQ ID NO: 9193 - protein, 11 aa, Artificial Sequence
  Description of Artificial Sequence: Synthetic peptide
  Seed: VGADGVGKSAL (KRAS G12D)
VFADGVGKSAM

SEQ ID NO: 9194 - protein, 11 aa, Artificial Sequence
  Description of Artificial Sequence: Synthetic peptide
  Seed: VGADGVGKSAL (KRAS G12D)
VFADGVGKSAR

SEQ ID NO: 9195 - protein, 11 aa, Artificial Sequence
  Description of Artificial Sequence: Synthetic peptide
  Seed: VGADGVGKSAL (KRAS G12D)
VFADGVGKSAW

SEQ ID NO: 9196 - protein, 11 aa, Artificial Sequence
  Description of Artificial Sequence: Synthetic peptide
  Seed: VGADGVGKSAL (KRAS G12D)
VFADGVGKSAY

SEQ ID NO: 9197 - protein, 10 aa, Artificial Sequence
  Description of Artificial Sequence: Synthetic peptide
  Seed: VGADGVGKSA (KRAS G12D)
VFADGVGKSF

SEQ ID NO: 9198 - protein, 10 aa, Artificial Sequence
  Description of Artificial Sequence: Synthetic peptide
  Seed: VGADGVGKSA (KRAS G12D)
VFADGVGKSH

SEQ ID NO: 9199 - protein, 10 aa, Artificial Sequence
  Description of Artificial Sequence: Synthetic peptide
  Seed: VGADGVGKSA (KRAS G12D)
VFADGVGKSK

SEQ ID NO: 9200 - protein, 10 aa, Artificial Sequence
  Description of Artificial Sequence: Synthetic peptide
  Seed: VGADGVGKSA (KRAS G12D)
VFADGVGKSL

SEQ ID NO: 9201 - protein, 10 aa, Artificial Sequence
  Description of Artificial Sequence: Synthetic peptide
  Seed: VGADGVGKSA (KRAS G12D)
VFADGVGKSM

SEQ ID NO: 9202 - protein, 10 aa, Artificial Sequence
  Description of Artificial Sequence: Synthetic peptide
  Seed: VGADGVGKSA (KRAS G12D)
VFADGVGKSR

SEQ ID NO: 9203 - protein, 10 aa, Artificial Sequence
  Description of Artificial Sequence: Synthetic peptide
  Seed: VGADGVGKSA (KRAS G12D)
VFADGVGKSY

SEQ ID NO: 9204 - protein, 8 aa, Artificial Sequence
  Description of Artificial Sequence: Synthetic peptide
  Seed: VGADGVGK (KRAS G12D)
VFADGVGR

SEQ ID NO: 9205 - protein, 9 aa, Artificial Sequence
  Description of Artificial Sequence: Synthetic peptide
  Seed: VVGADGVGK (KRAS G12D)
VFGADGVGK

SEQ ID NO: 9206 - protein, 9 aa, Artificial Sequence
  Description of Artificial Sequence: Synthetic peptide
  Seed: VVGADGVGK (KRAS G12D)
VFGADGVGR

SEQ ID NO: 9207 - protein, 10 aa, Artificial Sequence
  Description of Artificial Sequence: Synthetic peptide
  Seed: VVVGADGVGK (KRAS G12D)
VFVGADGVGF

SEQ ID NO: 9208 - protein, 10 aa, Artificial Sequence
  Description of Artificial Sequence: Synthetic peptide
  Seed: VVVGADGVGK (KRAS G12D)
VFVGADGVGK

SEQ ID NO: 9209 - protein, 10 aa, Artificial Sequence
  Description of Artificial Sequence: Synthetic peptide
  Seed: VVVGADGVGK (KRAS G12D)
VFVGADGVGR

SEQ ID NO: 9210 - protein, 10 aa, Artificial Sequence
  Description of Artificial Sequence: Synthetic peptide
  Seed: VVVGADGVGK (KRAS G12D)
VFVGADGVGY

SEQ ID NO: 9211 - protein, 11 aa, Artificial Sequence
  Description of Artificial Sequence: Synthetic peptide
  Seed: VGADGVGKSAL (KRAS G12D)
VGADGVGKSAE

SEQ ID NO: 9212 - protein, 11 aa, Artificial Sequence
  Description of Artificial Sequence: Synthetic peptide
  Seed: VGADGVGKSAL (KRAS G12D)
VGADGVGKSAF

SEQ ID NO: 9213 - protein, 11 aa, Artificial Sequence
  Description of Artificial Sequence: Synthetic peptide
  Seed: VGADGVGKSAL (KRAS G12D)
VGADGVGKSAH

SEQ ID NO: 9214 - protein, 11 aa, Artificial Sequence
  Description of Artificial Sequence: Synthetic peptide
  Seed: VGADGVGKSAL (KRAS G12D)
VGADGVGKSAI

SEQ ID NO: 9215 - protein, 11 aa, Artificial Sequence
  Description of Artificial Sequence: Synthetic peptide
  Seed: VGADGVGKSAL (KRAS G12D)
VGADGVGKSAK

SEQ ID NO: 9216 - protein, 11 aa, Artificial Sequence
  Description of Artificial Sequence: Synthetic peptide
  Seed: VGADGVGKSAL (KRAS G12D)
VGADGVGKSAM

SEQ ID NO: 9217 - protein, 11 aa, Artificial Sequence
  Description of Artificial Sequence: Synthetic peptide
  Seed: VGADGVGKSAL (KRAS G12D)
VGADGVGKSAN

SEQ ID NO: 9218 - protein, 11 aa, Artificial Sequence
  Description of Artificial Sequence: Synthetic peptide
  Seed: VGADGVGKSAL (KRAS G12D)
VGADGVGKSAQ

SEQ ID NO: 9219 - protein, 11 aa, Artificial Sequence
  Description of Artificial Sequence: Synthetic peptide
  Seed: VGADGVGKSAL (KRAS G12D)
VGADGVGKSAR

SEQ ID NO: 9220 - protein, 11 aa, Artificial Sequence
  Description of Artificial Sequence: Synthetic peptide
  Seed: VGADGVGKSAL (KRAS G12D)
VGADGVGKSAV

SEQ ID NO: 9221 - protein, 11 aa, Artificial Sequence
  Description of Artificial Sequence: Synthetic peptide
  Seed: VGADGVGKSAL (KRAS G12D)
VGADGVGKSAW

SEQ ID NO: 9222 - protein, 11 aa, Artificial Sequence
  Description of Artificial Sequence: Synthetic peptide
  Seed: VGADGVGKSAL (KRAS G12D)
VGADGVGKSAY

SEQ ID NO: 9223 - protein, 10 aa, Artificial Sequence
  Description of Artificial Sequence: Synthetic peptide
  Seed: VGADGVGKSA (KRAS G12D)
VGADGVGKSF

SEQ ID NO: 9224 - protein, 10 aa, Artificial Sequence
  Description of Artificial Sequence: Synthetic peptide
  Seed: VGADGVGKSA (KRAS G12D)
VGADGVGKSH

SEQ ID NO: 9225 - protein, 10 aa, Artificial Sequence
  Description of Artificial Sequence: Synthetic peptide
  Seed: VGADGVGKSA (KRAS G12D)
VGADGVGKSI

SEQ ID NO: 9226 - protein, 10 aa, Artificial Sequence
  Description of Artificial Sequence: Synthetic peptide
  Seed: VGADGVGKSA (KRAS G12D)
VGADGVGKSK

SEQ ID NO: 9227 - protein, 10 aa, Artificial Sequence
  Description of Artificial Sequence: Synthetic peptide
  Seed: VGADGVGKSA (KRAS G12D)
VGADGVGKSL

SEQ ID NO: 9228 - protein, 10 aa, Artificial Sequence
  Description of Artificial Sequence: Synthetic peptide
  Seed: VGADGVGKSA (KRAS G12D)
VGADGVGKSM

SEQ ID NO: 9229 - protein, 10 aa, Artificial Sequence
  Description of Artificial Sequence: Synthetic peptide
  Seed: VGADGVGKSA (KRAS G12D)
VGADGVGKSR

SEQ ID NO: 9230 - protein, 10 aa, Artificial Sequence
  Description of Artificial Sequence: Synthetic peptide
  Seed: VGADGVGKSA (KRAS G12D)
VGADGVGKSV

SEQ ID NO: 9231 - protein, 10 aa, Artificial Sequence
  Description of Artificial Sequence: Synthetic peptide
  Seed: VGADGVGKSA (KRAS G12D)
VGADGVGKSW

SEQ ID NO: 9232 - protein, 10 aa, Artificial Sequence
  Description of Artificial Sequence: Synthetic peptide
  Seed: VGADGVGKSA (KRAS G12D)
VGADGVGKSY

SEQ ID NO: 9233 - protein, 8 aa, Artificial Sequence
  Description of Artificial Sequence: Synthetic peptide
  Seed: VGADGVGK (KRAS G12D)
VGADGVGL

SEQ ID NO: 9234 - protein, 8 aa, Artificial Sequence
  Description of Artificial Sequence: Synthetic peptide
  Seed: VGADGVGK (KRAS G12D)
VGADGVGR

SEQ ID NO: 9235 - protein, 8 aa, Artificial Sequence
  Description of Artificial Sequence: Synthetic peptide
  Seed: VGADGVGK (KRAS G12D)
VGADGVGY

SEQ ID NO: 9236 - protein, 9 aa, Artificial Sequence
  Description of Artificial Sequence: Synthetic peptide
  Seed: VVGADGVGK (KRAS G12D)
VGGADGVGF

SEQ ID NO: 9237 - protein, 9 aa, Artificial Sequence
  Description of Artificial Sequence: Synthetic peptide
  Seed: VVGADGVGK (KRAS G12D)
VGGADGVGK

SEQ ID NO: 9238 - protein, 9 aa, Artificial Sequence
  Description of Artificial Sequence: Synthetic peptide
  Seed: VVGADGVGK (KRAS G12D)
VGGADGVGR

SEQ ID NO: 9239 - protein, 9 aa, Artificial Sequence
  Description of Artificial Sequence: Synthetic peptide
  Seed: VVGADGVGK (KRAS G12D)
VGGADGVGY

SEQ ID NO: 9240 - protein, 10 aa, Artificial Sequence
  Description of Artificial Sequence: Synthetic peptide
  Seed: VVVGADGVGK (KRAS G12D)
VGVGADGVGE

SEQ ID NO: 9241 - protein, 10 aa, Artificial Sequence
  Description of Artificial Sequence: Synthetic peptide
  Seed: VVVGADGVGK (KRAS G12D)
VGVGADGVGF

SEQ ID NO: 9242 - protein, 10 aa, Artificial Sequence
  Description of Artificial Sequence: Synthetic peptide
  Seed: VVVGADGVGK (KRAS G12D)
VGVGADGVGH

SEQ ID NO: 9243 - protein, 10 aa, Artificial Sequence
  Description of Artificial Sequence: Synthetic peptide
  Seed: VVVGADGVGK (KRAS G12D)
VGVGADGVGK

SEQ ID NO: 9244 - protein, 10 aa, Artificial Sequence
  Description of Artificial Sequence: Synthetic peptide
  Seed: VVVGADGVGK (KRAS G12D)
VGVGADGVGL

SEQ ID NO: 9245 - protein, 10 aa, Artificial Sequence
  Description of Artificial Sequence: Synthetic peptide
  Seed: VVVGADGVGK (KRAS G12D)
VGVGADGVGM

SEQ ID NO: 9246 - protein, 10 aa, Artificial Sequence
  Description of Artificial Sequence: Synthetic peptide
  Seed: VVVGADGVGK (KRAS G12D)
VGVGADGVGQ

SEQ ID NO: 9247 - protein, 10 aa, Artificial Sequence
  Description of Artificial Sequence: Synthetic peptide
  Seed: VVVGADGVGK (KRAS G12D)
VGVGADGVGR

SEQ ID NO: 9248 - protein, 10 aa, Artificial Sequence
  Description of Artificial Sequence: Synthetic peptide
  Seed: VVVGADGVGK (KRAS G12D)
VGVGADGVGY

SEQ ID NO: 9249 - protein, 8 aa, Artificial Sequence
  Description of Artificial Sequence: Synthetic peptide
  Seed: VGADGVGK (KRAS G12D)
VHADGVGK

SEQ ID NO: 9250 - protein, 11 aa, Artificial Sequence
  Description of Artificial Sequence: Synthetic peptide
  Seed: VGADGVGKSAL (KRAS G12D)
VHADGVGKSAF

SEQ ID NO: 9251 - protein, 11 aa, Artificial Sequence
  Description of Artificial Sequence: Synthetic peptide
  Seed: VGADGVGKSAL (KRAS G12D)
VHADGVGKSAI

SEQ ID NO: 9252 - protein, 11 aa, Artificial Sequence
  Description of Artificial Sequence: Synthetic peptide
  Seed: VGADGVGKSAL (KRAS G12D)
VHADGVGKSAK

SEQ ID NO: 9253 - protein, 11 aa, Artificial Sequence
  Description of Artificial Sequence: Synthetic peptide
  Seed: VGADGVGKSAL (KRAS G12D)
VHADGVGKSAL

SEQ ID NO: 9254 - protein, 11 aa, Artificial Sequence
  Description of Artificial Sequence: Synthetic peptide
  Seed: VGADGVGKSAL (KRAS G12D)
VHADGVGKSAM

SEQ ID NO: 9255 - protein, 11 aa, Artificial Sequence
  Description of Artificial Sequence: Synthetic peptide
  Seed: VGADGVGKSAL (KRAS G12D)
VHADGVGKSAR

SEQ ID NO: 9256 - protein, 11 aa, Artificial Sequence
  Description of Artificial Sequence: Synthetic peptide
  Seed: VGADGVGKSAL (KRAS G12D)
VHADGVGKSAV

SEQ ID NO: 9257 - protein, 11 aa, Artificial Sequence
  Description of Artificial Sequence: Synthetic peptide
  Seed: VGADGVGKSAL (KRAS G12D)
VHADGVGKSAW

SEQ ID NO: 9258 - protein, 11 aa, Artificial Sequence
  Description of Artificial Sequence: Synthetic peptide
  Seed: VGADGVGKSAL (KRAS G12D)
VHADGVGKSAY

SEQ ID NO: 9259 - protein, 10 aa, Artificial Sequence
  Description of Artificial Sequence: Synthetic peptide
  Seed: VGADGVGKSA (KRAS G12D)
VHADGVGKSF

SEQ ID NO: 9260 - protein, 10 aa, Artificial Sequence
  Description of Artificial Sequence: Synthetic peptide
  Seed: VGADGVGKSA (KRAS G12D)
VHADGVGKSK

SEQ ID NO: 9261 - protein, 10 aa, Artificial Sequence
  Description of Artificial Sequence: Synthetic peptide
  Seed: VGADGVGKSA (KRAS G12D)
VHADGVGKSY

SEQ ID NO: 9262 - protein, 9 aa, Artificial Sequence
  Description of Artificial Sequence: Synthetic peptide
  Seed: VVGADGVGK (KRAS G12D)
VHGADGVGK

SEQ ID NO: 9263 - protein, 9 aa, Artificial Sequence
  Description of Artificial Sequence: Synthetic peptide
  Seed: VVGADGVGK (KRAS G12D)
VHGADGVGR

SEQ ID NO: 9264 - protein, 10 aa, Artificial Sequence
  Description of Artificial Sequence: Synthetic peptide
  Seed: VVVGADGVGK (KRAS G12D)
VHVGADGVGK

SEQ ID NO: 9265 - protein, 10 aa, Artificial Sequence
  Description of Artificial Sequence: Synthetic peptide
  Seed: VVVGADGVGK (KRAS G12D)
VHVGADGVGR

SEQ ID NO: 9266 - protein, 10 aa, Artificial Sequence
  Description of Artificial Sequence: Synthetic peptide
  Seed: VVVGADGVGK (KRAS G12D)
VHVGADGVGY

SEQ ID NO: 9267 - protein, 8 aa, Artificial Sequence
  Description of Artificial Sequence: Synthetic peptide
  Seed: VGADGVGK (KRAS G12D)
VIADGVGF

SEQ ID NO: 9268 - protein, 8 aa, Artificial Sequence
  Description of Artificial Sequence: Synthetic peptide
  Seed: VGADGVGK (KRAS G12D)
VIADGVGK

SEQ ID NO: 9269 - protein, 10 aa, Artificial Sequence
  Description of Artificial Sequence: Synthetic peptide
  Seed: VGADGVGKSA (KRAS G12D)
VIADGVGKSA

SEQ ID NO: 9270 - protein, 11 aa, Artificial Sequence
  Description of Artificial Sequence: Synthetic peptide
  Seed: VGADGVGKSAL (KRAS G12D)
VIADGVGKSAF

SEQ ID NO: 9271 - protein, 11 aa, Artificial Sequence
  Description of Artificial Sequence: Synthetic peptide
  Seed: VGADGVGKSAL (KRAS G12D)
VIADGVGKSAH

SEQ ID NO: 9272 - protein, 11 aa, Artificial Sequence
  Description of Artificial Sequence: Synthetic peptide
  Seed: VGADGVGKSAL (KRAS G12D)
VIADGVGKSAI

SEQ ID NO: 9273 - protein, 11 aa, Artificial Sequence
  Description of Artificial Sequence: Synthetic peptide
  Seed: VGADGVGKSAL (KRAS G12D)
VIADGVGKSAK

SEQ ID NO: 9274 - protein, 11 aa, Artificial Sequence
  Description of Artificial Sequence: Synthetic peptide
  Seed: VGADGVGKSAL (KRAS G12D)
VIADGVGKSAL

SEQ ID NO: 9275 - protein, 11 aa, Artificial Sequence
  Description of Artificial Sequence: Synthetic peptide
  Seed: VGADGVGKSAL (KRAS G12D)
VIADGVGKSAM

SEQ ID NO: 9276 - protein, 11 aa, Artificial Sequence
  Description of Artificial Sequence: Synthetic peptide
  Seed: VGADGVGKSAL (KRAS G12D)
VIADGVGKSAQ

SEQ ID NO: 9277 - protein, 11 aa, Artificial Sequence
  Description of Artificial Sequence: Synthetic peptide
  Seed: VGADGVGKSAL (KRAS G12D)
VIADGVGKSAR

SEQ ID NO: 9278 - protein, 11 aa, Artificial Sequence
  Description of Artificial Sequence: Synthetic peptide
  Seed: VGADGVGKSAL (KRAS G12D)
VIADGVGKSAV

SEQ ID NO: 9279 - protein, 11 aa, Artificial Sequence
  Description of Artificial Sequence: Synthetic peptide
  Seed: VGADGVGKSAL (KRAS G12D)
VIADGVGKSAW

SEQ ID NO: 9280 - protein, 11 aa, Artificial Sequence
  Description of Artificial Sequence: Synthetic peptide
  Seed: VGADGVGKSAL (KRAS G12D)
VIADGVGKSAY

SEQ ID NO: 9281 - protein, 10 aa, Artificial Sequence
  Description of Artificial Sequence: Synthetic peptide
  Seed: VGADGVGKSA (KRAS G12D)
VIADGVGKSC

SEQ ID NO: 9282 - protein, 10 aa, Artificial Sequence
  Description of Artificial Sequence: Synthetic peptide
  Seed: VGADGVGKSA (KRAS G12D)
VIADGVGKSF

SEQ ID NO: 9283 - protein, 10 aa, Artificial Sequence
  Description of Artificial Sequence: Synthetic peptide
  Seed: VGADGVGKSA (KRAS G12D)
VIADGVGKSH

SEQ ID NO: 9284 - protein, 10 aa, Artificial Sequence
  Description of Artificial Sequence: Synthetic peptide
  Seed: VGADGVGKSA (KRAS G12D)
VIADGVGKSI

SEQ ID NO: 9285 - protein, 10 aa, Artificial Sequence
  Description of Artificial Sequence: Synthetic peptide
  Seed: VGADGVGKSA (KRAS G12D)
VIADGVGKSK

SEQ ID NO: 9286 - protein, 10 aa, Artificial Sequence
  Description of Artificial Sequence: Synthetic peptide
  Seed: VGADGVGKSA (KRAS G12D)
VIADGVGKSL

SEQ ID NO: 9287 - protein, 10 aa, Artificial Sequence
  Description of Artificial Sequence: Synthetic peptide
  Seed: VGADGVGKSA (KRAS G12D)
VIADGVGKSM

SEQ ID NO: 9288 - protein, 10 aa, Artificial Sequence
  Description of Artificial Sequence: Synthetic peptide
  Seed: VGADGVGKSA (KRAS G12D)
VIADGVGKSQ

SEQ ID NO: 9289 - protein, 10 aa, Artificial Sequence
  Description of Artificial Sequence: Synthetic peptide
  Seed: VGADGVGKSA (KRAS G12D)
VIADGVGKSR

SEQ ID NO: 9290 - protein, 10 aa, Artificial Sequence
  Description of Artificial Sequence: Synthetic peptide
  Seed: VGADGVGKSA (KRAS G12D)
VIADGVGKST

SEQ ID NO: 9291 - protein, 10 aa, Artificial Sequence
  Description of Artificial Sequence: Synthetic peptide
  Seed: VGADGVGKSA (KRAS G12D)
VIADGVGKSV

SEQ ID NO: 9292 - protein, 10 aa, Artificial Sequence
  Description of Artificial Sequence: Synthetic peptide
  Seed: VGADGVGKSA (KRAS G12D)
VIADGVGKSW

SEQ ID NO: 9293 - protein, 10 aa, Artificial Sequence
  Description of Artificial Sequence: Synthetic peptide
  Seed: VGADGVGKSA (KRAS G12D)
VIADGVGKSY

SEQ ID NO: 9294 - protein, 8 aa, Artificial Sequence
  Description of Artificial Sequence: Synthetic peptide
  Seed: VGADGVGK (KRAS G12D)
VIADGVGL

SEQ ID NO: 9295 - protein, 8 aa, Artificial Sequence
  Description of Artificial Sequence: Synthetic peptide
  Seed: VGADGVGK (KRAS G12D)
VIADGVGR

SEQ ID NO: 9296 - protein, 8 aa, Artificial Sequence
  Description of Artificial Sequence: Synthetic peptide
  Seed: VGADGVGK (KRAS G12D)
VIADGVGY

SEQ ID NO: 9297 - protein, 9 aa, Artificial Sequence
  Description of Artificial Sequence: Synthetic peptide
  Seed: VVGADGVGK (KRAS G12D)
VIGADGVGF

SEQ ID NO: 9298 - protein, 9 aa, Artificial Sequence
  Description of Artificial Sequence: Synthetic peptide
  Seed: VVGADGVGK (KRAS G12D)
VIGADGVGM

SEQ ID NO: 9299 - protein, 9 aa, Artificial Sequence
  Description of Artificial Sequence: Synthetic peptide
  Seed: VVGADGVGK (KRAS G12D)
VIGADGVGR

SEQ ID NO: 9300 - protein, 9 aa, Artificial Sequence
  Description of Artificial Sequence: Synthetic peptide
  Seed: VVGADGVGK (KRAS G12D)
VIGADGVGY

SEQ ID NO: 9301 - protein, 10 aa, Artificial Sequence
  Description of Artificial Sequence: Synthetic peptide
  Seed: VVVGADGVGK (KRAS G12D)
VIVGADGVGE

SEQ ID NO: 9302 - protein, 10 aa, Artificial Sequence
  Description of Artificial Sequence: Synthetic peptide
  Seed: VVVGADGVGK (KRAS G12D)
VIVGADGVGF

SEQ ID NO: 9303 - protein, 10 aa, Artificial Sequence
  Description of Artificial Sequence: Synthetic peptide
  Seed: VVVGADGVGK (KRAS G12D)
VIVGADGVGH

SEQ ID NO: 9304 - protein, 10 aa, Artificial Sequence
  Description of Artificial Sequence: Synthetic peptide
  Seed: VVVGADGVGK (KRAS G12D)
VIVGADGVGL

SEQ ID NO: 9305 - protein, 10 aa, Artificial Sequence
  Description of Artificial Sequence: Synthetic peptide
  Seed: VVVGADGVGK (KRAS G12D)
VIVGADGVGM

SEQ ID NO: 9306 - protein, 10 aa, Artificial Sequence
  Description of Artificial Sequence: Synthetic peptide
  Seed: VVVGADGVGK (KRAS G12D)
VIVGADGVGQ

SEQ ID NO: 9307 - protein, 10 aa, Artificial Sequence
  Description of Artificial Sequence: Synthetic peptide
  Seed: VVVGADGVGK (KRAS G12D)
VIVGADGVGY

SEQ ID NO: 9308 - protein, 11 aa, Artificial Sequence
  Description of Artificial Sequence: Synthetic peptide
  Seed: VGADGVGKSAL (KRAS G12D)
VKADGVGKSAF

SEQ ID NO: 9309 - protein, 11 aa, Artificial Sequence
  Description of Artificial Sequence: Synthetic peptide
  Seed: VGADGVGKSAL (KRAS G12D)
VKADGVGKSAK

SEQ ID NO: 9310 - protein, 11 aa, Artificial Sequence
  Description of Artificial Sequence: Synthetic peptide
  Seed: VGADGVGKSAL (KRAS G12D)
VKADGVGKSAL

SEQ ID NO: 9311 - protein, 11 aa, Artificial Sequence
  Description of Artificial Sequence: Synthetic peptide
  Seed: VGADGVGKSAL (KRAS G12D)
VKADGVGKSAM

SEQ ID NO: 9312 - protein, 11 aa, Artificial Sequence
  Description of Artificial Sequence: Synthetic peptide
  Seed: VGADGVGKSAL (KRAS G12D)
VKADGVGKSAR

SEQ ID NO: 9313 - protein, 11 aa, Artificial Sequence
  Description of Artificial Sequence: Synthetic peptide
  Seed: VGADGVGKSAL (KRAS G12D)
VKADGVGKSAW

SEQ ID NO: 9314 - protein, 11 aa, Artificial Sequence
  Description of Artificial Sequence: Synthetic peptide
  Seed: VGADGVGKSAL (KRAS G12D)
VKADGVGKSAY

SEQ ID NO: 9315 - protein, 10 aa, Artificial Sequence
  Description of Artificial Sequence: Synthetic peptide
  Seed: VGADGVGKSA (KRAS G12D)
VKADGVGKSF

SEQ ID NO: 9316 - protein, 10 aa, Artificial Sequence
  Description of Artificial Sequence: Synthetic peptide
  Seed: VGADGVGKSA (KRAS G12D)
VKADGVGKSH

SEQ ID NO: 9317 - protein, 10 aa, Artificial Sequence
  Description of Artificial Sequence: Synthetic peptide
  Seed: VGADGVGKSA (KRAS G12D)
VKADGVGKSL

SEQ ID NO: 9318 - protein, 10 aa, Artificial Sequence
  Description of Artificial Sequence: Synthetic peptide
  Seed: VGADGVGKSA (KRAS G12D)
VKADGVGKSM

SEQ ID NO: 9319 - protein, 10 aa, Artificial Sequence
  Description of Artificial Sequence: Synthetic peptide
  Seed: VGADGVGKSA (KRAS G12D)
VKADGVGKSY

SEQ ID NO: 9320 - protein, 10 aa, Artificial Sequence
  Description of Artificial Sequence: Synthetic peptide
  Seed: VVVGADGVGK (KRAS G12D)
VKVGADGVGK

SEQ ID NO: 9321 - protein, 10 aa, Artificial Sequence
  Description of Artificial Sequence: Synthetic peptide
  Seed: VVVGADGVGK (KRAS G12D)
VKVGADGVGR

SEQ ID NO: 9322 - protein, 10 aa, Artificial Sequence
  Description of Artificial Sequence: Synthetic peptide
  Seed: VVVGADGVGK (KRAS G12D)
VKVGADGVGY

SEQ ID NO: 9323 - protein, 8 aa, Artificial Sequence
  Description of Artificial Sequence: Synthetic peptide
  Seed: VGADGVGK (KRAS G12D)
VLADGVGK

SEQ ID NO: 9324 - protein, 10 aa, Artificial Sequence
  Description of Artificial Sequence: Synthetic peptide
  Seed: VGADGVGKSA (KRAS G12D)
VLADGVGKSA

SEQ ID NO: 9325 - protein, 11 aa, Artificial Sequence
  Description of Artificial Sequence: Synthetic peptide
  Seed: VGADGVGKSAL (KRAS G12D)
VLADGVGKSAF

SEQ ID NO: 9326 - protein, 11 aa, Artificial Sequence
  Description of Artificial Sequence: Synthetic peptide
  Seed: VGADGVGKSAL (KRAS G12D)
VLADGVGKSAH

SEQ ID NO: 9327 - protein, 11 aa, Artificial Sequence
  Description of Artificial Sequence: Synthetic peptide
  Seed: VGADGVGKSAL (KRAS G12D)
VLADGVGKSAI

SEQ ID NO: 9328 - protein, 11 aa, Artificial Sequence
  Description of Artificial Sequence: Synthetic peptide
  Seed: VGADGVGKSAL (KRAS G12D)
VLADGVGKSAK

SEQ ID NO: 9329 - protein, 11 aa, Artificial Sequence
  Description of Artificial Sequence: Synthetic peptide
  Seed: VGADGVGKSAL (KRAS G12D)
VLADGVGKSAL

SEQ ID NO: 9330 - protein, 11 aa, Artificial Sequence
  Description of Artificial Sequence: Synthetic peptide
  Seed: VGADGVGKSAL (KRAS G12D)
VLADGVGKSAM

SEQ ID NO: 9331 - protein, 11 aa, Artificial Sequence
  Description of Artificial Sequence: Synthetic peptide
  Seed: VGADGVGKSAL (KRAS G12D)
VLADGVGKSAR

SEQ ID NO: 9332 - protein, 11 aa, Artificial Sequence
  Description of Artificial Sequence: Synthetic peptide
  Seed: VGADGVGKSAL (KRAS G12D)
VLADGVGKSAV

SEQ ID NO: 9333 - protein, 11 aa, Artificial Sequence
  Description of Artificial Sequence: Synthetic peptide
  Seed: VGADGVGKSAL (KRAS G12D)
VLADGVGKSAW

SEQ ID NO: 9334 - protein, 11 aa, Artificial Sequence
  Description of Artificial Sequence: Synthetic peptide
  Seed: VGADGVGKSAL (KRAS G12D)
VLADGVGKSAY

SEQ ID NO: 9335 - protein, 10 aa, Artificial Sequence
  Description of Artificial Sequence: Synthetic peptide
  Seed: VGADGVGKSA (KRAS G12D)
VLADGVGKSC

SEQ ID NO: 9336 - protein, 10 aa, Artificial Sequence
  Description of Artificial Sequence: Synthetic peptide
  Seed: VGADGVGKSA (KRAS G12D)
VLADGVGKSF

SEQ ID NO: 9337 - protein, 10 aa, Artificial Sequence
  Description of Artificial Sequence: Synthetic peptide
  Seed: VGADGVGKSA (KRAS G12D)
VLADGVGKSH

SEQ ID NO: 9338 - protein, 10 aa, Artificial Sequence
  Description of Artificial Sequence: Synthetic peptide
  Seed: VGADGVGKSA (KRAS G12D)
VLADGVGKSI

SEQ ID NO: 9339 - protein, 10 aa, Artificial Sequence
  Description of Artificial Sequence: Synthetic peptide
  Seed: VGADGVGKSA (KRAS G12D)
VLADGVGKSK

SEQ ID NO: 9340 - protein, 10 aa, Artificial Sequence
  Description of Artificial Sequence: Synthetic peptide
  Seed: VGADGVGKSA (KRAS G12D)
VLADGVGKSL

SEQ ID NO: 9341 - protein, 10 aa, Artificial Sequence
  Description of Artificial Sequence: Synthetic peptide
  Seed: VGADGVGKSA (KRAS G12D)
VLADGVGKSM

SEQ ID NO: 9342 - protein, 10 aa, Artificial Sequence
  Description of Artificial Sequence: Synthetic peptide
  Seed: VGADGVGKSA (KRAS G12D)
VLADGVGKSR

SEQ ID NO: 9343 - protein, 10 aa, Artificial Sequence
  Description of Artificial Sequence: Synthetic peptide
  Seed: VGADGVGKSA (KRAS G12D)
VLADGVGKSV

SEQ ID NO: 9344 - protein, 10 aa, Artificial Sequence
  Description of Artificial Sequence: Synthetic peptide
  Seed: VGADGVGKSA (KRAS G12D)
VLADGVGKSW

SEQ ID NO: 9345 - protein, 10 aa, Artificial Sequence
  Description of Artificial Sequence: Synthetic peptide
  Seed: VGADGVGKSA (KRAS G12D)
VLADGVGKSY

SEQ ID NO: 9346 - protein, 8 aa, Artificial Sequence
  Description of Artificial Sequence: Synthetic peptide
  Seed: VGADGVGK (KRAS G12D)
VLADGVGR

SEQ ID NO: 9347 - protein, 8 aa, Artificial Sequence
  Description of Artificial Sequence: Synthetic peptide
  Seed: VGADGVGK (KRAS G12D)
VLADGVGY

SEQ ID NO: 9348 - protein, 9 aa, Artificial Sequence
  Description of Artificial Sequence: Synthetic peptide
  Seed: VVGADGVGK (KRAS G12D)
VLGADGVGR

SEQ ID NO: 9349 - protein, 9 aa, Artificial Sequence
  Description of Artificial Sequence: Synthetic peptide
  Seed: VVGADGVGK (KRAS G12D)
VLGADGVGY

SEQ ID NO: 9350 - protein, 10 aa, Artificial Sequence
  Description of Artificial Sequence: Synthetic peptide
  Seed: VVVGADGVGK (KRAS G12D)
VLVGADGVGF

SEQ ID NO: 9351 - protein, 10 aa, Artificial Sequence
  Description of Artificial Sequence: Synthetic peptide
  Seed: VVVGADGVGK (KRAS G12D)
VLVGADGVGH

SEQ ID NO: 9352 - protein, 10 aa, Artificial Sequence
  Description of Artificial Sequence: Synthetic peptide
  Seed: VVVGADGVGK (KRAS G12D)
VLVGADGVGK

SEQ ID NO: 9353 - protein, 10 aa, Artificial Sequence
  Description of Artificial Sequence: Synthetic peptide
  Seed: VVVGADGVGK (KRAS G12D)
VLVGADGVGL

SEQ ID NO: 9354 - protein, 10 aa, Artificial Sequence
  Description of Artificial Sequence: Synthetic peptide
  Seed: VVVGADGVGK (KRAS G12D)
VLVGADGVGM

SEQ ID NO: 9355 - protein, 10 aa, Artificial Sequence
  Description of Artificial Sequence: Synthetic peptide
  Seed: VVVGADGVGK (KRAS G12D)
VLVGADGVGQ

SEQ ID NO: 9356 - protein, 10 aa, Artificial Sequence
  Description of Artificial Sequence: Synthetic peptide
  Seed: VVVGADGVGK (KRAS G12D)
VLVGADGVGR

SEQ ID NO: 9357 - protein, 10 aa, Artificial Sequence
  Description of Artificial Sequence: Synthetic peptide
  Seed: VVVGADGVGK (KRAS G12D)
VLVGADGVGY

SEQ ID NO: 9358 - protein, 8 aa, Artificial Sequence
  Description of Artificial Sequence: Synthetic peptide
  Seed: VGADGVGK (KRAS G12D)
VMADGVGK

SEQ ID NO: 9359 - protein, 10 aa, Artificial Sequence
  Description of Artificial Sequence: Synthetic peptide
  Seed: VGADGVGKSA (KRAS G12D)
VMADGVGKSA

SEQ ID NO: 9360 - protein, 11 aa, Artificial Sequence
  Description of Artificial Sequence: Synthetic peptide
  Seed: VGADGVGKSAL (KRAS G12D)
VMADGVGKSAF

SEQ ID NO: 9361 - protein, 11 aa, Artificial Sequence
  Description of Artificial Sequence: Synthetic peptide
  Seed: VGADGVGKSAL (KRAS G12D)
VMADGVGKSAH

SEQ ID NO: 9362 - protein, 11 aa, Artificial Sequence
  Description of Artificial Sequence: Synthetic peptide
  Seed: VGADGVGKSAL (KRAS G12D)
VMADGVGKSAI

SEQ ID NO: 9363 - protein, 11 aa, Artificial Sequence
  Description of Artificial Sequence: Synthetic peptide
  Seed: VGADGVGKSAL (KRAS G12D)
VMADGVGKSAK

SEQ ID NO: 9364 - protein, 11 aa, Artificial Sequence
  Description of Artificial Sequence: Synthetic peptide
  Seed: VGADGVGKSAL (KRAS G12D)
VMADGVGKSAL

SEQ ID NO: 9365 - protein, 11 aa, Artificial Sequence
  Description of Artificial Sequence: Synthetic peptide
  Seed: VGADGVGKSAL (KRAS G12D)
VMADGVGKSAM

SEQ ID NO: 9366 - protein, 11 aa, Artificial Sequence
  Description of Artificial Sequence: Synthetic peptide
  Seed: VGADGVGKSAL (KRAS G12D)
VMADGVGKSAR

SEQ ID NO: 9367 - protein, 11 aa, Artificial Sequence
  Description of Artificial Sequence: Synthetic peptide
  Seed: VGADGVGKSAL (KRAS G12D)
VMADGVGKSAV

SEQ ID NO: 9368 - protein, 11 aa, Artificial Sequence
  Description of Artificial Sequence: Synthetic peptide
  Seed: VGADGVGKSAL (KRAS G12D)
VMADGVGKSAW

SEQ ID NO: 9369 - protein, 11 aa, Artificial Sequence
  Description of Artificial Sequence: Synthetic peptide
  Seed: VGADGVGKSAL (KRAS G12D)
VMADGVGKSAY

SEQ ID NO: 9370 - protein, 10 aa, Artificial Sequence
  Description of Artificial Sequence: Synthetic peptide
  Seed: VGADGVGKSA (KRAS G12D)
VMADGVGKSC

SEQ ID NO: 9371 - protein, 10 aa, Artificial Sequence
  Description of Artificial Sequence: Synthetic peptide
  Seed: VGADGVGKSA (KRAS G12D)
VMADGVGKSF

SEQ ID NO: 9372 - protein, 10 aa, Artificial Sequence
  Description of Artificial Sequence: Synthetic peptide
  Seed: VGADGVGKSA (KRAS G12D)
VMADGVGKSH

SEQ ID NO: 9373 - protein, 10 aa, Artificial Sequence
  Description of Artificial Sequence: Synthetic peptide
  Seed: VGADGVGKSA (KRAS G12D)
VMADGVGKSI

SEQ ID NO: 9374 - protein, 10 aa, Artificial Sequence
  Description of Artificial Sequence: Synthetic peptide
  Seed: VGADGVGKSA (KRAS G12D)
VMADGVGKSK

SEQ ID NO: 9375 - protein, 10 aa, Artificial Sequence
  Description of Artificial Sequence: Synthetic peptide
  Seed: VGADGVGKSA (KRAS G12D)
VMADGVGKSL

SEQ ID NO: 9376 - protein, 10 aa, Artificial Sequence
  Description of Artificial Sequence: Synthetic peptide
  Seed: VGADGVGKSA (KRAS G12D)
VMADGVGKSM

SEQ ID NO: 9377 - protein, 10 aa, Artificial Sequence
  Description of Artificial Sequence: Synthetic peptide
  Seed: VGADGVGKSA (KRAS G12D)
VMADGVGKSQ

SEQ ID NO: 9378 - protein, 10 aa, Artificial Sequence
  Description of Artificial Sequence: Synthetic peptide
  Seed: VGADGVGKSA (KRAS G12D)
VMADGVGKSR

SEQ ID NO: 9379 - protein, 10 aa, Artificial Sequence
  Description of Artificial Sequence: Synthetic peptide
  Seed: VGADGVGKSA (KRAS G12D)
VMADGVGKSV

SEQ ID NO: 9380 - protein, 10 aa, Artificial Sequence
  Description of Artificial Sequence: Synthetic peptide
  Seed: VGADGVGKSA (KRAS G12D)
VMADGVGKSW

SEQ ID NO: 9381 - protein, 10 aa, Artificial Sequence
  Description of Artificial Sequence: Synthetic peptide
  Seed: VGADGVGKSA (KRAS G12D)
VMADGVGKSY

SEQ ID NO: 9382 - protein, 8 aa, Artificial Sequence
  Description of Artificial Sequence: Synthetic peptide
  Seed: VGADGVGK (KRAS G12D)
VMADGVGR

SEQ ID NO: 9383 - protein, 8 aa, Artificial Sequence
  Description of Artificial Sequence: Synthetic peptide
  Seed: VGADGVGK (KRAS G12D)
VMADGVGY

SEQ ID NO: 9384 - protein, 9 aa, Artificial Sequence
  Description of Artificial Sequence: Synthetic peptide
  Seed: VVGADGVGK (KRAS G12D)
VMGADGVGF

SEQ ID NO: 9385 - protein, 9 aa, Artificial Sequence
  Description of Artificial Sequence: Synthetic peptide
  Seed: VVGADGVGK (KRAS G12D)
VMGADGVGR

SEQ ID NO: 9386 - protein, 9 aa, Artificial Sequence
  Description of Artificial Sequence: Synthetic peptide
  Seed: VVGADGVGK (KRAS G12D)
VMGADGVGY

SEQ ID NO: 9387 - protein, 10 aa, Artificial Sequence
  Description of Artificial Sequence: Synthetic peptide
  Seed: VVVGADGVGK (KRAS G12D)
VMVGADGVGF

SEQ ID NO: 9388 - protein, 10 aa, Artificial Sequence
  Description of Artificial Sequence: Synthetic peptide
  Seed: VVVGADGVGK (KRAS G12D)
VMVGADGVGH

SEQ ID NO: 9389 - protein, 10 aa, Artificial Sequence
  Description of Artificial Sequence: Synthetic peptide
  Seed: VVVGADGVGK (KRAS G12D)
VMVGADGVGL

SEQ ID NO: 9390 - protein, 10 aa, Artificial Sequence
  Description of Artificial Sequence: Synthetic peptide
  Seed: VVVGADGVGK (KRAS G12D)
VMVGADGVGM

SEQ ID NO: 9391 - protein, 10 aa, Artificial Sequence
  Description of Artificial Sequence: Synthetic peptide
  Seed: VVVGADGVGK (KRAS G12D)
VMVGADGVGQ

SEQ ID NO: 9392 - protein, 10 aa, Artificial Sequence
  Description of Artificial Sequence: Synthetic peptide
  Seed: VVVGADGVGK (KRAS G12D)
VMVGADGVGW

SEQ ID NO: 9393 - protein, 10 aa, Artificial Sequence
  Description of Artificial Sequence: Synthetic peptide
  Seed: VVVGADGVGK (KRAS G12D)
VMVGADGVGY

SEQ ID NO: 9394 - protein, 8 aa, Artificial Sequence
  Description of Artificial Sequence: Synthetic peptide
  Seed: VGADGVGK (KRAS G12D)
VNADGVGK

SEQ ID NO: 9395 - protein, 11 aa, Artificial Sequence
  Description of Artificial Sequence: Synthetic peptide
  Seed: VGADGVGKSAL (KRAS G12D)
VNADGVGKSAF

SEQ ID NO: 9396 - protein, 11 aa, Artificial Sequence
  Description of Artificial Sequence: Synthetic peptide
  Seed: VGADGVGKSAL (KRAS G12D)
VNADGVGKSAH

SEQ ID NO: 9397 - protein, 11 aa, Artificial Sequence
  Description of Artificial Sequence: Synthetic peptide
  Seed: VGADGVGKSAL (KRAS G12D)
VNADGVGKSAK

SEQ ID NO: 9398 - protein, 11 aa, Artificial Sequence
  Description of Artificial Sequence: Synthetic peptide
  Seed: VGADGVGKSAL (KRAS G12D)
VNADGVGKSAL

SEQ ID NO: 9399 - protein, 11 aa, Artificial Sequence
  Description of Artificial Sequence: Synthetic peptide
  Seed: VGADGVGKSAL (KRAS G12D)
VNADGVGKSAM

SEQ ID NO: 9400 - protein, 11 aa, Artificial Sequence
  Description of Artificial Sequence: Synthetic peptide
  Seed: VGADGVGKSAL (KRAS G12D)
VNADGVGKSAR

SEQ ID NO: 9401 - protein, 11 aa, Artificial Sequence
  Description of Artificial Sequence: Synthetic peptide
  Seed: VGADGVGKSAL (KRAS G12D)
VNADGVGKSAW

SEQ ID NO: 9402 - protein, 11 aa, Artificial Sequence
  Description of Artificial Sequence: Synthetic peptide
  Seed: VGADGVGKSAL (KRAS G12D)
VNADGVGKSAY

SEQ ID NO: 9403 - protein, 10 aa, Artificial Sequence
  Description of Artificial Sequence: Synthetic peptide
  Seed: VGADGVGKSA (KRAS G12D)
VNADGVGKSF

SEQ ID NO: 9404 - protein, 10 aa, Artificial Sequence
  Description of Artificial Sequence: Synthetic peptide
  Seed: VGADGVGKSA (KRAS G12D)
VNADGVGKSH

SEQ ID NO: 9405 - protein, 10 aa, Artificial Sequence
  Description of Artificial Sequence: Synthetic peptide
  Seed: VGADGVGKSA (KRAS G12D)
VNADGVGKSI

SEQ ID NO: 9406 - protein, 10 aa, Artificial Sequence
  Description of Artificial Sequence: Synthetic peptide
  Seed: VGADGVGKSA (KRAS G12D)
VNADGVGKSK

SEQ ID NO: 9407 - protein, 10 aa, Artificial Sequence
  Description of Artificial Sequence: Synthetic peptide
  Seed: VGADGVGKSA (KRAS G12D)
VNADGVGKSL

SEQ ID NO: 9408 - protein, 10 aa, Artificial Sequence
  Description of Artificial Sequence: Synthetic peptide
  Seed: VGADGVGKSA (KRAS G12D)
VNADGVGKSM

SEQ ID NO: 9409 - protein, 10 aa, Artificial Sequence
  Description of Artificial Sequence: Synthetic peptide
  Seed: VGADGVGKSA (KRAS G12D)
VNADGVGKSR

SEQ ID NO: 9410 - protein, 10 aa, Artificial Sequence
  Description of Artificial Sequence: Synthetic peptide
  Seed: VGADGVGKSA (KRAS G12D)
VNADGVGKSV

SEQ ID NO: 9411 - protein, 10 aa, Artificial Sequence
  Description of Artificial Sequence: Synthetic peptide
  Seed: VGADGVGKSA (KRAS G12D)
VNADGVGKSW

SEQ ID NO: 9412 - protein, 10 aa, Artificial Sequence
  Description of Artificial Sequence: Synthetic peptide
  Seed: VGADGVGKSA (KRAS G12D)
VNADGVGKSY

SEQ ID NO: 9413 - protein, 8 aa, Artificial Sequence
  Description of Artificial Sequence: Synthetic peptide
  Seed: VGADGVGK (KRAS G12D)
VNADGVGR

SEQ ID NO: 9414 - protein, 9 aa, Artificial Sequence
  Description of Artificial Sequence: Synthetic peptide
  Seed: VVGADGVGK (KRAS G12D)
VNGADGVGK

SEQ ID NO: 9415 - protein, 9 aa, Artificial Sequence
  Description of Artificial Sequence: Synthetic peptide
  Seed: VVGADGVGK (KRAS G12D)
VNGADGVGR

SEQ ID NO: 9416 - protein, 9 aa, Artificial Sequence
  Description of Artificial Sequence: Synthetic peptide
  Seed: VVGADGVGK (KRAS G12D)
VNGADGVGY

SEQ ID NO: 9417 - protein, 10 aa, Artificial Sequence
  Description of Artificial Sequence: Synthetic peptide
  Seed: VVVGADGVGK (KRAS G12D)
VNVGADGVGF

SEQ ID NO: 9418 - protein, 10 aa, Artificial Sequence
  Description of Artificial Sequence: Synthetic peptide
  Seed: VVVGADGVGK (KRAS G12D)
VNVGADGVGK

SEQ ID NO: 9419 - protein, 10 aa, Artificial Sequence
  Description of Artificial Sequence: Synthetic peptide
  Seed: VVVGADGVGK (KRAS G12D)
VNVGADGVGL

SEQ ID NO: 9420 - protein, 10 aa, Artificial Sequence
  Description of Artificial Sequence: Synthetic peptide
  Seed: VVVGADGVGK (KRAS G12D)
VNVGADGVGM

SEQ ID NO: 9421 - protein, 10 aa, Artificial Sequence
  Description of Artificial Sequence: Synthetic peptide
  Seed: VVVGADGVGK (KRAS G12D)
VNVGADGVGQ

SEQ ID NO: 9422 - protein, 10 aa, Artificial Sequence
  Description of Artificial Sequence: Synthetic peptide
  Seed: VVVGADGVGK (KRAS G12D)
VNVGADGVGR

SEQ ID NO: 9423 - protein, 10 aa, Artificial Sequence
  Description of Artificial Sequence: Synthetic peptide
  Seed: VVVGADGVGK (KRAS G12D)
VNVGADGVGY

SEQ ID NO: 9424 - protein, 8 aa, Artificial Sequence
  Description of Artificial Sequence: Synthetic peptide
  Seed: VGADGVGK (KRAS G12D)
VPADGVGK

SEQ ID NO: 9425 - protein, 10 aa, Artificial Sequence
  Description of Artificial Sequence: Synthetic peptide
  Seed: VGADGVGKSA (KRAS G12D)
VPADGVGKSA

SEQ ID NO: 9426 - protein, 11 aa, Artificial Sequence
  Description of Artificial Sequence: Synthetic peptide
  Seed: VGADGVGKSAL (KRAS G12D)
VPADGVGKSAA

SEQ ID NO: 9427 - protein, 11 aa, Artificial Sequence
  Description of Artificial Sequence: Synthetic peptide
  Seed: VGADGVGKSAL (KRAS G12D)
VPADGVGKSAC

SEQ ID NO: 9428 - protein, 11 aa, Artificial Sequence
  Description of Artificial Sequence: Synthetic peptide
  Seed: VGADGVGKSAL (KRAS G12D)
VPADGVGKSAF

SEQ ID NO: 9429 - protein, 11 aa, Artificial Sequence
  Description of Artificial Sequence: Synthetic peptide
  Seed: VGADGVGKSAL (KRAS G12D)
VPADGVGKSAG

SEQ ID NO: 9430 - protein, 11 aa, Artificial Sequence
  Description of Artificial Sequence: Synthetic peptide
  Seed: VGADGVGKSAL (KRAS G12D)
VPADGVGKSAH

SEQ ID NO: 9431 - protein, 11 aa, Artificial Sequence
  Description of Artificial Sequence: Synthetic peptide
  Seed: VGADGVGKSAL (KRAS G12D)
VPADGVGKSAI

SEQ ID NO: 9432 - protein, 11 aa, Artificial Sequence
  Description of Artificial Sequence: Synthetic peptide
  Seed: VGADGVGKSAL (KRAS G12D)
VPADGVGKSAK

SEQ ID NO: 9433 - protein, 11 aa, Artificial Sequence
  Description of Artificial Sequence: Synthetic peptide
  Seed: VGADGVGKSAL (KRAS G12D)
VPADGVGKSAL

SEQ ID NO: 9434 - protein, 11 aa, Artificial Sequence
  Description of Artificial Sequence: Synthetic peptide
  Seed: VGADGVGKSAL (KRAS G12D)
VPADGVGKSAM

SEQ ID NO: 9435 - protein, 11 aa, Artificial Sequence
  Description of Artificial Sequence: Synthetic peptide
  Seed: VGADGVGKSAL (KRAS G12D)
VPADGVGKSAP

SEQ ID NO: 9436 - protein, 11 aa, Artificial Sequence
  Description of Artificial Sequence: Synthetic peptide
  Seed: VGADGVGKSAL (KRAS G12D)
VPADGVGKSAQ

SEQ ID NO: 9437 - protein, 11 aa, Artificial Sequence
  Description of Artificial Sequence: Synthetic peptide
  Seed: VGADGVGKSAL (KRAS G12D)
VPADGVGKSAR

SEQ ID NO: 9438 - protein, 11 aa, Artificial Sequence
  Description of Artificial Sequence: Synthetic peptide
  Seed: VGADGVGKSAL (KRAS G12D)
VPADGVGKSAS

SEQ ID NO: 9439 - protein, 11 aa, Artificial Sequence
  Description of Artificial Sequence: Synthetic peptide
  Seed: VGADGVGKSAL (KRAS G12D)
VPADGVGKSAT

SEQ ID NO: 9440 - protein, 11 aa, Artificial Sequence
  Description of Artificial Sequence: Synthetic peptide
  Seed: VGADGVGKSAL (KRAS G12D)
VPADGVGKSAV

SEQ ID NO: 9441 - protein, 11 aa, Artificial Sequence
  Description of Artificial Sequence: Synthetic peptide
  Seed: VGADGVGKSAL (KRAS G12D)
VPADGVGKSAW

SEQ ID NO: 9442 - protein, 11 aa, Artificial Sequence
  Description of Artificial Sequence: Synthetic peptide
  Seed: VGADGVGKSAL (KRAS G12D)
VPADGVGKSAY

SEQ ID NO: 9443 - protein, 10 aa, Artificial Sequence
  Description of Artificial Sequence: Synthetic peptide
  Seed: VGADGVGKSA (KRAS G12D)
VPADGVGKSC

SEQ ID NO: 9444 - protein, 10 aa, Artificial Sequence
  Description of Artificial Sequence: Synthetic peptide
  Seed: VGADGVGKSA (KRAS G12D)
VPADGVGKSE

SEQ ID NO: 9445 - protein, 10 aa, Artificial Sequence
  Description of Artificial Sequence: Synthetic peptide
  Seed: VGADGVGKSA (KRAS G12D)
VPADGVGKSF

SEQ ID NO: 9446 - protein, 10 aa, Artificial Sequence
  Description of Artificial Sequence: Synthetic peptide
  Seed: VGADGVGKSA (KRAS G12D)
VPADGVGKSG

SEQ ID NO: 9447 - protein, 10 aa, Artificial Sequence
  Description of Artificial Sequence: Synthetic peptide
  Seed: VGADGVGKSA (KRAS G12D)
VPADGVGKSH

SEQ ID NO: 9448 - protein, 10 aa, Artificial Sequence
  Description of Artificial Sequence: Synthetic peptide
  Seed: VGADGVGKSA (KRAS G12D)
VPADGVGKSI

SEQ ID NO: 9449 - protein, 10 aa, Artificial Sequence
  Description of Artificial Sequence: Synthetic peptide
  Seed: VGADGVGKSA (KRAS G12D)
VPADGVGKSK

SEQ ID NO: 9450 - protein, 10 aa, Artificial Sequence
  Description of Artificial Sequence: Synthetic peptide
  Seed: VGADGVGKSA (KRAS G12D)
VPADGVGKSL

SEQ ID NO: 9451 - protein, 10 aa, Artificial Sequence
  Description of Artificial Sequence: Synthetic peptide
  Seed: VGADGVGKSA (KRAS G12D)
VPADGVGKSM

SEQ ID NO: 9452 - protein, 10 aa, Artificial Sequence
  Description of Artificial Sequence: Synthetic peptide
  Seed: VGADGVGKSA (KRAS G12D)
VPADGVGKSN

SEQ ID NO: 9453 - protein, 10 aa, Artificial Sequence
  Description of Artificial Sequence: Synthetic peptide
  Seed: VGADGVGKSA (KRAS G12D)
VPADGVGKSP

SEQ ID NO: 9454 - protein, 10 aa, Artificial Sequence
  Description of Artificial Sequence: Synthetic peptide
  Seed: VGADGVGKSA (KRAS G12D)
VPADGVGKSQ

SEQ ID NO: 9455 - protein, 10 aa, Artificial Sequence
  Description of Artificial Sequence: Synthetic peptide
  Seed: VGADGVGKSA (KRAS G12D)
VPADGVGKSR

SEQ ID NO: 9456 - protein, 10 aa, Artificial Sequence
  Description of Artificial Sequence: Synthetic peptide
  Seed: VGADGVGKSA (KRAS G12D)
VPADGVGKSS

SEQ ID NO: 9457 - protein, 10 aa, Artificial Sequence
  Description of Artificial Sequence: Synthetic peptide
  Seed: VGADGVGKSA (KRAS G12D)
VPADGVGKST

SEQ ID NO: 9458 - protein, 10 aa, Artificial Sequence
  Description of Artificial Sequence: Synthetic peptide
  Seed: VGADGVGKSA (KRAS G12D)
VPADGVGKSV

SEQ ID NO: 9459 - protein, 10 aa, Artificial Sequence
  Description of Artificial Sequence: Synthetic peptide
  Seed: VGADGVGKSA (KRAS G12D)
VPADGVGKSW

SEQ ID NO: 9460 - protein, 10 aa, Artificial Sequence
  Description of Artificial Sequence: Synthetic peptide
  Seed: VGADGVGKSA (KRAS G12D)
VPADGVGKSY

SEQ ID NO: 9461 - protein, 9 aa, Artificial Sequence
  Description of Artificial Sequence: Synthetic peptide
  Seed: VVGADGVGK (KRAS G12D)
VPGADGVGK

SEQ ID NO: 9462 - protein, 9 aa, Artificial Sequence
  Description of Artificial Sequence: Synthetic peptide
  Seed: VVGADGVGK (KRAS G12D)
VPGADGVGR

SEQ ID NO: 9463 - protein, 10 aa, Artificial Sequence
  Description of Artificial Sequence: Synthetic peptide
  Seed: VVVGADGVGK (KRAS G12D)
VPVGADGVGK

SEQ ID NO: 9464 - protein, 10 aa, Artificial Sequence
  Description of Artificial Sequence: Synthetic peptide
  Seed: VVVGADGVGK (KRAS G12D)
VPVGADGVGL

SEQ ID NO: 9465 - protein, 10 aa, Artificial Sequence
  Description of Artificial Sequence: Synthetic peptide
  Seed: VVVGADGVGK (KRAS G12D)
VPVGADGVGM

SEQ ID NO: 9466 - protein, 10 aa, Artificial Sequence
  Description of Artificial Sequence: Synthetic peptide
  Seed: VVVGADGVGK (KRAS G12D)
VPVGADGVGR

SEQ ID NO: 9467 - protein, 10 aa, Artificial Sequence
  Description of Artificial Sequence: Synthetic peptide
  Seed: VVVGADGVGK (KRAS G12D)
VPVGADGVGY

SEQ ID NO: 9468 - protein, 8 aa, Artificial Sequence
  Description of Artificial Sequence: Synthetic peptide
  Seed: VGADGVGK (KRAS G12D)
VQADGVGK

SEQ ID NO: 9469 - protein, 10 aa, Artificial Sequence
  Description of Artificial Sequence: Synthetic peptide
  Seed: VGADGVGKSA (KRAS G12D)
VQADGVGKSA

SEQ ID NO: 9470 - protein, 11 aa, Artificial Sequence
  Description of Artificial Sequence: Synthetic peptide
  Seed: VGADGVGKSAL (KRAS G12D)
VQADGVGKSAF

SEQ ID NO: 9471 - protein, 11 aa, Artificial Sequence
  Description of Artificial Sequence: Synthetic peptide
  Seed: VGADGVGKSAL (KRAS G12D)
VQADGVGKSAH

SEQ ID NO: 9472 - protein, 11 aa, Artificial Sequence
  Description of Artificial Sequence: Synthetic peptide
  Seed: VGADGVGKSAL (KRAS G12D)
VQADGVGKSAI

SEQ ID NO: 9473 - protein, 11 aa, Artificial Sequence
  Description of Artificial Sequence: Synthetic peptide
  Seed: VGADGVGKSAL (KRAS G12D)
VQADGVGKSAK

SEQ ID NO: 9474 - protein, 11 aa, Artificial Sequence
  Description of Artificial Sequence: Synthetic peptide
  Seed: VGADGVGKSAL (KRAS G12D)
VQADGVGKSAL

SEQ ID NO: 9475 - protein, 11 aa, Artificial Sequence
  Description of Artificial Sequence: Synthetic peptide
  Seed: VGADGVGKSAL (KRAS G12D)
VQADGVGKSAM

SEQ ID NO: 9476 - protein, 11 aa, Artificial Sequence
  Description of Artificial Sequence: Synthetic peptide
  Seed: VGADGVGKSAL (KRAS G12D)
VQADGVGKSAR

SEQ ID NO: 9477 - protein, 11 aa, Artificial Sequence
  Description of Artificial Sequence: Synthetic peptide
  Seed: VGADGVGKSAL (KRAS G12D)
VQADGVGKSAV

SEQ ID NO: 9478 - protein, 11 aa, Artificial Sequence
  Description of Artificial Sequence: Synthetic peptide
  Seed: VGADGVGKSAL (KRAS G12D)
VQADGVGKSAW

SEQ ID NO: 9479 - protein, 11 aa, Artificial Sequence
  Description of Artificial Sequence: Synthetic peptide
  Seed: VGADGVGKSAL (KRAS G12D)
VQADGVGKSAY

SEQ ID NO: 9480 - protein, 10 aa, Artificial Sequence
  Description of Artificial Sequence: Synthetic peptide
  Seed: VGADGVGKSA (KRAS G12D)
VQADGVGKSC

SEQ ID NO: 9481 - protein, 10 aa, Artificial Sequence
  Description of Artificial Sequence: Synthetic peptide
  Seed: VGADGVGKSA (KRAS G12D)
VQADGVGKSF

SEQ ID NO: 9482 - protein, 10 aa, Artificial Sequence
  Description of Artificial Sequence: Synthetic peptide
  Seed: VGADGVGKSA (KRAS G12D)
VQADGVGKSH

SEQ ID NO: 9483 - protein, 10 aa, Artificial Sequence
  Description of Artificial Sequence: Synthetic peptide
  Seed: VGADGVGKSA (KRAS G12D)
VQADGVGKSI

SEQ ID NO: 9484 - protein, 10 aa, Artificial Sequence
  Description of Artificial Sequence: Synthetic peptide
  Seed: VGADGVGKSA (KRAS G12D)
VQADGVGKSK

SEQ ID NO: 9485 - protein, 10 aa, Artificial Sequence
  Description of Artificial Sequence: Synthetic peptide
  Seed: VGADGVGKSA (KRAS G12D)
VQADGVGKSL

SEQ ID NO: 9486 - protein, 10 aa, Artificial Sequence
  Description of Artificial Sequence: Synthetic peptide
  Seed: VGADGVGKSA (KRAS G12D)
VQADGVGKSM

SEQ ID NO: 9487 - protein, 10 aa, Artificial Sequence
  Description of Artificial Sequence: Synthetic peptide
  Seed: VGADGVGKSA (KRAS G12D)
VQADGVGKSQ

SEQ ID NO: 9488 - protein, 10 aa, Artificial Sequence
  Description of Artificial Sequence: Synthetic peptide
  Seed: VGADGVGKSA (KRAS G12D)
VQADGVGKSR

SEQ ID NO: 9489 - protein, 10 aa, Artificial Sequence
  Description of Artificial Sequence: Synthetic peptide
  Seed: VGADGVGKSA (KRAS G12D)
VQADGVGKSV

SEQ ID NO: 9490 - protein, 10 aa, Artificial Sequence
  Description of Artificial Sequence: Synthetic peptide
  Seed: VGADGVGKSA (KRAS G12D)
VQADGVGKSW

SEQ ID NO: 9491 - protein, 10 aa, Artificial Sequence
  Description of Artificial Sequence: Synthetic peptide
  Seed: VGADGVGKSA (KRAS G12D)
VQADGVGKSY

SEQ ID NO: 9492 - protein, 8 aa, Artificial Sequence
  Description of Artificial Sequence: Synthetic peptide
  Seed: VGADGVGK (KRAS G12D)
VQADGVGR

SEQ ID NO: 9493 - protein, 8 aa, Artificial Sequence
  Description of Artificial Sequence: Synthetic peptide
  Seed: VGADGVGK (KRAS G12D)
VQADGVGY

SEQ ID NO: 9494 - protein, 9 aa, Artificial Sequence
  Description of Artificial Sequence: Synthetic peptide
  Seed: VVGADGVGK (KRAS G12D)
VQGADGVGF

SEQ ID NO: 9495 - protein, 9 aa, Artificial Sequence
  Description of Artificial Sequence: Synthetic peptide
  Seed: VVGADGVGK (KRAS G12D)
VQGADGVGK

SEQ ID NO: 9496 - protein, 9 aa, Artificial Sequence
  Description of Artificial Sequence: Synthetic peptide
  Seed: VVGADGVGK (KRAS G12D)
VQGADGVGR

SEQ ID NO: 9497 - protein, 9 aa, Artificial Sequence
  Description of Artificial Sequence: Synthetic peptide
  Seed: VVGADGVGK (KRAS G12D)
VQGADGVGY

SEQ ID NO: 9498 - protein, 10 aa, Artificial Sequence
  Description of Artificial Sequence: Synthetic peptide
  Seed: VVVGADGVGK (KRAS G12D)
VQVGADGVGF

SEQ ID NO: 9499 - protein, 10 aa, Artificial Sequence
  Description of Artificial Sequence: Synthetic peptide
  Seed: VVVGADGVGK (KRAS G12D)
VQVGADGVGH

SEQ ID NO: 9500 - protein, 10 aa, Artificial Sequence
  Description of Artificial Sequence: Synthetic peptide
  Seed: VVVGADGVGK (KRAS G12D)
VQVGADGVGK

SEQ ID NO: 9501 - protein, 10 aa, Artificial Sequence
  Description of Artificial Sequence: Synthetic peptide
  Seed: VVVGADGVGK (KRAS G12D)
VQVGADGVGL

SEQ ID NO: 9502 - protein, 10 aa, Artificial Sequence
  Description of Artificial Sequence: Synthetic peptide
  Seed: VVVGADGVGK (KRAS G12D)
VQVGADGVGM

SEQ ID NO: 9503 - protein, 10 aa, Artificial Sequence
  Description of Artificial Sequence: Synthetic peptide
  Seed: VVVGADGVGK (KRAS G12D)
VQVGADGVGQ

SEQ ID NO: 9504 - protein, 10 aa, Artificial Sequence
  Description of Artificial Sequence: Synthetic peptide
  Seed: VVVGADGVGK (KRAS G12D)
VQVGADGVGR

SEQ ID NO: 9505 - protein, 10 aa, Artificial Sequence
  Description of Artificial Sequence: Synthetic peptide
  Seed: VVVGADGVGK (KRAS G12D)
VQVGADGVGY

SEQ ID NO: 9506 - protein, 11 aa, Artificial Sequence
  Description of Artificial Sequence: Synthetic peptide
  Seed: VGADGVGKSAL (KRAS G12D)
VRADGVGKSAA

SEQ ID NO: 9507 - protein, 11 aa, Artificial Sequence
  Description of Artificial Sequence: Synthetic peptide
  Seed: VGADGVGKSAL (KRAS G12D)
VRADGVGKSAC

SEQ ID NO: 9508 - protein, 11 aa, Artificial Sequence
  Description of Artificial Sequence: Synthetic peptide
  Seed: VGADGVGKSAL (KRAS G12D)
VRADGVGKSAH

SEQ ID NO: 9509 - protein, 11 aa, Artificial Sequence
  Description of Artificial Sequence: Synthetic peptide
  Seed: VGADGVGKSAL (KRAS G12D)
VRADGVGKSAI

SEQ ID NO: 9510 - protein, 11 aa, Artificial Sequence
  Description of Artificial Sequence: Synthetic peptide
  Seed: VGADGVGKSAL (KRAS G12D)
VRADGVGKSAK

SEQ ID NO: 9511 - protein, 11 aa, Artificial Sequence
  Description of Artificial Sequence: Synthetic peptide
  Seed: VGADGVGKSAL (KRAS G12D)
VRADGVGKSAL

SEQ ID NO: 9512 - protein, 11 aa, Artificial Sequence
  Description of Artificial Sequence: Synthetic peptide
  Seed: VGADGVGKSAL (KRAS G12D)
VRADGVGKSAM

SEQ ID NO: 9513 - protein, 11 aa, Artificial Sequence
  Description of Artificial Sequence: Synthetic peptide
  Seed: VGADGVGKSAL (KRAS G12D)
VRADGVGKSAQ

SEQ ID NO: 9514 - protein, 11 aa, Artificial Sequence
  Description of Artificial Sequence: Synthetic peptide
  Seed: VGADGVGKSAL (KRAS G12D)
VRADGVGKSAR

SEQ ID NO: 9515 - protein, 11 aa, Artificial Sequence
  Description of Artificial Sequence: Synthetic peptide
  Seed: VGADGVGKSAL (KRAS G12D)
VRADGVGKSAV

SEQ ID NO: 9516 - protein, 11 aa, Artificial Sequence
  Description of Artificial Sequence: Synthetic peptide
  Seed: VGADGVGKSAL (KRAS G12D)
VRADGVGKSAW

SEQ ID NO: 9517 - protein, 11 aa, Artificial Sequence
  Description of Artificial Sequence: Synthetic peptide
  Seed: VGADGVGKSAL (KRAS G12D)
VRADGVGKSAY

SEQ ID NO: 9518 - protein, 10 aa, Artificial Sequence
  Description of Artificial Sequence: Synthetic peptide
  Seed: VGADGVGKSA (KRAS G12D)
VRADGVGKSF

SEQ ID NO: 9519 - protein, 10 aa, Artificial Sequence
  Description of Artificial Sequence: Synthetic peptide
  Seed: VGADGVGKSA (KRAS G12D)
VRADGVGKSL

SEQ ID NO: 9520 - protein, 10 aa, Artificial Sequence
  Description of Artificial Sequence: Synthetic peptide
  Seed: VGADGVGKSA (KRAS G12D)
VRADGVGKSM

SEQ ID NO: 9521 - protein, 10 aa, Artificial Sequence
  Description of Artificial Sequence: Synthetic peptide
  Seed: VGADGVGKSA (KRAS G12D)
VRADGVGKSY

SEQ ID NO: 9522 - protein, 8 aa, Artificial Sequence
  Description of Artificial Sequence: Synthetic peptide
  Seed: VGADGVGK (KRAS G12D)
VRADGVGL

SEQ ID NO: 9523 - protein, 10 aa, Artificial Sequence
  Description of Artificial Sequence: Synthetic peptide
  Seed: VVVGADGVGK (KRAS G12D)
VRVGADGVGF

SEQ ID NO: 9524 - protein, 10 aa, Artificial Sequence
  Description of Artificial Sequence: Synthetic peptide
  Seed: VVVGADGVGK (KRAS G12D)
VRVGADGVGK

SEQ ID NO: 9525 - protein, 10 aa, Artificial Sequence
  Description of Artificial Sequence: Synthetic peptide
  Seed: VVVGADGVGK (KRAS G12D)
VRVGADGVGL

SEQ ID NO: 9526 - protein, 10 aa, Artificial Sequence
  Description of Artificial Sequence: Synthetic peptide
  Seed: VVVGADGVGK (KRAS G12D)
VRVGADGVGM

SEQ ID NO: 9527 - protein, 10 aa, Artificial Sequence
  Description of Artificial Sequence: Synthetic peptide
  Seed: VVVGADGVGK (KRAS G12D)
VRVGADGVGR

SEQ ID NO: 9528 - protein, 10 aa, Artificial Sequence
  Description of Artificial Sequence: Synthetic peptide
  Seed: VVVGADGVGK (KRAS G12D)
VRVGADGVGY

SEQ ID NO: 9529 - protein, 8 aa, Artificial Sequence
  Description of Artificial Sequence: Synthetic peptide
  Seed: VGADGVGK (KRAS G12D)
VSADGVGF

SEQ ID NO: 9530 - protein, 8 aa, Artificial Sequence
  Description of Artificial Sequence: Synthetic peptide
  Seed: VGADGVGK (KRAS G12D)
VSADGVGH

SEQ ID NO: 9531 - protein, 8 aa, Artificial Sequence
  Description of Artificial Sequence: Synthetic peptide
  Seed: VGADGVGK (KRAS G12D)
VSADGVGI

SEQ ID NO: 9532 - protein, 8 aa, Artificial Sequence
  Description of Artificial Sequence: Synthetic peptide
  Seed: VGADGVGK (KRAS G12D)
VSADGVGK

SEQ ID NO: 9533 - protein, 10 aa, Artificial Sequence
  Description of Artificial Sequence: Synthetic peptide
  Seed: VGADGVGKSA (KRAS G12D)
VSADGVGKSA

SEQ ID NO: 9534 - protein, 11 aa, Artificial Sequence
  Description of Artificial Sequence: Synthetic peptide
  Seed: VGADGVGKSAL (KRAS G12D)
VSADGVGKSAA

SEQ ID NO: 9535 - protein, 11 aa, Artificial Sequence
  Description of Artificial Sequence: Synthetic peptide
  Seed: VGADGVGKSAL (KRAS G12D)
VSADGVGKSAH

SEQ ID NO: 9536 - protein, 11 aa, Artificial Sequence
  Description of Artificial Sequence: Synthetic peptide
  Seed: VGADGVGKSAL (KRAS G12D)
VSADGVGKSAI

SEQ ID NO: 9537 - protein, 11 aa, Artificial Sequence
  Description of Artificial Sequence: Synthetic peptide
  Seed: VGADGVGKSAL (KRAS G12D)
VSADGVGKSAK

SEQ ID NO: 9538 - protein, 11 aa, Artificial Sequence
  Description of Artificial Sequence: Synthetic peptide
  Seed: VGADGVGKSAL (KRAS G12D)
VSADGVGKSAL

SEQ ID NO: 9539 - protein, 11 aa, Artificial Sequence
  Description of Artificial Sequence: Synthetic peptide
  Seed: VGADGVGKSAL (KRAS G12D)
VSADGVGKSAM

SEQ ID NO: 9540 - protein, 11 aa, Artificial Sequence
  Description of Artificial Sequence: Synthetic peptide
  Seed: VGADGVGKSAL (KRAS G12D)
VSADGVGKSAQ

SEQ ID NO: 9541 - protein, 11 aa, Artificial Sequence
  Description of Artificial Sequence: Synthetic peptide
  Seed: VGADGVGKSAL (KRAS G12D)
VSADGVGKSAR

SEQ ID NO: 9542 - protein, 11 aa, Artificial Sequence
  Description of Artificial Sequence: Synthetic peptide
  Seed: VGADGVGKSAL (KRAS G12D)
VSADGVGKSAV

SEQ ID NO: 9543 - protein, 11 aa, Artificial Sequence
  Description of Artificial Sequence: Synthetic peptide
  Seed: VGADGVGKSAL (KRAS G12D)
VSADGVGKSAW

SEQ ID NO: 9544 - protein, 11 aa, Artificial Sequence
  Description of Artificial Sequence: Synthetic peptide
  Seed: VGADGVGKSAL (KRAS G12D)
VSADGVGKSAY

SEQ ID NO: 9545 - protein, 10 aa, Artificial Sequence
  Description of Artificial Sequence: Synthetic peptide
  Seed: VGADGVGKSA (KRAS G12D)
VSADGVGKSC

SEQ ID NO: 9546 - protein, 10 aa, Artificial Sequence
  Description of Artificial Sequence: Synthetic peptide
  Seed: VGADGVGKSA (KRAS G12D)
VSADGVGKSF

SEQ ID NO: 9547 - protein, 10 aa, Artificial Sequence
  Description of Artificial Sequence: Synthetic peptide
  Seed: VGADGVGKSA (KRAS G12D)
VSADGVGKSH

SEQ ID NO: 9548 - protein, 10 aa, Artificial Sequence
  Description of Artificial Sequence: Synthetic peptide
  Seed: VGADGVGKSA (KRAS G12D)
VSADGVGKSI

SEQ ID NO: 9549 - protein, 10 aa, Artificial Sequence
  Description of Artificial Sequence: Synthetic peptide
  Seed: VGADGVGKSA (KRAS G12D)
VSADGVGKSK

SEQ ID NO: 9550 - protein, 10 aa, Artificial Sequence
  Description of Artificial Sequence: Synthetic peptide
  Seed: VGADGVGKSA (KRAS G12D)
VSADGVGKSL

SEQ ID NO: 9551 - protein, 10 aa, Artificial Sequence
  Description of Artificial Sequence: Synthetic peptide
  Seed: VGADGVGKSA (KRAS G12D)
VSADGVGKSM

SEQ ID NO: 9552 - protein, 10 aa, Artificial Sequence
  Description of Artificial Sequence: Synthetic peptide
  Seed: VGADGVGKSA (KRAS G12D)
VSADGVGKSQ

SEQ ID NO: 9553 - protein, 10 aa, Artificial Sequence
  Description of Artificial Sequence: Synthetic peptide
  Seed: VGADGVGKSA (KRAS G12D)
VSADGVGKSR

SEQ ID NO: 9554 - protein, 10 aa, Artificial Sequence
  Description of Artificial Sequence: Synthetic peptide
  Seed: VGADGVGKSA (KRAS G12D)
VSADGVGKSS

SEQ ID NO: 9555 - protein, 10 aa, Artificial Sequence
  Description of Artificial Sequence: Synthetic peptide
  Seed: VGADGVGKSA (KRAS G12D)
VSADGVGKST

SEQ ID NO: 9556 - protein, 10 aa, Artificial Sequence
  Description of Artificial Sequence: Synthetic peptide
  Seed: VGADGVGKSA (KRAS G12D)
VSADGVGKSV

SEQ ID NO: 9557 - protein, 10 aa, Artificial Sequence
  Description of Artificial Sequence: Synthetic peptide
  Seed: VGADGVGKSA (KRAS G12D)
VSADGVGKSW

SEQ ID NO: 9558 - protein, 10 aa, Artificial Sequence
  Description of Artificial Sequence: Synthetic peptide
  Seed: VGADGVGKSA (KRAS G12D)
VSADGVGKSY

SEQ ID NO: 9559 - protein, 8 aa, Artificial Sequence
  Description of Artificial Sequence: Synthetic peptide
  Seed: VGADGVGK (KRAS G12D)
VSADGVGL

SEQ ID NO: 9560 - protein, 8 aa, Artificial Sequence
  Description of Artificial Sequence: Synthetic peptide
  Seed: VGADGVGK (KRAS G12D)
VSADGVGM

SEQ ID NO: 9561 - protein, 8 aa, Artificial Sequence
  Description of Artificial Sequence: Synthetic peptide
  Seed: VGADGVGK (KRAS G12D)
VSADGVGR

SEQ ID NO: 9562 - protein, 8 aa, Artificial Sequence
  Description of Artificial Sequence: Synthetic peptide
  Seed: VGADGVGK (KRAS G12D)
VSADGVGY

SEQ ID NO: 9563 - protein, 9 aa, Artificial Sequence
  Description of Artificial Sequence: Synthetic peptide
  Seed: VVGADGVGK (KRAS G12D)
VSGADGVGF

SEQ ID NO: 9564 - protein, 9 aa, Artificial Sequence
  Description of Artificial Sequence: Synthetic peptide
  Seed: VVGADGVGK (KRAS G12D)
VSGADGVGH

SEQ ID NO: 9565 - protein, 9 aa, Artificial Sequence
  Description of Artificial Sequence: Synthetic peptide
  Seed: VVGADGVGK (KRAS G12D)
VSGADGVGL

SEQ ID NO: 9566 - protein, 9 aa, Artificial Sequence
  Description of Artificial Sequence: Synthetic peptide
  Seed: VVGADGVGK (KRAS G12D)
VSGADGVGM

SEQ ID NO: 9567 - protein, 9 aa, Artificial Sequence
  Description of Artificial Sequence: Synthetic peptide
  Seed: VVGADGVGK (KRAS G12D)
VSGADGVGR

SEQ ID NO: 9568 - protein, 9 aa, Artificial Sequence
  Description of Artificial Sequence: Synthetic peptide
  Seed: VVGADGVGK (KRAS G12D)
VSGADGVGY

SEQ ID NO: 9569 - protein, 10 aa, Artificial Sequence
  Description of Artificial Sequence: Synthetic peptide
  Seed: VVVGADGVGK (KRAS G12D)
VSVGADGVGE

SEQ ID NO: 9570 - protein, 10 aa, Artificial Sequence
  Description of Artificial Sequence: Synthetic peptide
  Seed: VVVGADGVGK (KRAS G12D)
VSVGADGVGF

SEQ ID NO: 9571 - protein, 10 aa, Artificial Sequence
  Description of Artificial Sequence: Synthetic peptide
  Seed: VVVGADGVGK (KRAS G12D)
VSVGADGVGH

SEQ ID NO: 9572 - protein, 10 aa, Artificial Sequence
  Description of Artificial Sequence: Synthetic peptide
  Seed: VVVGADGVGK (KRAS G12D)
VSVGADGVGI

SEQ ID NO: 9573 - protein, 10 aa, Artificial Sequence
  Description of Artificial Sequence: Synthetic peptide
  Seed: VVVGADGVGK (KRAS G12D)
VSVGADGVGL

SEQ ID NO: 9574 - protein, 10 aa, Artificial Sequence
  Description of Artificial Sequence: Synthetic peptide
  Seed: VVVGADGVGK (KRAS G12D)
VSVGADGVGM

SEQ ID NO: 9575 - protein, 10 aa, Artificial Sequence
  Description of Artificial Sequence: Synthetic peptide
  Seed: VVVGADGVGK (KRAS G12D)
VSVGADGVGQ

SEQ ID NO: 9576 - protein, 10 aa, Artificial Sequence
  Description of Artificial Sequence: Synthetic peptide
  Seed: VVVGADGVGK (KRAS G12D)
VSVGADGVGV

SEQ ID NO: 9577 - protein, 10 aa, Artificial Sequence
  Description of Artificial Sequence: Synthetic peptide
  Seed: VVVGADGVGK (KRAS G12D)
VSVGADGVGW

SEQ ID NO: 9578 - protein, 10 aa, Artificial Sequence
  Description of Artificial Sequence: Synthetic peptide
  Seed: VVVGADGVGK (KRAS G12D)
VSVGADGVGY

SEQ ID NO: 9579 - protein, 8 aa, Artificial Sequence
  Description of Artificial Sequence: Synthetic peptide
  Seed: VGADGVGK (KRAS G12D)
VTADGVGF

SEQ ID NO: 9580 - protein, 8 aa, Artificial Sequence
  Description of Artificial Sequence: Synthetic peptide
  Seed: VGADGVGK (KRAS G12D)
VTADGVGK

SEQ ID NO: 9581 - protein, 10 aa, Artificial Sequence
  Description of Artificial Sequence: Synthetic peptide
  Seed: VGADGVGKSA (KRAS G12D)
VTADGVGKSA

SEQ ID NO: 9582 - protein, 11 aa, Artificial Sequence
  Description of Artificial Sequence: Synthetic peptide
  Seed: VGADGVGKSAL (KRAS G12D)
VTADGVGKSAA

SEQ ID NO: 9583 - protein, 11 aa, Artificial Sequence
  Description of Artificial Sequence: Synthetic peptide
  Seed: VGADGVGKSAL (KRAS G12D)
VTADGVGKSAC

SEQ ID NO: 9584 - protein, 11 aa, Artificial Sequence
  Description of Artificial Sequence: Synthetic peptide
  Seed: VGADGVGKSAL (KRAS G12D)
VTADGVGKSAH

SEQ ID NO: 9585 - protein, 11 aa, Artificial Sequence
  Description of Artificial Sequence: Synthetic peptide
  Seed: VGADGVGKSAL (KRAS G12D)
VTADGVGKSAI

SEQ ID NO: 9586 - protein, 11 aa, Artificial Sequence
  Description of Artificial Sequence: Synthetic peptide
  Seed: VGADGVGKSAL (KRAS G12D)
VTADGVGKSAK

SEQ ID NO: 9587 - protein, 11 aa, Artificial Sequence
  Description of Artificial Sequence: Synthetic peptide
  Seed: VGADGVGKSAL (KRAS G12D)
VTADGVGKSAL

SEQ ID NO: 9588 - protein, 11 aa, Artificial Sequence
  Description of Artificial Sequence: Synthetic peptide
  Seed: VGADGVGKSAL (KRAS G12D)
VTADGVGKSAM

SEQ ID NO: 9589 - protein, 11 aa, Artificial Sequence
  Description of Artificial Sequence: Synthetic peptide
  Seed: VGADGVGKSAL (KRAS G12D)
VTADGVGKSAR

SEQ ID NO: 9590 - protein, 11 aa, Artificial Sequence
  Description of Artificial Sequence: Synthetic peptide
  Seed: VGADGVGKSAL (KRAS G12D)
VTADGVGKSAV

SEQ ID NO: 9591 - protein, 11 aa, Artificial Sequence
  Description of Artificial Sequence: Synthetic peptide
  Seed: VGADGVGKSAL (KRAS G12D)
VTADGVGKSAW

SEQ ID NO: 9592 - protein, 11 aa, Artificial Sequence
  Description of Artificial Sequence: Synthetic peptide
  Seed: VGADGVGKSAL (KRAS G12D)
VTADGVGKSAY

SEQ ID NO: 9593 - protein, 10 aa, Artificial Sequence
  Description of Artificial Sequence: Synthetic peptide
  Seed: VGADGVGKSA (KRAS G12D)
VTADGVGKSC

SEQ ID NO: 9594 - protein, 10 aa, Artificial Sequence
  Description of Artificial Sequence: Synthetic peptide
  Seed: VGADGVGKSA (KRAS G12D)
VTADGVGKSF

SEQ ID NO: 9595 - protein, 10 aa, Artificial Sequence
  Description of Artificial Sequence: Synthetic peptide
  Seed: VGADGVGKSA (KRAS G12D)
VTADGVGKSH

SEQ ID NO: 9596 - protein, 10 aa, Artificial Sequence
  Description of Artificial Sequence: Synthetic peptide
  Seed: VGADGVGKSA (KRAS G12D)
VTADGVGKSI

SEQ ID NO: 9597 - protein, 10 aa, Artificial Sequence
  Description of Artificial Sequence: Synthetic peptide
  Seed: VGADGVGKSA (KRAS G12D)
VTADGVGKSK

SEQ ID NO: 9598 - protein, 10 aa, Artificial Sequence
  Description of Artificial Sequence: Synthetic peptide
  Seed: VGADGVGKSA (KRAS G12D)
VTADGVGKSL

SEQ ID NO: 9599 - protein, 10 aa, Artificial Sequence
  Description of Artificial Sequence: Synthetic peptide
  Seed: VGADGVGKSA (KRAS G12D)
VTADGVGKSM

SEQ ID NO: 9600 - protein, 10 aa, Artificial Sequence
  Description of Artificial Sequence: Synthetic peptide
  Seed: VGADGVGKSA (KRAS G12D)
VTADGVGKSQ

SEQ ID NO: 9601 - protein, 10 aa, Artificial Sequence
  Description of Artificial Sequence: Synthetic peptide
  Seed: VGADGVGKSA (KRAS G12D)
VTADGVGKSR

SEQ ID NO: 9602 - protein, 10 aa, Artificial Sequence
  Description of Artificial Sequence: Synthetic peptide
  Seed: VGADGVGKSA (KRAS G12D)
VTADGVGKSS

SEQ ID NO: 9603 - protein, 10 aa, Artificial Sequence
  Description of Artificial Sequence: Synthetic peptide
  Seed: VGADGVGKSA (KRAS G12D)
VTADGVGKST

SEQ ID NO: 9604 - protein, 10 aa, Artificial Sequence
  Description of Artificial Sequence: Synthetic peptide
  Seed: VGADGVGKSA (KRAS G12D)
VTADGVGKSV

SEQ ID NO: 9605 - protein, 10 aa, Artificial Sequence
  Description of Artificial Sequence: Synthetic peptide
  Seed: VGADGVGKSA (KRAS G12D)
VTADGVGKSW

SEQ ID NO: 9606 - protein, 10 aa, Artificial Sequence
  Description of Artificial Sequence: Synthetic peptide
  Seed: VGADGVGKSA (KRAS G12D)
VTADGVGKSY

SEQ ID NO: 9607 - protein, 8 aa, Artificial Sequence
  Description of Artificial Sequence: Synthetic peptide
  Seed: VGADGVGK (KRAS G12D)
VTADGVGL

SEQ ID NO: 9608 - protein, 8 aa, Artificial Sequence
  Description of Artificial Sequence: Synthetic peptide
  Seed: VGADGVGK (KRAS G12D)
VTADGVGM

SEQ ID NO: 9609 - protein, 8 aa, Artificial Sequence
  Description of Artificial Sequence: Synthetic peptide
  Seed: VGADGVGK (KRAS G12D)
VTADGVGR

SEQ ID NO: 9610 - protein, 8 aa, Artificial Sequence
  Description of Artificial Sequence: Synthetic peptide
  Seed: VGADGVGK (KRAS G12D)
VTADGVGY

SEQ ID NO: 9611 - protein, 9 aa, Artificial Sequence
  Description of Artificial Sequence: Synthetic peptide
  Seed: VVGADGVGK (KRAS G12D)
VTGADGVGF

SEQ ID NO: 9612 - protein, 9 aa, Artificial Sequence
  Description of Artificial Sequence: Synthetic peptide
  Seed: VVGADGVGK (KRAS G12D)
VTGADGVGH

SEQ ID NO: 9613 - protein, 9 aa, Artificial Sequence
  Description of Artificial Sequence: Synthetic peptide
  Seed: VVGADGVGK (KRAS G12D)
VTGADGVGL

SEQ ID NO: 9614 - protein, 9 aa, Artificial Sequence
  Description of Artificial Sequence: Synthetic peptide
  Seed: VVGADGVGK (KRAS G12D)
VTGADGVGM

SEQ ID NO: 9615 - protein, 9 aa, Artificial Sequence
  Description of Artificial Sequence: Synthetic peptide
  Seed: VVGADGVGK (KRAS G12D)
VTGADGVGR

SEQ ID NO: 9616 - protein, 9 aa, Artificial Sequence
  Description of Artificial Sequence: Synthetic peptide
  Seed: VVGADGVGK (KRAS G12D)
VTGADGVGY

SEQ ID NO: 9617 - protein, 10 aa, Artificial Sequence
  Description of Artificial Sequence: Synthetic peptide
  Seed: VVVGADGVGK (KRAS G12D)
VTVGADGVGE

SEQ ID NO: 9618 - protein, 10 aa, Artificial Sequence
  Description of Artificial Sequence: Synthetic peptide
  Seed: VVVGADGVGK (KRAS G12D)
VTVGADGVGF

SEQ ID NO: 9619 - protein, 10 aa, Artificial Sequence
  Description of Artificial Sequence: Synthetic peptide
  Seed: VVVGADGVGK (KRAS G12D)
VTVGADGVGH

SEQ ID NO: 9620 - protein, 10 aa, Artificial Sequence
  Description of Artificial Sequence: Synthetic peptide
  Seed: VVVGADGVGK (KRAS G12D)
VTVGADGVGI

SEQ ID NO: 9621 - protein, 10 aa, Artificial Sequence
  Description of Artificial Sequence: Synthetic peptide
  Seed: VVVGADGVGK (KRAS G12D)
VTVGADGVGL

SEQ ID NO: 9622 - protein, 10 aa, Artificial Sequence
  Description of Artificial Sequence: Synthetic peptide
  Seed: VVVGADGVGK (KRAS G12D)
VTVGADGVGM

SEQ ID NO: 9623 - protein, 10 aa, Artificial Sequence
  Description of Artificial Sequence: Synthetic peptide
  Seed: VVVGADGVGK (KRAS G12D)
VTVGADGVGQ

SEQ ID NO: 9624 - protein, 10 aa, Artificial Sequence
  Description of Artificial Sequence: Synthetic peptide
  Seed: VVVGADGVGK (KRAS G12D)
VTVGADGVGV

SEQ ID NO: 9625 - protein, 10 aa, Artificial Sequence
  Description of Artificial Sequence: Synthetic peptide
  Seed: VVVGADGVGK (KRAS G12D)
VTVGADGVGW

SEQ ID NO: 9626 - protein, 10 aa, Artificial Sequence
  Description of Artificial Sequence: Synthetic peptide
  Seed: VVVGADGVGK (KRAS G12D)
VTVGADGVGY

SEQ ID NO: 9627 - protein, 8 aa, Artificial Sequence
  Description of Artificial Sequence: Synthetic peptide
  Seed: VGADGVGK (KRAS G12D)
VVADGVGF

SEQ ID NO: 9628 - protein, 8 aa, Artificial Sequence
  Description of Artificial Sequence: Synthetic peptide
  Seed: VGADGVGK (KRAS G12D)
VVADGVGH

SEQ ID NO: 9629 - protein, 8 aa, Artificial Sequence
  Description of Artificial Sequence: Synthetic peptide
  Seed: VGADGVGK (KRAS G12D)
VVADGVGK

SEQ ID NO: 9630 - protein, 10 aa, Artificial Sequence
  Description of Artificial Sequence: Synthetic peptide
  Seed: VGADGVGKSA (KRAS G12D)
VVADGVGKSA

SEQ ID NO: 9631 - protein, 11 aa, Artificial Sequence
  Description of Artificial Sequence: Synthetic peptide
  Seed: VGADGVGKSAL (KRAS G12D)
VVADGVGKSAA

SEQ ID NO: 9632 - protein, 11 aa, Artificial Sequence
  Description of Artificial Sequence: Synthetic peptide
  Seed: VGADGVGKSAL (KRAS G12D)
VVADGVGKSAC

SEQ ID NO: 9633 - protein, 11 aa, Artificial Sequence
  Description of Artificial Sequence: Synthetic peptide
  Seed: VGADGVGKSAL (KRAS G12D)
VVADGVGKSAF

SEQ ID NO: 9634 - protein, 11 aa, Artificial Sequence
  Description of Artificial Sequence: Synthetic peptide
  Seed: VGADGVGKSAL (KRAS G12D)
VVADGVGKSAH

SEQ ID NO: 9635 - protein, 11 aa, Artificial Sequence
  Description of Artificial Sequence: Synthetic peptide
  Seed: VGADGVGKSAL (KRAS G12D)
VVADGVGKSAI

SEQ ID NO: 9636 - protein, 11 aa, Artificial Sequence
  Description of Artificial Sequence: Synthetic peptide
  Seed: VGADGVGKSAL (KRAS G12D)
VVADGVGKSAK

SEQ ID NO: 9637 - protein, 11 aa, Artificial Sequence
  Description of Artificial Sequence: Synthetic peptide
  Seed: VGADGVGKSAL (KRAS G12D)
VVADGVGKSAL

SEQ ID NO: 9638 - protein, 11 aa, Artificial Sequence
  Description of Artificial Sequence: Synthetic peptide
  Seed: VGADGVGKSAL (KRAS G12D)
VVADGVGKSAM

SEQ ID NO: 9639 - protein, 11 aa, Artificial Sequence
  Description of Artificial Sequence: Synthetic peptide
  Seed: VGADGVGKSAL (KRAS G12D)
VVADGVGKSAQ

SEQ ID NO: 9640 - protein, 11 aa, Artificial Sequence
  Description of Artificial Sequence: Synthetic peptide
  Seed: VGADGVGKSAL (KRAS G12D)
VVADGVGKSAR

SEQ ID NO: 9641 - protein, 11 aa, Artificial Sequence
  Description of Artificial Sequence: Synthetic peptide
  Seed: VGADGVGKSAL (KRAS G12D)
VVADGVGKSAV

SEQ ID NO: 9642 - protein, 11 aa, Artificial Sequence
  Description of Artificial Sequence: Synthetic peptide
  Seed: VGADGVGKSAL (KRAS G12D)
VVADGVGKSAW

SEQ ID NO: 9643 - protein, 11 aa, Artificial Sequence
  Description of Artificial Sequence: Synthetic peptide
  Seed: VGADGVGKSAL (KRAS G12D)
VVADGVGKSAY

SEQ ID NO: 9644 - protein, 10 aa, Artificial Sequence
  Description of Artificial Sequence: Synthetic peptide
  Seed: VGADGVGKSA (KRAS G12D)
VVADGVGKSC

SEQ ID NO: 9645 - protein, 10 aa, Artificial Sequence
  Description of Artificial Sequence: Synthetic peptide
  Seed: VGADGVGKSA (KRAS G12D)
VVADGVGKSF

SEQ ID NO: 9646 - protein, 10 aa, Artificial Sequence
  Description of Artificial Sequence: Synthetic peptide
  Seed: VGADGVGKSA (KRAS G12D)
VVADGVGKSH

SEQ ID NO: 9647 - protein, 10 aa, Artificial Sequence
  Description of Artificial Sequence: Synthetic peptide
  Seed: VGADGVGKSA (KRAS G12D)
VVADGVGKSI

SEQ ID NO: 9648 - protein, 10 aa, Artificial Sequence
  Description of Artificial Sequence: Synthetic peptide
  Seed: VGADGVGKSA (KRAS G12D)
VVADGVGKSK

SEQ ID NO: 9649 - protein, 10 aa, Artificial Sequence
  Description of Artificial Sequence: Synthetic peptide
  Seed: VGADGVGKSA (KRAS G12D)
VVADGVGKSL

SEQ ID NO: 9650 - protein, 10 aa, Artificial Sequence
  Description of Artificial Sequence: Synthetic peptide
  Seed: VGADGVGKSA (KRAS G12D)
VVADGVGKSM

SEQ ID NO: 9651 - protein, 10 aa, Artificial Sequence
  Description of Artificial Sequence: Synthetic peptide
  Seed: VGADGVGKSA (KRAS G12D)
VVADGVGKSQ

SEQ ID NO: 9652 - protein, 10 aa, Artificial Sequence
  Description of Artificial Sequence: Synthetic peptide
  Seed: VGADGVGKSA (KRAS G12D)
VVADGVGKSR

SEQ ID NO: 9653 - protein, 10 aa, Artificial Sequence
  Description of Artificial Sequence: Synthetic peptide
  Seed: VGADGVGKSA (KRAS G12D)
VVADGVGKSS

SEQ ID NO: 9654 - protein, 10 aa, Artificial Sequence
  Description of Artificial Sequence: Synthetic peptide
  Seed: VGADGVGKSA (KRAS G12D)
VVADGVGKST

SEQ ID NO: 9655 - protein, 10 aa, Artificial Sequence
  Description of Artificial Sequence: Synthetic peptide
  Seed: VGADGVGKSA (KRAS G12D)
VVADGVGKSV

SEQ ID NO: 9656 - protein, 10 aa, Artificial Sequence
  Description of Artificial Sequence: Synthetic peptide
  Seed: VGADGVGKSA (KRAS G12D)
VVADGVGKSW

SEQ ID NO: 9657 - protein, 10 aa, Artificial Sequence
  Description of Artificial Sequence: Synthetic peptide
  Seed: VGADGVGKSA (KRAS G12D)
VVADGVGKSY

SEQ ID NO: 9658 - protein, 8 aa, Artificial Sequence
  Description of Artificial Sequence: Synthetic peptide
  Seed: VGADGVGK (KRAS G12D)
VVADGVGL

SEQ ID NO: 9659 - protein, 8 aa, Artificial Sequence
  Description of Artificial Sequence: Synthetic peptide
  Seed: VGADGVGK (KRAS G12D)
VVADGVGM

SEQ ID NO: 9660 - protein, 8 aa, Artificial Sequence
  Description of Artificial Sequence: Synthetic peptide
  Seed: VGADGVGK (KRAS G12D)
VVADGVGR

SEQ ID NO: 9661 - protein, 8 aa, Artificial Sequence
  Description of Artificial Sequence: Synthetic peptide
  Seed: VGADGVGK (KRAS G12D)
VVADGVGY

SEQ ID NO: 9662 - protein, 9 aa, Artificial Sequence
  Description of Artificial Sequence: Synthetic peptide
  Seed: VVGADGVGK (KRAS G12D)
VVGADGVGF

SEQ ID NO: 9663 - protein, 9 aa, Artificial Sequence
  Description of Artificial Sequence: Synthetic peptide
  Seed: VVGADGVGK (KRAS G12D)
VVGADGVGH

SEQ ID NO: 9664 - protein, 9 aa, Artificial Sequence
  Description of Artificial Sequence: Synthetic peptide
  Seed: VVGADGVGK (KRAS G12D)
VVGADGVGL

SEQ ID NO: 9665 - protein, 9 aa, Artificial Sequence
  Description of Artificial Sequence: Synthetic peptide
  Seed: VVGADGVGK (KRAS G12D)
VVGADGVGM

SEQ ID NO: 9666 - protein, 9 aa, Artificial Sequence
  Description of Artificial Sequence: Synthetic peptide
  Seed: VVGADGVGK (KRAS G12D)
VVGADGVGR

SEQ ID NO: 9667 - protein, 9 aa, Artificial Sequence
  Description of Artificial Sequence: Synthetic peptide
  Seed: VVGADGVGK (KRAS G12D)
VVGADGVGY

SEQ ID NO: 9668 - protein, 10 aa, Artificial Sequence
  Description of Artificial Sequence: Synthetic peptide
  Seed: VVVGADGVGK (KRAS G12D)
VVVGADGVGE

SEQ ID NO: 9669 - protein, 10 aa, Artificial Sequence
  Description of Artificial Sequence: Synthetic peptide
  Seed: VVVGADGVGK (KRAS G12D)
VVVGADGVGF

SEQ ID NO: 9670 - protein, 10 aa, Artificial Sequence
  Description of Artificial Sequence: Synthetic peptide
  Seed: VVVGADGVGK (KRAS G12D)
VVVGADGVGH

SEQ ID NO: 9671 - protein, 10 aa, Artificial Sequence
  Description of Artificial Sequence: Synthetic peptide
  Seed: VVVGADGVGK (KRAS G12D)
VVVGADGVGI

SEQ ID NO: 9672 - protein, 10 aa, Artificial Sequence
  Description of Artificial Sequence: Synthetic peptide
  Seed: VVVGADGVGK (KRAS G12D)
VVVGADGVGL

SEQ ID NO: 9673 - protein, 10 aa, Artificial Sequence
  Description of Artificial Sequence: Synthetic peptide
  Seed: VVVGADGVGK (KRAS G12D)
VVVGADGVGM

SEQ ID NO: 9674 - protein, 10 aa, Artificial Sequence
  Description of Artificial Sequence: Synthetic peptide
  Seed: VVVGADGVGK (KRAS G12D)
VVVGADGVGQ

SEQ ID NO: 9675 - protein, 10 aa, Artificial Sequence
  Description of Artificial Sequence: Synthetic peptide
  Seed: VVVGADGVGK (KRAS G12D)
VVVGADGVGV

SEQ ID NO: 9676 - protein, 10 aa, Artificial Sequence
  Description of Artificial Sequence: Synthetic peptide
  Seed: VVVGADGVGK (KRAS G12D)
VVVGADGVGW

SEQ ID NO: 9677 - protein, 10 aa, Artificial Sequence
  Description of Artificial Sequence: Synthetic peptide
  Seed: VVVGADGVGK (KRAS G12D)
VVVGADGVGY

SEQ ID NO: 9678 - protein, 8 aa, Artificial Sequence
  Description of Artificial Sequence: Synthetic peptide
  Seed: VGADGVGK (KRAS G12D)
VWADGVGK

SEQ ID NO: 9679 - protein, 11 aa, Artificial Sequence
  Description of Artificial Sequence: Synthetic peptide
  Seed: VGADGVGKSAL (KRAS G12D)
VWADGVGKSAF

SEQ ID NO: 9680 - protein, 11 aa, Artificial Sequence
  Description of Artificial Sequence: Synthetic peptide
  Seed: VGADGVGKSAL (KRAS G12D)
VWADGVGKSAK

SEQ ID NO: 9681 - protein, 11 aa, Artificial Sequence
  Description of Artificial Sequence: Synthetic peptide
  Seed: VGADGVGKSAL (KRAS G12D)
VWADGVGKSAL

SEQ ID NO: 9682 - protein, 11 aa, Artificial Sequence
  Description of Artificial Sequence: Synthetic peptide
  Seed: VGADGVGKSAL (KRAS G12D)
VWADGVGKSAM

SEQ ID NO: 9683 - protein, 11 aa, Artificial Sequence
  Description of Artificial Sequence: Synthetic peptide
  Seed: VGADGVGKSAL (KRAS G12D)
VWADGVGKSAR

SEQ ID NO: 9684 - protein, 11 aa, Artificial Sequence
  Description of Artificial Sequence: Synthetic peptide
  Seed: VGADGVGKSAL (KRAS G12D)
VWADGVGKSAW

SEQ ID NO: 9685 - protein, 11 aa, Artificial Sequence
  Description of Artificial Sequence: Synthetic peptide
  Seed: VGADGVGKSAL (KRAS G12D)
VWADGVGKSAY

SEQ ID NO: 9686 - protein, 10 aa, Artificial Sequence
  Description of Artificial Sequence: Synthetic peptide
  Seed: VGADGVGKSA (KRAS G12D)
VWADGVGKSF

SEQ ID NO: 9687 - protein, 10 aa, Artificial Sequence
  Description of Artificial Sequence: Synthetic peptide
  Seed: VGADGVGKSA (KRAS G12D)
VWADGVGKSK

SEQ ID NO: 9688 - protein, 10 aa, Artificial Sequence
  Description of Artificial Sequence: Synthetic peptide
  Seed: VGADGVGKSA (KRAS G12D)
VWADGVGKSM

SEQ ID NO: 9689 - protein, 10 aa, Artificial Sequence
  Description of Artificial Sequence: Synthetic peptide
  Seed: VGADGVGKSA (KRAS G12D)
VWADGVGKSY

SEQ ID NO: 9690 - protein, 8 aa, Artificial Sequence
  Description of Artificial Sequence: Synthetic peptide
  Seed: VGADGVGK (KRAS G12D)
VWADGVGR

SEQ ID NO: 9691 - protein, 9 aa, Artificial Sequence
  Description of Artificial Sequence: Synthetic peptide
  Seed: VVGADGVGK (KRAS G12D)
VWGADGVGK

SEQ ID NO: 9692 - protein, 9 aa, Artificial Sequence
  Description of Artificial Sequence: Synthetic peptide
  Seed: VVGADGVGK (KRAS G12D)
VWGADGVGR

SEQ ID NO: 9693 - protein, 10 aa, Artificial Sequence
  Description of Artificial Sequence: Synthetic peptide
  Seed: VVVGADGVGK (KRAS G12D)
VWVGADGVGF

SEQ ID NO: 9694 - protein, 10 aa, Artificial Sequence
  Description of Artificial Sequence: Synthetic peptide
  Seed: VVVGADGVGK (KRAS G12D)
VWVGADGVGK

SEQ ID NO: 9695 - protein, 10 aa, Artificial Sequence
  Description of Artificial Sequence: Synthetic peptide
  Seed: VVVGADGVGK (KRAS G12D)
VWVGADGVGR

SEQ ID NO: 9696 - protein, 10 aa, Artificial Sequence
  Description of Artificial Sequence: Synthetic peptide
  Seed: VVVGADGVGK (KRAS G12D)
VWVGADGVGY

SEQ ID NO: 9697 - protein, 8 aa, Artificial Sequence
  Description of Artificial Sequence: Synthetic peptide
  Seed: VGADGVGK (KRAS G12D)
VYADGVGK

SEQ ID NO: 9698 - protein, 11 aa, Artificial Sequence
  Description of Artificial Sequence: Synthetic peptide
  Seed: VGADGVGKSAL (KRAS G12D)
VYADGVGKSAF

SEQ ID NO: 9699 - protein, 11 aa, Artificial Sequence
  Description of Artificial Sequence: Synthetic peptide
  Seed: VGADGVGKSAL (KRAS G12D)
VYADGVGKSAH

SEQ ID NO: 9700 - protein, 11 aa, Artificial Sequence
  Description of Artificial Sequence: Synthetic peptide
  Seed: VGADGVGKSAL (KRAS G12D)
VYADGVGKSAI

SEQ ID NO: 9701 - protein, 11 aa, Artificial Sequence
  Description of Artificial Sequence: Synthetic peptide
  Seed: VGADGVGKSAL (KRAS G12D)
VYADGVGKSAK

SEQ ID NO: 9702 - protein, 11 aa, Artificial Sequence
  Description of Artificial Sequence: Synthetic peptide
  Seed: VGADGVGKSAL (KRAS G12D)
VYADGVGKSAL

SEQ ID NO: 9703 - protein, 11 aa, Artificial Sequence
  Description of Artificial Sequence: Synthetic peptide
  Seed: VGADGVGKSAL (KRAS G12D)
VYADGVGKSAM

SEQ ID NO: 9704 - protein, 11 aa, Artificial Sequence
  Description of Artificial Sequence: Synthetic peptide
  Seed: VGADGVGKSAL (KRAS G12D)
VYADGVGKSAR

SEQ ID NO: 9705 - protein, 11 aa, Artificial Sequence
  Description of Artificial Sequence: Synthetic peptide
  Seed: VGADGVGKSAL (KRAS G12D)
VYADGVGKSAV

SEQ ID NO: 9706 - protein, 11 aa, Artificial Sequence
  Description of Artificial Sequence: Synthetic peptide
  Seed: VGADGVGKSAL (KRAS G12D)
VYADGVGKSAW

SEQ ID NO: 9707 - protein, 11 aa, Artificial Sequence
  Description of Artificial Sequence: Synthetic peptide
  Seed: VGADGVGKSAL (KRAS G12D)
VYADGVGKSAY

SEQ ID NO: 9708 - protein, 10 aa, Artificial Sequence
  Description of Artificial Sequence: Synthetic peptide
  Seed: VGADGVGKSA (KRAS G12D)
VYADGVGKSF

SEQ ID NO: 9709 - protein, 10 aa, Artificial Sequence
  Description of Artificial Sequence: Synthetic peptide
  Seed: VGADGVGKSA (KRAS G12D)
VYADGVGKSK

SEQ ID NO: 9710 - protein, 10 aa, Artificial Sequence
  Description of Artificial Sequence: Synthetic peptide
  Seed: VGADGVGKSA (KRAS G12D)
VYADGVGKSL

SEQ ID NO: 9711 - protein, 10 aa, Artificial Sequence
  Description of Artificial Sequence: Synthetic peptide
  Seed: VGADGVGKSA (KRAS G12D)
VYADGVGKSM

SEQ ID NO: 9712 - protein, 10 aa, Artificial Sequence
  Description of Artificial Sequence: Synthetic peptide
  Seed: VGADGVGKSA (KRAS G12D)
VYADGVGKSY

SEQ ID NO: 9713 - protein, 8 aa, Artificial Sequence
  Description of Artificial Sequence: Synthetic peptide
  Seed: VGADGVGK (KRAS G12D)
VYADGVGR

SEQ ID NO: 9714 - protein, 9 aa, Artificial Sequence
  Description of Artificial Sequence: Synthetic peptide
  Seed: VVGADGVGK (KRAS G12D)
VYGADGVGK

SEQ ID NO: 9715 - protein, 9 aa, Artificial Sequence
  Description of Artificial Sequence: Synthetic peptide
  Seed: VVGADGVGK (KRAS G12D)
VYGADGVGR

SEQ ID NO: 9716 - protein, 9 aa, Artificial Sequence
  Description of Artificial Sequence: Synthetic peptide
  Seed: VVGADGVGK (KRAS G12D)
VYGADGVGY

SEQ ID NO: 9717 - protein, 10 aa, Artificial Sequence
  Description of Artificial Sequence: Synthetic peptide
  Seed: VVVGADGVGK (KRAS G12D)
VYVGADGVGF

SEQ ID NO: 9718 - protein, 10 aa, Artificial Sequence
  Description of Artificial Sequence: Synthetic peptide
  Seed: VVVGADGVGK (KRAS G12D)
VYVGADGVGK

SEQ ID NO: 9719 - protein, 10 aa, Artificial Sequence
  Description of Artificial Sequence: Synthetic peptide
  Seed: VVVGADGVGK (KRAS G12D)
VYVGADGVGL

SEQ ID NO: 9720 - protein, 10 aa, Artificial Sequence
  Description of Artificial Sequence: Synthetic peptide
  Seed: VVVGADGVGK (KRAS G12D)
VYVGADGVGM

SEQ ID NO: 9721 - protein, 10 aa, Artificial Sequence
  Description of Artificial Sequence: Synthetic peptide
  Seed: VVVGADGVGK (KRAS G12D)
VYVGADGVGR

SEQ ID NO: 9722 - protein, 10 aa, Artificial Sequence
  Description of Artificial Sequence: Synthetic peptide
  Seed: VVVGADGVGK (KRAS G12D)
VYVGADGVGY

SEQ ID NO: 9723 - protein, 10 aa, Homo sapiens
  Native (KRAS G12D)
GADGVGKSAL

SEQ ID NO: 9724 - protein, 10 aa, Homo sapiens
  Native (KRAS G12D)
KLVVVGADGV

SEQ ID NO: 9725 - protein, 9 aa, Homo sapiens
  Native (KRAS G12D)
LVVVGADGV

SEQ ID NO: 9726 - protein, 9 aa, Homo sapiens
  Native (KRAS G12D)
VVGADGVGK

SEQ ID NO: 9727 - protein, 8 aa, Homo sapiens
  Native (KRAS G12D)
DGVGKSAL

SEQ ID NO: 9728 - protein, 9 aa, Homo sapiens
  Native (KRAS G12D)
GADGVGKSA

SEQ ID NO: 9729 - protein, 11 aa, Homo sapiens
  Native (KRAS G12D)
GADGVGKSALT

SEQ ID NO: 9730 - protein, 11 aa, Homo sapiens
  Native (KRAS G12D)
LVVVGADGVGK

SEQ ID NO: 9731 - protein, 8 aa, Homo sapiens
  Native (KRAS G12D)
VGADGVGK

SEQ ID NO: 9732 - protein, 10 aa, Homo sapiens
  Native (KRAS G12D)
VGADGVGKSA

SEQ ID NO: 9733 - protein, 11 aa, Homo sapiens
  Native (KRAS G12D)
VGADGVGKSAL

SEQ ID NO: 9734 - protein, 10 aa, Artificial Sequence
  Description of Artificial Sequence: Synthetic peptide
  Seed: GARGVGKSAL (KRAS G12R)
GARGVGKSAM

SEQ ID NO: 9735 - protein, 10 aa, Artificial Sequence
  Description of Artificial Sequence: Synthetic peptide
  Seed: GARGVGKSAL (KRAS G12R)
GIRGVGKSAL

SEQ ID NO: 9736 - protein, 10 aa, Artificial Sequence
  Description of Artificial Sequence: Synthetic peptide
  Seed: GARGVGKSAL (KRAS G12R)
GIRGVGKSAM

SEQ ID NO: 9737 - protein, 10 aa, Artificial Sequence
  Description of Artificial Sequence: Synthetic peptide
  Seed: GARGVGKSAL (KRAS G12R)
GLRGVGKSAL

SEQ ID NO: 9738 - protein, 10 aa, Artificial Sequence
  Description of Artificial Sequence: Synthetic peptide
  Seed: GARGVGKSAL (KRAS G12R)
GMRGVGKSAL

SEQ ID NO: 9739 - protein, 10 aa, Artificial Sequence
  Description of Artificial Sequence: Synthetic peptide
  Seed: GARGVGKSAL (KRAS G12R)
GPRGVGKSAA

SEQ ID NO: 9740 - protein, 10 aa, Artificial Sequence
  Description of Artificial Sequence: Synthetic peptide
  Seed: GARGVGKSAL (KRAS G12R)
GPRGVGKSAC

SEQ ID NO: 9741 - protein, 10 aa, Artificial Sequence
  Description of Artificial Sequence: Synthetic peptide
  Seed: GARGVGKSAL (KRAS G12R)
GPRGVGKSAF

SEQ ID NO: 9742 - protein, 10 aa, Artificial Sequence
  Description of Artificial Sequence: Synthetic peptide
  Seed: GARGVGKSAL (KRAS G12R)
GPRGVGKSAG

SEQ ID NO: 9743 - protein, 10 aa, Artificial Sequence
  Description of Artificial Sequence: Synthetic peptide
  Seed: GARGVGKSAL (KRAS G12R)
GPRGVGKSAI

SEQ ID NO: 9744 - protein, 10 aa, Artificial Sequence
  Description of Artificial Sequence: Synthetic peptide
  Seed: GARGVGKSAL (KRAS G12R)
GPRGVGKSAM

SEQ ID NO: 9745 - protein, 10 aa, Artificial Sequence
  Description of Artificial Sequence: Synthetic peptide
  Seed: GARGVGKSAL (KRAS G12R)
GPRGVGKSAP

SEQ ID NO: 9746 - protein, 10 aa, Artificial Sequence
  Description of Artificial Sequence: Synthetic peptide
  Seed: GARGVGKSAL (KRAS G12R)
GPRGVGKSAS

SEQ ID NO: 9747 - protein, 10 aa, Artificial Sequence
  Description of Artificial Sequence: Synthetic peptide
  Seed: GARGVGKSAL (KRAS G12R)
GPRGVGKSAT

SEQ ID NO: 9748 - protein, 10 aa, Artificial Sequence
  Description of Artificial Sequence: Synthetic peptide
  Seed: GARGVGKSAL (KRAS G12R)
GPRGVGKSAW

SEQ ID NO: 9749 - protein, 10 aa, Artificial Sequence
  Description of Artificial Sequence: Synthetic peptide
  Seed: GARGVGKSAL (KRAS G12R)
GPRGVGKSAY

SEQ ID NO: 9750 - protein, 10 aa, Artificial Sequence
  Description of Artificial Sequence: Synthetic peptide
  Seed: GARGVGKSAL (KRAS G12R)
GTRGVGKSAL

SEQ ID NO: 9751 - protein, 10 aa, Artificial Sequence
  Description of Artificial Sequence: Synthetic peptide
  Seed: GARGVGKSAL (KRAS G12R)
GVRGVGKSAL

SEQ ID NO: 9752 - protein, 10 aa, Artificial Sequence
  Description of Artificial Sequence: Synthetic peptide
  Seed: GARGVGKSAL (KRAS G12R)
GVRGVGKSAM

SEQ ID NO: 9753 - protein, 10 aa, Artificial Sequence
  Description of Artificial Sequence: Synthetic peptide
  Seed: KLVVVGARGV (KRAS G12R)
KIVVVGARGV

SEQ ID NO: 9754 - protein, 10 aa, Artificial Sequence
  Description of Artificial Sequence: Synthetic peptide
  Seed: KLVVVGARGV (KRAS G12R)
KLVVVGARGA

SEQ ID NO: 9755 - protein, 10 aa, Artificial Sequence
  Description of Artificial Sequence: Synthetic peptide
  Seed: KLVVVGARGV (KRAS G12R)
KLVVVGARGI

SEQ ID NO: 9756 - protein, 10 aa, Artificial Sequence
  Description of Artificial Sequence: Synthetic peptide
  Seed: KLVVVGARGV (KRAS G12R)
KLVVVGARGL

SEQ ID NO: 9757 - protein, 10 aa, Artificial Sequence
  Description of Artificial Sequence: Synthetic peptide
  Seed: KLVVVGARGV (KRAS G12R)
KMVVVGARGA

SEQ ID NO: 9758 - protein, 10 aa, Artificial Sequence
  Description of Artificial Sequence: Synthetic peptide
  Seed: KLVVVGARGV (KRAS G12R)
KMVVVGARGI

SEQ ID NO: 9759 - protein, 10 aa, Artificial Sequence
  Description of Artificial Sequence: Synthetic peptide
  Seed: KLVVVGARGV (KRAS G12R)
KMVVVGARGL

SEQ ID NO: 9760 - protein, 10 aa, Artificial Sequence
  Description of Artificial Sequence: Synthetic peptide
  Seed: KLVVVGARGV (KRAS G12R)
KMVVVGARGV

SEQ ID NO: 9761 - protein, 10 aa, Artificial Sequence
  Description of Artificial Sequence: Synthetic peptide
  Seed: KLVVVGARGV (KRAS G12R)
KQVVVGARGV

SEQ ID NO: 9762 - protein, 10 aa, Artificial Sequence
  Description of Artificial Sequence: Synthetic peptide
  Seed: KLVVVGARGV (KRAS G12R)
KVVVVGARGV

SEQ ID NO: 9763 - protein, 9 aa, Artificial Sequence
  Description of Artificial Sequence: Synthetic peptide
  Seed: LVVVGARGV (KRAS G12R)
LIVVGARGV

SEQ ID NO: 9764 - protein, 9 aa, Artificial Sequence
  Description of Artificial Sequence: Synthetic peptide
  Seed: LVVVGARGV (KRAS G12R)
LLVVGARGA

SEQ ID NO: 9765 - protein, 9 aa, Artificial Sequence
  Description of Artificial Sequence: Synthetic peptide
  Seed: LVVVGARGV (KRAS G12R)
LLVVGARGI

SEQ ID NO: 9766 - protein, 9 aa, Artificial Sequence
  Description of Artificial Sequence: Synthetic peptide
  Seed: LVVVGARGV (KRAS G12R)
LLVVGARGL

SEQ ID NO: 9767 - protein, 9 aa, Artificial Sequence
  Description of Artificial Sequence: Synthetic peptide
  Seed: LVVVGARGV (KRAS G12R)
LMVVGARGA

SEQ ID NO: 9768 - protein, 9 aa, Artificial Sequence
  Description of Artificial Sequence: Synthetic peptide
  Seed: LVVVGARGV (KRAS G12R)
LMVVGARGI

SEQ ID NO: 9769 - protein, 9 aa, Artificial Sequence
  Description of Artificial Sequence: Synthetic peptide
  Seed: LVVVGARGV (KRAS G12R)
LMVVGARGL

SEQ ID NO: 9770 - protein, 9 aa, Artificial Sequence
  Description of Artificial Sequence: Synthetic peptide
  Seed: LVVVGARGV (KRAS G12R)
LQVVGARGV

SEQ ID NO: 9771 - protein, 10 aa, Artificial Sequence
  Description of Artificial Sequence: Synthetic peptide
  Seed: VVVGARGVGK (KRAS G12R)
VAVGARGVGK

SEQ ID NO: 9772 - protein, 10 aa, Artificial Sequence
  Description of Artificial Sequence: Synthetic peptide
  Seed: VVVGARGVGK (KRAS G12R)
VAVGARGVGR

SEQ ID NO: 9773 - protein, 10 aa, Artificial Sequence
  Description of Artificial Sequence: Synthetic peptide
  Seed: VVVGARGVGK (KRAS G12R)
VFVGARGVGK

SEQ ID NO: 9774 - protein, 9 aa, Artificial Sequence
  Description of Artificial Sequence: Synthetic peptide
  Seed: VVGARGVGK (KRAS G12R)
VIGARGVGK

SEQ ID NO: 9775 - protein, 10 aa, Artificial Sequence
  Description of Artificial Sequence: Synthetic peptide
  Seed: VVVGARGVGK (KRAS G12R)
VIVGARGVGK

SEQ ID NO: 9776 - protein, 10 aa, Artificial Sequence
  Description of Artificial Sequence: Synthetic peptide
  Seed: VVVGARGVGK (KRAS G12R)
VIVGARGVGR

SEQ ID NO: 9777 - protein, 10 aa, Artificial Sequence
  Description of Artificial Sequence: Synthetic peptide
  Seed: VVVGARGVGK (KRAS G12R)
VKVGARGVGK

SEQ ID NO: 9778 - protein, 9 aa, Artificial Sequence
  Description of Artificial Sequence: Synthetic peptide
  Seed: VVGARGVGK (KRAS G12R)
VLGARGVGK

SEQ ID NO: 9779 - protein, 10 aa, Artificial Sequence
  Description of Artificial Sequence: Synthetic peptide
  Seed: VVVGARGVGK (KRAS G12R)
VLVGARGVGK

SEQ ID NO: 9780 - protein, 10 aa, Artificial Sequence
  Description of Artificial Sequence: Synthetic peptide
  Seed: VVVGARGVGK (KRAS G12R)
VMVGARGVGR

SEQ ID NO: 9781 - protein, 10 aa, Artificial Sequence
  Description of Artificial Sequence: Synthetic peptide
  Seed: VVVGARGVGK (KRAS G12R)
VQVGARGVGK

SEQ ID NO: 9782 - protein, 10 aa, Artificial Sequence
  Description of Artificial Sequence: Synthetic peptide
  Seed: VVVGARGVGK (KRAS G12R)
VRVGARGVGK

SEQ ID NO: 9783 - protein, 9 aa, Artificial Sequence
  Description of Artificial Sequence: Synthetic peptide
  Seed: VVGARGVGK (KRAS G12R)
VSGARGVGK

SEQ ID NO: 9784 - protein, 10 aa, Artificial Sequence
  Description of Artificial Sequence: Synthetic peptide
  Seed: VVVGARGVGK (KRAS G12R)
VSVGARGVGK

SEQ ID NO: 9785 - protein, 10 aa, Artificial Sequence
  Description of Artificial Sequence: Synthetic peptide
  Seed: VVVGARGVGK (KRAS G12R)
VSVGARGVGR

SEQ ID NO: 9786 - protein, 9 aa, Artificial Sequence
  Description of Artificial Sequence: Synthetic peptide
  Seed: VVGARGVGK (KRAS G12R)
VTGARGVGK

SEQ ID NO: 9787 - protein, 9 aa, Artificial Sequence
  Description of Artificial Sequence: Synthetic peptide
  Seed: VVGARGVGK (KRAS G12R)
VVGARGVGR

SEQ ID NO: 9788 - protein, 10 aa, Artificial Sequence
  Description of Artificial Sequence: Synthetic peptide
  Seed: GARGVGKSAL (KRAS G12R)
GARGVGKSAF

SEQ ID NO: 9789 - protein, 10 aa, Artificial Sequence
  Description of Artificial Sequence: Synthetic peptide
  Seed: GARGVGKSAL (KRAS G12R)
GARGVGKSAH

SEQ ID NO: 9790 - protein, 10 aa, Artificial Sequence
  Description of Artificial Sequence: Synthetic peptide
  Seed: GARGVGKSAL (KRAS G12R)
GARGVGKSAI

SEQ ID NO: 9791 - protein, 10 aa, Artificial Sequence
  Description of Artificial Sequence: Synthetic peptide
  Seed: GARGVGKSAL (KRAS G12R)
GARGVGKSAV

SEQ ID NO: 9792 - protein, 10 aa, Artificial Sequence
  Description of Artificial Sequence: Synthetic peptide
  Seed: GARGVGKSAL (KRAS G12R)
GARGVGKSAW

SEQ ID NO: 9793 - protein, 10 aa, Artificial Sequence
  Description of Artificial Sequence: Synthetic peptide
  Seed: GARGVGKSAL (KRAS G12R)
GARGVGKSAY

SEQ ID NO: 9794 - protein, 9 aa, Artificial Sequence
  Description of Artificial Sequence: Synthetic peptide
  Seed: GARGVGKSA (KRAS G12R)
GARGVGKSC

SEQ ID NO: 9795 - protein, 9 aa, Artificial Sequence
  Description of Artificial Sequence: Synthetic peptide
  Seed: GARGVGKSA (KRAS G12R)
GARGVGKSF

SEQ ID NO: 9796 - protein, 9 aa, Artificial Sequence
  Description of Artificial Sequence: Synthetic peptide
  Seed: GARGVGKSA (KRAS G12R)
GARGVGKSH

SEQ ID NO: 9797 - protein, 9 aa, Artificial Sequence
  Description of Artificial Sequence: Synthetic peptide
  Seed: GARGVGKSA (KRAS G12R)
GARGVGKSI

SEQ ID NO: 9798 - protein, 9 aa, Artificial Sequence
  Description of Artificial Sequence: Synthetic peptide
  Seed: GARGVGKSA (KRAS G12R)
GARGVGKSK

SEQ ID NO: 9799 - protein, 9 aa, Artificial Sequence
  Description of Artificial Sequence: Synthetic peptide
  Seed: GARGVGKSA (KRAS G12R)
GARGVGKSL

SEQ ID NO: 9800 - protein, 9 aa, Artificial Sequence
  Description of Artificial Sequence: Synthetic peptide
  Seed: GARGVGKSA (KRAS G12R)
GARGVGKSM

SEQ ID NO: 9801 - protein, 9 aa, Artificial Sequence
  Description of Artificial Sequence: Synthetic peptide
  Seed: GARGVGKSA (KRAS G12R)
GARGVGKSP

SEQ ID NO: 9802 - protein, 9 aa, Artificial Sequence
  Description of Artificial Sequence: Synthetic peptide
  Seed: GARGVGKSA (KRAS G12R)
GARGVGKSQ

SEQ ID NO: 9803 - protein, 9 aa, Artificial Sequence
  Description of Artificial Sequence: Synthetic peptide
  Seed: GARGVGKSA (KRAS G12R)
GARGVGKSR

SEQ ID NO: 9804 - protein, 9 aa, Artificial Sequence
  Description of Artificial Sequence: Synthetic peptide
  Seed: GARGVGKSA (KRAS G12R)
GARGVGKSS

SEQ ID NO: 9805 - protein, 9 aa, Artificial Sequence
  Description of Artificial Sequence: Synthetic peptide
  Seed: GARGVGKSA (KRAS G12R)
GARGVGKST

SEQ ID NO: 9806 - protein, 9 aa, Artificial Sequence
  Description of Artificial Sequence: Synthetic peptide
  Seed: GARGVGKSA (KRAS G12R)
GARGVGKSV

SEQ ID NO: 9807 - protein, 9 aa, Artificial Sequence
  Description of Artificial Sequence: Synthetic peptide
  Seed: GARGVGKSA (KRAS G12R)
GARGVGKSW

SEQ ID NO: 9808 - protein, 10 aa, Artificial Sequence
  Description of Artificial Sequence: Synthetic peptide
  Seed: GARGVGKSAL (KRAS G12R)
GCRGVGKSAY

SEQ ID NO: 9809 - protein, 9 aa, Artificial Sequence
  Description of Artificial Sequence: Synthetic peptide
  Seed: GARGVGKSA (KRAS G12R)
GCRGVGKSF

SEQ ID NO: 9810 - protein, 9 aa, Artificial Sequence
  Description of Artificial Sequence: Synthetic peptide
  Seed: GARGVGKSA (KRAS G12R)
GCRGVGKSL

SEQ ID NO: 9811 - protein, 9 aa, Artificial Sequence
  Description of Artificial Sequence: Synthetic peptide
  Seed: GARGVGKSA (KRAS G12R)
GCRGVGKSM

SEQ ID NO: 9812 - protein, 9 aa, Artificial Sequence
  Description of Artificial Sequence: Synthetic peptide
  Seed: GARGVGKSA (KRAS G12R)
GCRGVGKSY

SEQ ID NO: 9813 - protein, 9 aa, Artificial Sequence
  Description of Artificial Sequence: Synthetic peptide
  Seed: GARGVGKSA (KRAS G12R)
GDRGVGKSF

SEQ ID NO: 9814 - protein, 9 aa, Artificial Sequence
  Description of Artificial Sequence: Synthetic peptide
  Seed: GARGVGKSA (KRAS G12R)
GDRGVGKSY

SEQ ID NO: 9815 - protein, 10 aa, Artificial Sequence
  Description of Artificial Sequence: Synthetic peptide
  Seed: GARGVGKSAL (KRAS G12R)
GERGVGKSAL

SEQ ID NO: 9816 - protein, 10 aa, Artificial Sequence
  Description of Artificial Sequence: Synthetic peptide
  Seed: GARGVGKSAL (KRAS G12R)
GERGVGKSAY

SEQ ID NO: 9817 - protein, 9 aa, Artificial Sequence
  Description of Artificial Sequence: Synthetic peptide
  Seed: GARGVGKSA (KRAS G12R)
GERGVGKSF

SEQ ID NO: 9818 - protein, 9 aa, Artificial Sequence
  Description of Artificial Sequence: Synthetic peptide
  Seed: GARGVGKSA (KRAS G12R)
GERGVGKSL

SEQ ID NO: 9819 - protein, 9 aa, Artificial Sequence
  Description of Artificial Sequence: Synthetic peptide
  Seed: GARGVGKSA (KRAS G12R)
GERGVGKSM

SEQ ID NO: 9820 - protein, 9 aa, Artificial Sequence
  Description of Artificial Sequence: Synthetic peptide
  Seed: GARGVGKSA (KRAS G12R)
GERGVGKSY

SEQ ID NO: 9821 - protein, 9 aa, Artificial Sequence
  Description of Artificial Sequence: Synthetic peptide
  Seed: GARGVGKSA (KRAS G12R)
GFRGVGKSF

SEQ ID NO: 9822 - protein, 9 aa, Artificial Sequence
  Description of Artificial Sequence: Synthetic peptide
  Seed: GARGVGKSA (KRAS G12R)
GFRGVGKSY

SEQ ID NO: 9823 - protein, 9 aa, Artificial Sequence
  Description of Artificial Sequence: Synthetic peptide
  Seed: GARGVGKSA (KRAS G12R)
GGRGVGKSA

SEQ ID NO: 9824 - protein, 10 aa, Artificial Sequence
  Description of Artificial Sequence: Synthetic peptide
  Seed: GARGVGKSAL (KRAS G12R)
GGRGVGKSAF

SEQ ID NO: 9825 - protein, 10 aa, Artificial Sequence
  Description of Artificial Sequence: Synthetic peptide
  Seed: GARGVGKSAL (KRAS G12R)
GGRGVGKSAY

SEQ ID NO: 9826 - protein, 9 aa, Artificial Sequence
  Description of Artificial Sequence: Synthetic peptide
  Seed: GARGVGKSA (KRAS G12R)
GGRGVGKSF

SEQ ID NO: 9827 - protein, 9 aa, Artificial Sequence
  Description of Artificial Sequence: Synthetic peptide
  Seed: GARGVGKSA (KRAS G12R)
GGRGVGKSH

SEQ ID NO: 9828 - protein, 9 aa, Artificial Sequence
  Description of Artificial Sequence: Synthetic peptide
  Seed: GARGVGKSA (KRAS G12R)
GGRGVGKSI

SEQ ID NO: 9829 - protein, 9 aa, Artificial Sequence
  Description of Artificial Sequence: Synthetic peptide
  Seed: GARGVGKSA (KRAS G12R)
GGRGVGKSL

SEQ ID NO: 9830 - protein, 9 aa, Artificial Sequence
  Description of Artificial Sequence: Synthetic peptide
  Seed: GARGVGKSA (KRAS G12R)
GGRGVGKSM

SEQ ID NO: 9831 - protein, 9 aa, Artificial Sequence
  Description of Artificial Sequence: Synthetic peptide
  Seed: GARGVGKSA (KRAS G12R)
GGRGVGKSV

SEQ ID NO: 9832 - protein, 9 aa, Artificial Sequence
  Description of Artificial Sequence: Synthetic peptide
  Seed: GARGVGKSA (KRAS G12R)
GGRGVGKSY

SEQ ID NO: 9833 - protein, 10 aa, Artificial Sequence
  Description of Artificial Sequence: Synthetic peptide
  Seed: GARGVGKSAL (KRAS G12R)
GHRGVGKSAL

SEQ ID NO: 9834 - protein, 9 aa, Artificial Sequence
  Description of Artificial Sequence: Synthetic peptide
  Seed: GARGVGKSA (KRAS G12R)
GIRGVGKSA

SEQ ID NO: 9835 - protein, 10 aa, Artificial Sequence
  Description of Artificial Sequence: Synthetic peptide
  Seed: GARGVGKSAL (KRAS G12R)
GIRGVGKSAF

SEQ ID NO: 9836 - protein, 10 aa, Artificial Sequence
  Description of Artificial Sequence: Synthetic peptide
  Seed: GARGVGKSAL (KRAS G12R)
GIRGVGKSAY

SEQ ID NO: 9837 - protein, 9 aa, Artificial Sequence
  Description of Artificial Sequence: Synthetic peptide
  Seed: GARGVGKSA (KRAS G12R)
GIRGVGKSF

SEQ ID NO: 9838 - protein, 9 aa, Artificial Sequence
  Description of Artificial Sequence: Synthetic peptide
  Seed: GARGVGKSA (KRAS G12R)
GIRGVGKSH

SEQ ID NO: 9839 - protein, 9 aa, Artificial Sequence
  Description of Artificial Sequence: Synthetic peptide
  Seed: GARGVGKSA (KRAS G12R)
GIRGVGKSI

SEQ ID NO: 9840 - protein, 9 aa, Artificial Sequence
  Description of Artificial Sequence: Synthetic peptide
  Seed: GARGVGKSA (KRAS G12R)
GIRGVGKSL

SEQ ID NO: 9841 - protein, 9 aa, Artificial Sequence
  Description of Artificial Sequence: Synthetic peptide
  Seed: GARGVGKSA (KRAS G12R)
GIRGVGKSM

SEQ ID NO: 9842 - protein, 9 aa, Artificial Sequence
  Description of Artificial Sequence: Synthetic peptide
  Seed: GARGVGKSA (KRAS G12R)
GIRGVGKSV

SEQ ID NO: 9843 - protein, 9 aa, Artificial Sequence
  Description of Artificial Sequence: Synthetic peptide
  Seed: GARGVGKSA (KRAS G12R)
GIRGVGKSW

SEQ ID NO: 9844 - protein, 9 aa, Artificial Sequence
  Description of Artificial Sequence: Synthetic peptide
  Seed: GARGVGKSA (KRAS G12R)
GIRGVGKSY

SEQ ID NO: 9845 - protein, 9 aa, Artificial Sequence
  Description of Artificial Sequence: Synthetic peptide
  Seed: GARGVGKSA (KRAS G12R)
GLRGVGKSA

SEQ ID NO: 9846 - protein, 10 aa, Artificial Sequence
  Description of Artificial Sequence: Synthetic peptide
  Seed: GARGVGKSAL (KRAS G12R)
GLRGVGKSAF

SEQ ID NO: 9847 - protein, 10 aa, Artificial Sequence
  Description of Artificial Sequence: Synthetic peptide
  Seed: GARGVGKSAL (KRAS G12R)
GLRGVGKSAY

SEQ ID NO: 9848 - protein, 9 aa, Artificial Sequence
  Description of Artificial Sequence: Synthetic peptide
  Seed: GARGVGKSA (KRAS G12R)
GLRGVGKSF

SEQ ID NO: 9849 - protein, 9 aa, Artificial Sequence
  Description of Artificial Sequence: Synthetic peptide
  Seed: GARGVGKSA (KRAS G12R)
GLRGVGKSH

SEQ ID NO: 9850 - protein, 9 aa, Artificial Sequence
  Description of Artificial Sequence: Synthetic peptide
  Seed: GARGVGKSA (KRAS G12R)
GLRGVGKSL

SEQ ID NO: 9851 - protein, 9 aa, Artificial Sequence
  Description of Artificial Sequence: Synthetic peptide
  Seed: GARGVGKSA (KRAS G12R)
GLRGVGKSM

SEQ ID NO: 9852 - protein, 9 aa, Artificial Sequence
  Description of Artificial Sequence: Synthetic peptide
  Seed: GARGVGKSA (KRAS G12R)
GLRGVGKSY

SEQ ID NO: 9853 - protein, 9 aa, Artificial Sequence
  Description of Artificial Sequence: Synthetic peptide
  Seed: GARGVGKSA (KRAS G12R)
GMRGVGKSA

SEQ ID NO: 9854 - protein, 10 aa, Artificial Sequence
  Description of Artificial Sequence: Synthetic peptide
  Seed: GARGVGKSAL (KRAS G12R)
GMRGVGKSAF

SEQ ID NO: 9855 - protein, 10 aa, Artificial Sequence
  Description of Artificial Sequence: Synthetic peptide
  Seed: GARGVGKSAL (KRAS G12R)
GMRGVGKSAY

SEQ ID NO: 9856 - protein, 9 aa, Artificial Sequence
  Description of Artificial Sequence: Synthetic peptide
  Seed: GARGVGKSA (KRAS G12R)
GMRGVGKSF

SEQ ID NO: 9857 - protein, 9 aa, Artificial Sequence
  Description of Artificial Sequence: Synthetic peptide
  Seed: GARGVGKSA (KRAS G12R)
GMRGVGKSH

SEQ ID NO: 9858 - protein, 9 aa, Artificial Sequence
  Description of Artificial Sequence: Synthetic peptide
  Seed: GARGVGKSA (KRAS G12R)
GMRGVGKSL

SEQ ID NO: 9859 - protein, 9 aa, Artificial Sequence
  Description of Artificial Sequence: Synthetic peptide
  Seed: GARGVGKSA (KRAS G12R)
GMRGVGKSM

SEQ ID NO: 9860 - protein, 9 aa, Artificial Sequence
  Description of Artificial Sequence: Synthetic peptide
  Seed: GARGVGKSA (KRAS G12R)
GMRGVGKSY

SEQ ID NO: 9861 - protein, 9 aa, Artificial Sequence
  Description of Artificial Sequence: Synthetic peptide
  Seed: GARGVGKSA (KRAS G12R)
GNRGVGKSF

SEQ ID NO: 9862 - protein, 9 aa, Artificial Sequence
  Description of Artificial Sequence: Synthetic peptide
  Seed: GARGVGKSA (KRAS G12R)
GNRGVGKSL

SEQ ID NO: 9863 - protein, 9 aa, Artificial Sequence
  Description of Artificial Sequence: Synthetic peptide
  Seed: GARGVGKSA (KRAS G12R)
GNRGVGKSM

SEQ ID NO: 9864 - protein, 9 aa, Artificial Sequence
  Description of Artificial Sequence: Synthetic peptide
  Seed: GARGVGKSA (KRAS G12R)
GNRGVGKSY

SEQ ID NO: 9865 - protein, 10 aa, Artificial Sequence
  Description of Artificial Sequence: Synthetic peptide
  Seed: GARGVGKSAL (KRAS G12R)
GPRGVGKSAH

SEQ ID NO: 9866 - protein, 10 aa, Artificial Sequence
  Description of Artificial Sequence: Synthetic peptide
  Seed: GARGVGKSAL (KRAS G12R)
GPRGVGKSAK

SEQ ID NO: 9867 - protein, 10 aa, Artificial Sequence
  Description of Artificial Sequence: Synthetic peptide
  Seed: GARGVGKSAL (KRAS G12R)
GPRGVGKSAN

SEQ ID NO: 9868 - protein, 10 aa, Artificial Sequence
  Description of Artificial Sequence: Synthetic peptide
  Seed: GARGVGKSAL (KRAS G12R)
GPRGVGKSAQ

SEQ ID NO: 9869 - protein, 10 aa, Artificial Sequence
  Description of Artificial Sequence: Synthetic peptide
  Seed: GARGVGKSAL (KRAS G12R)
GPRGVGKSAR

SEQ ID NO: 9870 - protein, 9 aa, Artificial Sequence
  Description of Artificial Sequence: Synthetic peptide
  Seed: GARGVGKSA (KRAS G12R)
GPRGVGKSC

SEQ ID NO: 9871 - protein, 9 aa, Artificial Sequence
  Description of Artificial Sequence: Synthetic peptide
  Seed: GARGVGKSA (KRAS G12R)
GPRGVGKSE

SEQ ID NO: 9872 - protein, 9 aa, Artificial Sequence
  Description of Artificial Sequence: Synthetic peptide
  Seed: GARGVGKSA (KRAS G12R)
GPRGVGKSF

SEQ ID NO: 9873 - protein, 9 aa, Artificial Sequence
  Description of Artificial Sequence: Synthetic peptide
  Seed: GARGVGKSA (KRAS G12R)
GPRGVGKSG

SEQ ID NO: 9874 - protein, 9 aa, Artificial Sequence
  Description of Artificial Sequence: Synthetic peptide
  Seed: GARGVGKSA (KRAS G12R)
GPRGVGKSH

SEQ ID NO: 9875 - protein, 9 aa, Artificial Sequence
  Description of Artificial Sequence: Synthetic peptide
  Seed: GARGVGKSA (KRAS G12R)
GPRGVGKSI

SEQ ID NO: 9876 - protein, 9 aa, Artificial Sequence
  Description of Artificial Sequence: Synthetic peptide
  Seed: GARGVGKSA (KRAS G12R)
GPRGVGKSK

SEQ ID NO: 9877 - protein, 9 aa, Artificial Sequence
  Description of Artificial Sequence: Synthetic peptide
  Seed: GARGVGKSA (KRAS G12R)
GPRGVGKSL

SEQ ID NO: 9878 - protein, 9 aa, Artificial Sequence
  Description of Artificial Sequence: Synthetic peptide
  Seed: GARGVGKSA (KRAS G12R)
GPRGVGKSM

SEQ ID NO: 9879 - protein, 9 aa, Artificial Sequence
  Description of Artificial Sequence: Synthetic peptide
  Seed: GARGVGKSA (KRAS G12R)
GPRGVGKSN

SEQ ID NO: 9880 - protein, 9 aa, Artificial Sequence
  Description of Artificial Sequence: Synthetic peptide
  Seed: GARGVGKSA (KRAS G12R)
GPRGVGKSP

SEQ ID NO: 9881 - protein, 9 aa, Artificial Sequence
  Description of Artificial Sequence: Synthetic peptide
  Seed: GARGVGKSA (KRAS G12R)
GPRGVGKSQ

SEQ ID NO: 9882 - protein, 9 aa, Artificial Sequence
  Description of Artificial Sequence: Synthetic peptide
  Seed: GARGVGKSA (KRAS G12R)
GPRGVGKSR

SEQ ID NO: 9883 - protein, 9 aa, Artificial Sequence
  Description of Artificial Sequence: Synthetic peptide
  Seed: GARGVGKSA (KRAS G12R)
GPRGVGKSS

SEQ ID NO: 9884 - protein, 9 aa, Artificial Sequence
  Description of Artificial Sequence: Synthetic peptide
  Seed: GARGVGKSA (KRAS G12R)
GPRGVGKST

SEQ ID NO: 9885 - protein, 9 aa, Artificial Sequence
  Description of Artificial Sequence: Synthetic peptide
  Seed: GARGVGKSA (KRAS G12R)
GPRGVGKSV

SEQ ID NO: 9886 - protein, 9 aa, Artificial Sequence
  Description of Artificial Sequence: Synthetic peptide
  Seed: GARGVGKSA (KRAS G12R)
GPRGVGKSW

SEQ ID NO: 9887 - protein, 9 aa, Artificial Sequence
  Description of Artificial Sequence: Synthetic peptide
  Seed: GARGVGKSA (KRAS G12R)
GPRGVGKSY

SEQ ID NO: 9888 - protein, 10 aa, Artificial Sequence
  Description of Artificial Sequence: Synthetic peptide
  Seed: GARGVGKSAL (KRAS G12R)
GQRGVGKSAF

SEQ ID NO: 9889 - protein, 10 aa, Artificial Sequence
  Description of Artificial Sequence: Synthetic peptide
  Seed: GARGVGKSAL (KRAS G12R)
GQRGVGKSAL

SEQ ID NO: 9890 - protein, 10 aa, Artificial Sequence
  Description of Artificial Sequence: Synthetic peptide
  Seed: GARGVGKSAL (KRAS G12R)
GQRGVGKSAM

SEQ ID NO: 9891 - protein, 10 aa, Artificial Sequence
  Description of Artificial Sequence: Synthetic peptide
  Seed: GARGVGKSAL (KRAS G12R)
GQRGVGKSAY

SEQ ID NO: 9892 - protein, 9 aa, Artificial Sequence
  Description of Artificial Sequence: Synthetic peptide
  Seed: GARGVGKSA (KRAS G12R)
GQRGVGKSF

SEQ ID NO: 9893 - protein, 9 aa, Artificial Sequence
  Description of Artificial Sequence: Synthetic peptide
  Seed: GARGVGKSA (KRAS G12R)
GQRGVGKSH

SEQ ID NO: 9894 - protein, 9 aa, Artificial Sequence
  Description of Artificial Sequence: Synthetic peptide
  Seed: GARGVGKSA (KRAS G12R)
GQRGVGKSL

SEQ ID NO: 9895 - protein, 9 aa, Artificial Sequence
  Description of Artificial Sequence: Synthetic peptide
  Seed: GARGVGKSA (KRAS G12R)
GQRGVGKSM

SEQ ID NO: 9896 - protein, 9 aa, Artificial Sequence
  Description of Artificial Sequence: Synthetic peptide
  Seed: GARGVGKSA (KRAS G12R)
GQRGVGKSV

SEQ ID NO: 9897 - protein, 9 aa, Artificial Sequence
  Description of Artificial Sequence: Synthetic peptide
  Seed: GARGVGKSA (KRAS G12R)
GQRGVGKSY

SEQ ID NO: 9898 - protein, 10 aa, Artificial Sequence
  Description of Artificial Sequence: Synthetic peptide
  Seed: GARGVGKSAL (KRAS G12R)
GRRGVGKSAF

SEQ ID NO: 9899 - protein, 10 aa, Artificial Sequence
  Description of Artificial Sequence: Synthetic peptide
  Seed: GARGVGKSAL (KRAS G12R)
GRRGVGKSAL

SEQ ID NO: 9900 - protein, 10 aa, Artificial Sequence
  Description of Artificial Sequence: Synthetic peptide
  Seed: GARGVGKSAL (KRAS G12R)
GRRGVGKSAM

SEQ ID NO: 9901 - protein, 9 aa, Artificial Sequence
  Description of Artificial Sequence: Synthetic peptide
  Seed: GARGVGKSA (KRAS G12R)
GSRGVGKSA

SEQ ID NO: 9902 - protein, 10 aa, Artificial Sequence
  Description of Artificial Sequence: Synthetic peptide
  Seed: GARGVGKSAL (KRAS G12R)
GSRGVGKSAF

SEQ ID NO: 9903 - protein, 10 aa, Artificial Sequence
  Description of Artificial Sequence: Synthetic peptide
  Seed: GARGVGKSAL (KRAS G12R)
GSRGVGKSAH

SEQ ID NO: 9904 - protein, 10 aa, Artificial Sequence
  Description of Artificial Sequence: Synthetic peptide
  Seed: GARGVGKSAL (KRAS G12R)
GSRGVGKSAL

SEQ ID NO: 9905 - protein, 10 aa, Artificial Sequence
  Description of Artificial Sequence: Synthetic peptide
  Seed: GARGVGKSAL (KRAS G12R)
GSRGVGKSAM

SEQ ID NO: 9906 - protein, 10 aa, Artificial Sequence
  Description of Artificial Sequence: Synthetic peptide
  Seed: GARGVGKSAL (KRAS G12R)
GSRGVGKSAY

SEQ ID NO: 9907 - protein, 9 aa, Artificial Sequence
  Description of Artificial Sequence: Synthetic peptide
  Seed: GARGVGKSA (KRAS G12R)
GSRGVGKSF

SEQ ID NO: 9908 - protein, 9 aa, Artificial Sequence
  Description of Artificial Sequence: Synthetic peptide
  Seed: GARGVGKSA (KRAS G12R)
GSRGVGKSH

SEQ ID NO: 9909 - protein, 9 aa, Artificial Sequence
  Description of Artificial Sequence: Synthetic peptide
  Seed: GARGVGKSA (KRAS G12R)
GSRGVGKSI

SEQ ID NO: 9910 - protein, 9 aa, Artificial Sequence
  Description of Artificial Sequence: Synthetic peptide
  Seed: GARGVGKSA (KRAS G12R)
GSRGVGKSL

SEQ ID NO: 9911 - protein, 9 aa, Artificial Sequence
  Description of Artificial Sequence: Synthetic peptide
  Seed: GARGVGKSA (KRAS G12R)
GSRGVGKSM

SEQ ID NO: 9912 - protein, 9 aa, Artificial Sequence
  Description of Artificial Sequence: Synthetic peptide
  Seed: GARGVGKSA (KRAS G12R)
GSRGVGKSV

SEQ ID NO: 9913 - protein, 9 aa, Artificial Sequence
  Description of Artificial Sequence: Synthetic peptide
  Seed: GARGVGKSA (KRAS G12R)
GSRGVGKSW

SEQ ID NO: 9914 - protein, 9 aa, Artificial Sequence
  Description of Artificial Sequence: Synthetic peptide
  Seed: GARGVGKSA (KRAS G12R)
GSRGVGKSY

SEQ ID NO: 9915 - protein, 9 aa, Artificial Sequence
  Description of Artificial Sequence: Synthetic peptide
  Seed: GARGVGKSA (KRAS G12R)
GTRGVGKSA

SEQ ID NO: 9916 - protein, 10 aa, Artificial Sequence
  Description of Artificial Sequence: Synthetic peptide
  Seed: GARGVGKSAL (KRAS G12R)
GTRGVGKSAF

SEQ ID NO: 9917 - protein, 10 aa, Artificial Sequence
  Description of Artificial Sequence: Synthetic peptide
  Seed: GARGVGKSAL (KRAS G12R)
GTRGVGKSAH

SEQ ID NO: 9918 - protein, 10 aa, Artificial Sequence
  Description of Artificial Sequence: Synthetic peptide
  Seed: GARGVGKSAL (KRAS G12R)
GTRGVGKSAM

SEQ ID NO: 9919 - protein, 10 aa, Artificial Sequence
  Description of Artificial Sequence: Synthetic peptide
  Seed: GARGVGKSAL (KRAS G12R)
GTRGVGKSAY

SEQ ID NO: 9920 - protein, 9 aa, Artificial Sequence
  Description of Artificial Sequence: Synthetic peptide
  Seed: GARGVGKSA (KRAS G12R)
GTRGVGKSF

SEQ ID NO: 9921 - protein, 9 aa, Artificial Sequence
  Description of Artificial Sequence: Synthetic peptide
  Seed: GARGVGKSA (KRAS G12R)
GTRGVGKSH

SEQ ID NO: 9922 - protein, 9 aa, Artificial Sequence
  Description of Artificial Sequence: Synthetic peptide
  Seed: GARGVGKSA (KRAS G12R)
GTRGVGKSI

SEQ ID NO: 9923 - protein, 9 aa, Artificial Sequence
  Description of Artificial Sequence: Synthetic peptide
  Seed: GARGVGKSA (KRAS G12R)
GTRGVGKSL

SEQ ID NO: 9924 - protein, 9 aa, Artificial Sequence
  Description of Artificial Sequence: Synthetic peptide
  Seed: GARGVGKSA (KRAS G12R)
GTRGVGKSM

SEQ ID NO: 9925 - protein, 9 aa, Artificial Sequence
  Description of Artificial Sequence: Synthetic peptide
  Seed: GARGVGKSA (KRAS G12R)
GTRGVGKSV

SEQ ID NO: 9926 - protein, 9 aa, Artificial Sequence
  Description of Artificial Sequence: Synthetic peptide
  Seed: GARGVGKSA (KRAS G12R)
GTRGVGKSW

SEQ ID NO: 9927 - protein, 9 aa, Artificial Sequence
  Description of Artificial Sequence: Synthetic peptide
  Seed: GARGVGKSA (KRAS G12R)
GTRGVGKSY

SEQ ID NO: 9928 - protein, 9 aa, Artificial Sequence
  Description of Artificial Sequence: Synthetic peptide
  Seed: GARGVGKSA (KRAS G12R)
GVRGVGKSA

SEQ ID NO: 9929 - protein, 10 aa, Artificial Sequence
  Description of Artificial Sequence: Synthetic peptide
  Seed: GARGVGKSAL (KRAS G12R)
GVRGVGKSAF

SEQ ID NO: 9930 - protein, 10 aa, Artificial Sequence
  Description of Artificial Sequence: Synthetic peptide
  Seed: GARGVGKSAL (KRAS G12R)
GVRGVGKSAH

SEQ ID NO: 9931 - protein, 10 aa, Artificial Sequence
  Description of Artificial Sequence: Synthetic peptide
  Seed: GARGVGKSAL (KRAS G12R)
GVRGVGKSAY

SEQ ID NO: 9932 - protein, 9 aa, Artificial Sequence
  Description of Artificial Sequence: Synthetic peptide
  Seed: GARGVGKSA (KRAS G12R)
GVRGVGKSC

SEQ ID NO: 9933 - protein, 9 aa, Artificial Sequence
  Description of Artificial Sequence: Synthetic peptide
  Seed: GARGVGKSA (KRAS G12R)
GVRGVGKSF

SEQ ID NO: 9934 - protein, 9 aa, Artificial Sequence
  Description of Artificial Sequence: Synthetic peptide
  Seed: GARGVGKSA (KRAS G12R)
GVRGVGKSH

SEQ ID NO: 9935 - protein, 9 aa, Artificial Sequence
  Description of Artificial Sequence: Synthetic peptide
  Seed: GARGVGKSA (KRAS G12R)
GVRGVGKSI

SEQ ID NO: 9936 - protein, 9 aa, Artificial Sequence
  Description of Artificial Sequence: Synthetic peptide
  Seed: GARGVGKSA (KRAS G12R)
GVRGVGKSL

SEQ ID NO: 9937 - protein, 9 aa, Artificial Sequence
  Description of Artificial Sequence: Synthetic peptide
  Seed: GARGVGKSA (KRAS G12R)
GVRGVGKSM

SEQ ID NO: 9938 - protein, 9 aa, Artificial Sequence
  Description of Artificial Sequence: Synthetic peptide
  Seed: GARGVGKSA (KRAS G12R)
GVRGVGKSV

SEQ ID NO: 9939 - protein, 9 aa, Artificial Sequence
  Description of Artificial Sequence: Synthetic peptide
  Seed: GARGVGKSA (KRAS G12R)
GVRGVGKSW

SEQ ID NO: 9940 - protein, 9 aa, Artificial Sequence
  Description of Artificial Sequence: Synthetic peptide
  Seed: GARGVGKSA (KRAS G12R)
GVRGVGKSY

SEQ ID NO: 9941 - protein, 9 aa, Artificial Sequence
  Description of Artificial Sequence: Synthetic peptide
  Seed: GARGVGKSA (KRAS G12R)
GYRGVGKSY

SEQ ID NO: 9942 - protein, 10 aa, Artificial Sequence
  Description of Artificial Sequence: Synthetic peptide
  Seed: KLVVVGARGV (KRAS G12R)
KQVVVGARGA

SEQ ID NO: 9943 - protein, 10 aa, Artificial Sequence
  Description of Artificial Sequence: Synthetic peptide
  Seed: KLVVVGARGV (KRAS G12R)
KQVVVGARGF

SEQ ID NO: 9944 - protein, 10 aa, Artificial Sequence
  Description of Artificial Sequence: Synthetic peptide
  Seed: KLVVVGARGV (KRAS G12R)
KQVVVGARGI

SEQ ID NO: 9945 - protein, 10 aa, Artificial Sequence
  Description of Artificial Sequence: Synthetic peptide
  Seed: KLVVVGARGV (KRAS G12R)
KQVVVGARGL

SEQ ID NO: 9946 - protein, 10 aa, Artificial Sequence
  Description of Artificial Sequence: Synthetic peptide
  Seed: KLVVVGARGV (KRAS G12R)
KQVVVGARGM

SEQ ID NO: 9947 - protein, 10 aa, Artificial Sequence
  Description of Artificial Sequence: Synthetic peptide
  Seed: KLVVVGARGV (KRAS G12R)
KTVVVGARGV

SEQ ID NO: 9948 - protein, 11 aa, Artificial Sequence
  Description of Artificial Sequence: Synthetic peptide
  Seed: LVVVGARGVGK (KRAS G12R)
LAVVGARGVGF

SEQ ID NO: 9949 - protein, 11 aa, Artificial Sequence
  Description of Artificial Sequence: Synthetic peptide
  Seed: LVVVGARGVGK (KRAS G12R)
LAVVGARGVGH

SEQ ID NO: 9950 - protein, 11 aa, Artificial Sequence
  Description of Artificial Sequence: Synthetic peptide
  Seed: LVVVGARGVGK (KRAS G12R)
LAVVGARGVGK

SEQ ID NO: 9951 - protein, 11 aa, Artificial Sequence
  Description of Artificial Sequence: Synthetic peptide
  Seed: LVVVGARGVGK (KRAS G12R)
LAVVGARGVGL

SEQ ID NO: 9952 - protein, 11 aa, Artificial Sequence
  Description of Artificial Sequence: Synthetic peptide
  Seed: LVVVGARGVGK (KRAS G12R)
LAVVGARGVGM

SEQ ID NO: 9953 - protein, 11 aa, Artificial Sequence
  Description of Artificial Sequence: Synthetic peptide
  Seed: LVVVGARGVGK (KRAS G12R)
LAVVGARGVGR

SEQ ID NO: 9954 - protein, 11 aa, Artificial Sequence
  Description of Artificial Sequence: Synthetic peptide
  Seed: LVVVGARGVGK (KRAS G12R)
LAVVGARGVGY

SEQ ID NO: 9955 - protein, 11 aa, Artificial Sequence
  Description of Artificial Sequence: Synthetic peptide
  Seed: LVVVGARGVGK (KRAS G12R)
LCVVGARGVGK

SEQ ID NO: 9956 - protein, 11 aa, Artificial Sequence
  Description of Artificial Sequence: Synthetic peptide
  Seed: LVVVGARGVGK (KRAS G12R)
LDVVGARGVGK

SEQ ID NO: 9957 - protein, 11 aa, Artificial Sequence
  Description of Artificial Sequence: Synthetic peptide
  Seed: LVVVGARGVGK (KRAS G12R)
LDVVGARGVGR

SEQ ID NO: 9958 - protein, 11 aa, Artificial Sequence
  Description of Artificial Sequence: Synthetic peptide
  Seed: LVVVGARGVGK (KRAS G12R)
LEVVGARGVGK

SEQ ID NO: 9959 - protein, 11 aa, Artificial Sequence
  Description of Artificial Sequence: Synthetic peptide
  Seed: LVVVGARGVGK (KRAS G12R)
LGVVGARGVGK

SEQ ID NO: 9960 - protein, 11 aa, Artificial Sequence
  Description of Artificial Sequence: Synthetic peptide
  Seed: LVVVGARGVGK (KRAS G12R)
LGVVGARGVGR

SEQ ID NO: 9961 - protein, 9 aa, Artificial Sequence
  Description of Artificial Sequence: Synthetic peptide
  Seed: LVVVGARGV (KRAS G12R)
LIVVGARGL

SEQ ID NO: 9962 - protein, 11 aa, Artificial Sequence
  Description of Artificial Sequence: Synthetic peptide
  Seed: LVVVGARGVGK (KRAS G12R)
LIVVGARGVGK

SEQ ID NO: 9963 - protein, 11 aa, Artificial Sequence
  Description of Artificial Sequence: Synthetic peptide
  Seed: LVVVGARGVGK (KRAS G12R)
LIVVGARGVGR

SEQ ID NO: 9964 - protein, 9 aa, Artificial Sequence
  Description of Artificial Sequence: Synthetic peptide
  Seed: LVVVGARGV (KRAS G12R)
LLVVGARGM

SEQ ID NO: 9965 - protein, 11 aa, Artificial Sequence
  Description of Artificial Sequence: Synthetic peptide
  Seed: LVVVGARGVGK (KRAS G12R)
LLVVGARGVGK

SEQ ID NO: 9966 - protein, 11 aa, Artificial Sequence
  Description of Artificial Sequence: Synthetic peptide
  Seed: LVVVGARGVGK (KRAS G12R)
LLVVGARGVGR

SEQ ID NO: 9967 - protein, 9 aa, Artificial Sequence
  Description of Artificial Sequence: Synthetic peptide
  Seed: LVVVGARGV (KRAS G12R)
LMVVGARGM

SEQ ID NO: 9968 - protein, 11 aa, Artificial Sequence
  Description of Artificial Sequence: Synthetic peptide
  Seed: LVVVGARGVGK (KRAS G12R)
LMVVGARGVGK

SEQ ID NO: 9969 - protein, 11 aa, Artificial Sequence
  Description of Artificial Sequence: Synthetic peptide
  Seed: LVVVGARGVGK (KRAS G12R)
LMVVGARGVGR

SEQ ID NO: 9970 - protein, 11 aa, Artificial Sequence
  Description of Artificial Sequence: Synthetic peptide
  Seed: LVVVGARGVGK (KRAS G12R)
LNVVGARGVGK

SEQ ID NO: 9971 - protein, 11 aa, Artificial Sequence
  Description of Artificial Sequence: Synthetic peptide
  Seed: LVVVGARGVGK (KRAS G12R)
LNVVGARGVGR

SEQ ID NO: 9972 - protein, 9 aa, Artificial Sequence
  Description of Artificial Sequence: Synthetic peptide
  Seed: LVVVGARGV (KRAS G12R)
LQVVGARGI

SEQ ID NO: 9973 - protein, 9 aa, Artificial Sequence
  Description of Artificial Sequence: Synthetic peptide
  Seed: LVVVGARGV (KRAS G12R)
LQVVGARGL

SEQ ID NO: 9974 - protein, 11 aa, Artificial Sequence
  Description of Artificial Sequence: Synthetic peptide
  Seed: LVVVGARGVGK (KRAS G12R)
LQVVGARGVGK

SEQ ID NO: 9975 - protein, 11 aa, Artificial Sequence
  Description of Artificial Sequence: Synthetic peptide
  Seed: LVVVGARGVGK (KRAS G12R)
LQVVGARGVGR

SEQ ID NO: 9976 - protein, 11 aa, Artificial Sequence
  Description of Artificial Sequence: Synthetic peptide
  Seed: LVVVGARGVGK (KRAS G12R)
LSVVGARGVGF

SEQ ID NO: 9977 - protein, 11 aa, Artificial Sequence
  Description of Artificial Sequence: Synthetic peptide
  Seed: LVVVGARGVGK (KRAS G12R)
LSVVGARGVGK

SEQ ID NO: 9978 - protein, 11 aa, Artificial Sequence
  Description of Artificial Sequence: Synthetic peptide
  Seed: LVVVGARGVGK (KRAS G12R)
LSVVGARGVGR

SEQ ID NO: 9979 - protein, 11 aa, Artificial Sequence
  Description of Artificial Sequence: Synthetic peptide
  Seed: LVVVGARGVGK (KRAS G12R)
LSVVGARGVGY

SEQ ID NO: 9980 - protein, 9 aa, Artificial Sequence
  Description of Artificial Sequence: Synthetic peptide
  Seed: LVVVGARGV (KRAS G12R)
LTVVGARGV

SEQ ID NO: 9981 - protein, 11 aa, Artificial Sequence
  Description of Artificial Sequence: Synthetic peptide
  Seed: LVVVGARGVGK (KRAS G12R)
LTVVGARGVGF

SEQ ID NO: 9982 - protein, 11 aa, Artificial Sequence
  Description of Artificial Sequence: Synthetic peptide
  Seed: LVVVGARGVGK (KRAS G12R)
LTVVGARGVGK

SEQ ID NO: 9983 - protein, 11 aa, Artificial Sequence
  Description of Artificial Sequence: Synthetic peptide
  Seed: LVVVGARGVGK (KRAS G12R)
LTVVGARGVGR

SEQ ID NO: 9984 - protein, 11 aa, Artificial Sequence
  Description of Artificial Sequence: Synthetic peptide
  Seed: LVVVGARGVGK (KRAS G12R)
LTVVGARGVGY

SEQ ID NO: 9985 - protein, 11 aa, Artificial Sequence
  Description of Artificial Sequence: Synthetic peptide
  Seed: LVVVGARGVGK (KRAS G12R)
LVVVGARGVGR

SEQ ID NO: 9986 - protein, 11 aa, Artificial Sequence
  Description of Artificial Sequence: Synthetic peptide
  Seed: LVVVGARGVGK (KRAS G12R)
LVVVGARGVGY

SEQ ID NO: 9987 - protein, 10 aa, Artificial Sequence
  Description of Artificial Sequence: Synthetic peptide
  Seed: RGVGKSALTI (KRAS G12R)
RAVGKSALTF

SEQ ID NO: 9988 - protein, 10 aa, Artificial Sequence
  Description of Artificial Sequence: Synthetic peptide
  Seed: RGVGKSALTI (KRAS G12R)
RAVGKSALTK

SEQ ID NO: 9989 - protein, 10 aa, Artificial Sequence
  Description of Artificial Sequence: Synthetic peptide
  Seed: RGVGKSALTI (KRAS G12R)
RAVGKSALTL

SEQ ID NO: 9990 - protein, 10 aa, Artificial Sequence
  Description of Artificial Sequence: Synthetic peptide
  Seed: RGVGKSALTI (KRAS G12R)
RAVGKSALTY

SEQ ID NO: 9991 - protein, 10 aa, Artificial Sequence
  Description of Artificial Sequence: Synthetic peptide
  Seed: RGVGKSALTI (KRAS G12R)
RCVGKSALTL

SEQ ID NO: 9992 - protein, 10 aa, Artificial Sequence
  Description of Artificial Sequence: Synthetic peptide
  Seed: RGVGKSALTI (KRAS G12R)
RDVGKSALTK

SEQ ID NO: 9993 - protein, 10 aa, Artificial Sequence
  Description of Artificial Sequence: Synthetic peptide
  Seed: RGVGKSALTI (KRAS G12R)
REVGKSALTF

SEQ ID NO: 9994 - protein, 10 aa, Artificial Sequence
  Description of Artificial Sequence: Synthetic peptide
  Seed: RGVGKSALTI (KRAS G12R)
REVGKSALTK

SEQ ID NO: 9995 - protein, 10 aa, Artificial Sequence
  Description of Artificial Sequence: Synthetic peptide
  Seed: RGVGKSALTI (KRAS G12R)
REVGKSALTL

SEQ ID NO: 9996 - protein, 10 aa, Artificial Sequence
  Description of Artificial Sequence: Synthetic peptide
  Seed: RGVGKSALTI (KRAS G12R)
REVGKSALTR

SEQ ID NO: 9997 - protein, 10 aa, Artificial Sequence
  Description of Artificial Sequence: Synthetic peptide
  Seed: RGVGKSALTI (KRAS G12R)
REVGKSALTY

SEQ ID NO: 9998 - protein, 10 aa, Artificial Sequence
  Description of Artificial Sequence: Synthetic peptide
  Seed: RGVGKSALTI (KRAS G12R)
RGVGKSALTF

SEQ ID NO: 9999 - protein, 10 aa, Artificial Sequence
  Description of Artificial Sequence: Synthetic peptide
  Seed: RGVGKSALTI (KRAS G12R)
RGVGKSALTK

SEQ ID NO: 10000 - protein, 10 aa, Artificial Sequence
  Description of Artificial Sequence: Synthetic peptide
  Seed: RGVGKSALTI (KRAS G12R)
RGVGKSALTL

SEQ ID NO: 10001 - protein, 10 aa, Artificial Sequence
  Description of Artificial Sequence: Synthetic peptide
  Seed: RGVGKSALTI (KRAS G12R)
RGVGKSALTM

SEQ ID NO: 10002 - protein, 10 aa, Artificial Sequence
  Description of Artificial Sequence: Synthetic peptide
  Seed: RGVGKSALTI (KRAS G12R)
RGVGKSALTR

SEQ ID NO: 10003 - protein, 10 aa, Artificial Sequence
  Description of Artificial Sequence: Synthetic peptide
  Seed: RGVGKSALTI (KRAS G12R)
RGVGKSALTY

SEQ ID NO: 10004 - protein, 10 aa, Artificial Sequence
  Description of Artificial Sequence: Synthetic peptide
  Seed: RGVGKSALTI (KRAS G12R)
RHVGKSALTF

SEQ ID NO: 10005 - protein, 10 aa, Artificial Sequence
  Description of Artificial Sequence: Synthetic peptide
  Seed: RGVGKSALTI (KRAS G12R)
RHVGKSALTK

SEQ ID NO: 10006 - protein, 10 aa, Artificial Sequence
  Description of Artificial Sequence: Synthetic peptide
  Seed: RGVGKSALTI (KRAS G12R)
RHVGKSALTL

SEQ ID NO: 10007 - protein, 10 aa, Artificial Sequence
  Description of Artificial Sequence: Synthetic peptide
  Seed: RGVGKSALTI (KRAS G12R)
RHVGKSALTY

SEQ ID NO: 10008 - protein, 10 aa, Artificial Sequence
  Description of Artificial Sequence: Synthetic peptide
  Seed: RGVGKSALTI (KRAS G12R)
RIVGKSALTF

SEQ ID NO: 10009 - protein, 10 aa, Artificial Sequence
  Description of Artificial Sequence: Synthetic peptide
  Seed: RGVGKSALTI (KRAS G12R)
RIVGKSALTL

SEQ ID NO: 10010 - protein, 10 aa, Artificial Sequence
  Description of Artificial Sequence: Synthetic peptide
  Seed: RGVGKSALTI (KRAS G12R)
RKVGKSALTF

SEQ ID NO: 10011 - protein, 10 aa, Artificial Sequence
  Description of Artificial Sequence: Synthetic peptide
  Seed: RGVGKSALTI (KRAS G12R)
RKVGKSALTK

SEQ ID NO: 10012 - protein, 10 aa, Artificial Sequence
  Description of Artificial Sequence: Synthetic peptide
  Seed: RGVGKSALTI (KRAS G12R)
RKVGKSALTL

SEQ ID NO: 10013 - protein, 10 aa, Artificial Sequence
  Description of Artificial Sequence: Synthetic peptide
  Seed: RGVGKSALTI (KRAS G12R)
RKVGKSALTM

SEQ ID NO: 10014 - protein, 10 aa, Artificial Sequence
  Description of Artificial Sequence: Synthetic peptide
  Seed: RGVGKSALTI (KRAS G12R)
RKVGKSALTR

SEQ ID NO: 10015 - protein, 10 aa, Artificial Sequence
  Description of Artificial Sequence: Synthetic peptide
  Seed: RGVGKSALTI (KRAS G12R)
RKVGKSALTY

SEQ ID NO: 10016 - protein, 10 aa, Artificial Sequence
  Description of Artificial Sequence: Synthetic peptide
  Seed: RGVGKSALTI (KRAS G12R)
RLVGKSALTF

SEQ ID NO: 10017 - protein, 10 aa, Artificial Sequence
  Description of Artificial Sequence: Synthetic peptide
  Seed: RGVGKSALTI (KRAS G12R)
RLVGKSALTL

SEQ ID NO: 10018 - protein, 10 aa, Artificial Sequence
  Description of Artificial Sequence: Synthetic peptide
  Seed: RGVGKSALTI (KRAS G12R)
RMVGKSALTF

SEQ ID NO: 10019 - protein, 10 aa, Artificial Sequence
  Description of Artificial Sequence: Synthetic peptide
  Seed: RGVGKSALTI (KRAS G12R)
RMVGKSALTK

SEQ ID NO: 10020 - protein, 10 aa, Artificial Sequence
  Description of Artificial Sequence: Synthetic peptide
  Seed: RGVGKSALTI (KRAS G12R)
RMVGKSALTL

SEQ ID NO: 10021 - protein, 10 aa, Artificial Sequence
  Description of Artificial Sequence: Synthetic peptide
  Seed: RGVGKSALTI (KRAS G12R)
RNVGKSALTF

SEQ ID NO: 10022 - protein, 10 aa, Artificial Sequence
  Description of Artificial Sequence: Synthetic peptide
  Seed: RGVGKSALTI (KRAS G12R)
RNVGKSALTK

SEQ ID NO: 10023 - protein, 10 aa, Artificial Sequence
  Description of Artificial Sequence: Synthetic peptide
  Seed: RGVGKSALTI (KRAS G12R)
RNVGKSALTL

SEQ ID NO: 10024 - protein, 10 aa, Artificial Sequence
  Description of Artificial Sequence: Synthetic peptide
  Seed: RGVGKSALTI (KRAS G12R)
RNVGKSALTR

SEQ ID NO: 10025 - protein, 10 aa, Artificial Sequence
  Description of Artificial Sequence: Synthetic peptide
  Seed: RGVGKSALTI (KRAS G12R)
RQVGKSALTF

SEQ ID NO: 10026 - protein, 10 aa, Artificial Sequence
  Description of Artificial Sequence: Synthetic peptide
  Seed: RGVGKSALTI (KRAS G12R)
RQVGKSALTI

SEQ ID NO: 10027 - protein, 10 aa, Artificial Sequence
  Description of Artificial Sequence: Synthetic peptide
  Seed: RGVGKSALTI (KRAS G12R)
RQVGKSALTK

SEQ ID NO: 10028 - protein, 10 aa, Artificial Sequence
  Description of Artificial Sequence: Synthetic peptide
  Seed: RGVGKSALTI (KRAS G12R)
RQVGKSALTL

SEQ ID NO: 10029 - protein, 10 aa, Artificial Sequence
  Description of Artificial Sequence: Synthetic peptide
  Seed: RGVGKSALTI (KRAS G12R)
RQVGKSALTM

SEQ ID NO: 10030 - protein, 10 aa, Artificial Sequence
  Description of Artificial Sequence: Synthetic peptide
  Seed: RGVGKSALTI (KRAS G12R)
RQVGKSALTR

SEQ ID NO: 10031 - protein, 10 aa, Artificial Sequence
  Description of Artificial Sequence: Synthetic peptide
  Seed: RGVGKSALTI (KRAS G12R)
RQVGKSALTY

SEQ ID NO: 10032 - protein, 10 aa, Artificial Sequence
  Description of Artificial Sequence: Synthetic peptide
  Seed: RGVGKSALTI (KRAS G12R)
RRVGKSALTA

SEQ ID NO: 10033 - protein, 10 aa, Artificial Sequence
  Description of Artificial Sequence: Synthetic peptide
  Seed: RGVGKSALTI (KRAS G12R)
RRVGKSALTC

SEQ ID NO: 10034 - protein, 10 aa, Artificial Sequence
  Description of Artificial Sequence: Synthetic peptide
  Seed: RGVGKSALTI (KRAS G12R)
RRVGKSALTE

SEQ ID NO: 10035 - protein, 10 aa, Artificial Sequence
  Description of Artificial Sequence: Synthetic peptide
  Seed: RGVGKSALTI (KRAS G12R)
RRVGKSALTF

SEQ ID NO: 10036 - protein, 10 aa, Artificial Sequence
  Description of Artificial Sequence: Synthetic peptide
  Seed: RGVGKSALTI (KRAS G12R)
RRVGKSALTG

SEQ ID NO: 10037 - protein, 10 aa, Artificial Sequence
  Description of Artificial Sequence: Synthetic peptide
  Seed: RGVGKSALTI (KRAS G12R)
RRVGKSALTH

SEQ ID NO: 10038 - protein, 10 aa, Artificial Sequence
  Description of Artificial Sequence: Synthetic peptide
  Seed: RGVGKSALTI (KRAS G12R)
RRVGKSALTI

SEQ ID NO: 10039 - protein, 10 aa, Artificial Sequence
  Description of Artificial Sequence: Synthetic peptide
  Seed: RGVGKSALTI (KRAS G12R)
RRVGKSALTK

SEQ ID NO: 10040 - protein, 10 aa, Artificial Sequence
  Description of Artificial Sequence: Synthetic peptide
  Seed: RGVGKSALTI (KRAS G12R)
RRVGKSALTL

SEQ ID NO: 10041 - protein, 10 aa, Artificial Sequence
  Description of Artificial Sequence: Synthetic peptide
  Seed: RGVGKSALTI (KRAS G12R)
RRVGKSALTM

SEQ ID NO: 10042 - protein, 10 aa, Artificial Sequence
  Description of Artificial Sequence: Synthetic peptide
  Seed: RGVGKSALTI (KRAS G12R)
RRVGKSALTN

SEQ ID NO: 10043 - protein, 10 aa, Artificial Sequence
  Description of Artificial Sequence: Synthetic peptide
  Seed: RGVGKSALTI (KRAS G12R)
RRVGKSALTP

SEQ ID NO: 10044 - protein, 10 aa, Artificial Sequence
  Description of Artificial Sequence: Synthetic peptide
  Seed: RGVGKSALTI (KRAS G12R)
RRVGKSALTQ

SEQ ID NO: 10045 - protein, 10 aa, Artificial Sequence
  Description of Artificial Sequence: Synthetic peptide
  Seed: RGVGKSALTI (KRAS G12R)
RRVGKSALTR

SEQ ID NO: 10046 - protein, 10 aa, Artificial Sequence
  Description of Artificial Sequence: Synthetic peptide
  Seed: RGVGKSALTI (KRAS G12R)
RRVGKSALTS

SEQ ID NO: 10047 - protein, 10 aa, Artificial Sequence
  Description of Artificial Sequence: Synthetic peptide
  Seed: RGVGKSALTI (KRAS G12R)
RRVGKSALTT

SEQ ID NO: 10048 - protein, 10 aa, Artificial Sequence
  Description of Artificial Sequence: Synthetic peptide
  Seed: RGVGKSALTI (KRAS G12R)
RRVGKSALTV

SEQ ID NO: 10049 - protein, 10 aa, Artificial Sequence
  Description of Artificial Sequence: Synthetic peptide
  Seed: RGVGKSALTI (KRAS G12R)
RRVGKSALTW

SEQ ID NO: 10050 - protein, 10 aa, Artificial Sequence
  Description of Artificial Sequence: Synthetic peptide
  Seed: RGVGKSALTI (KRAS G12R)
RRVGKSALTY

SEQ ID NO: 10051 - protein, 10 aa, Artificial Sequence
  Description of Artificial Sequence: Synthetic peptide
  Seed: RGVGKSALTI (KRAS G12R)
RSVGKSALTF

SEQ ID NO: 10052 - protein, 10 aa, Artificial Sequence
  Description of Artificial Sequence: Synthetic peptide
  Seed: RGVGKSALTI (KRAS G12R)
RSVGKSALTK

SEQ ID NO: 10053 - protein, 10 aa, Artificial Sequence
  Description of Artificial Sequence: Synthetic peptide
  Seed: RGVGKSALTI (KRAS G12R)
RSVGKSALTL

SEQ ID NO: 10054 - protein, 10 aa, Artificial Sequence
  Description of Artificial Sequence: Synthetic peptide
  Seed: RGVGKSALTI (KRAS G12R)
RTVGKSALTF

SEQ ID NO: 10055 - protein, 10 aa, Artificial Sequence
  Description of Artificial Sequence: Synthetic peptide
  Seed: RGVGKSALTI (KRAS G12R)
RTVGKSALTL

SEQ ID NO: 10056 - protein, 10 aa, Artificial Sequence
  Description of Artificial Sequence: Synthetic peptide
  Seed: RGVGKSALTI (KRAS G12R)
RVVGKSALTL

SEQ ID NO: 10057 - protein, 8 aa, Artificial Sequence
  Description of Artificial Sequence: Synthetic peptide
  Seed: VGARGVGK (KRAS G12R)
VAARGVGF

SEQ ID NO: 10058 - protein, 8 aa, Artificial Sequence
  Description of Artificial Sequence: Synthetic peptide
  Seed: VGARGVGK (KRAS G12R)
VAARGVGI

SEQ ID NO: 10059 - protein, 8 aa, Artificial Sequence
  Description of Artificial Sequence: Synthetic peptide
  Seed: VGARGVGK (KRAS G12R)
VAARGVGK

SEQ ID NO: 10060 - protein, 8 aa, Artificial Sequence
  Description of Artificial Sequence: Synthetic peptide
  Seed: VGARGVGK (KRAS G12R)
VAARGVGL

SEQ ID NO: 10061 - protein, 8 aa, Artificial Sequence
  Description of Artificial Sequence: Synthetic peptide
  Seed: VGARGVGK (KRAS G12R)
VAARGVGM

SEQ ID NO: 10062 - protein, 8 aa, Artificial Sequence
  Description of Artificial Sequence: Synthetic peptide
  Seed: VGARGVGK (KRAS G12R)
VAARGVGR

SEQ ID NO: 10063 - protein, 9 aa, Artificial Sequence
  Description of Artificial Sequence: Synthetic peptide
  Seed: VVGARGVGK (KRAS G12R)
VAGARGVGF

SEQ ID NO: 10064 - protein, 9 aa, Artificial Sequence
  Description of Artificial Sequence: Synthetic peptide
  Seed: VVGARGVGK (KRAS G12R)
VAGARGVGI

SEQ ID NO: 10065 - protein, 9 aa, Artificial Sequence
  Description of Artificial Sequence: Synthetic peptide
  Seed: VVGARGVGK (KRAS G12R)
VAGARGVGK

SEQ ID NO: 10066 - protein, 9 aa, Artificial Sequence
  Description of Artificial Sequence: Synthetic peptide
  Seed: VVGARGVGK (KRAS G12R)
VAGARGVGR

SEQ ID NO: 10067 - protein, 9 aa, Artificial Sequence
  Description of Artificial Sequence: Synthetic peptide
  Seed: VVGARGVGK (KRAS G12R)
VAGARGVGV

SEQ ID NO: 10068 - protein, 9 aa, Artificial Sequence
  Description of Artificial Sequence: Synthetic peptide
  Seed: VVGARGVGK (KRAS G12R)
VAGARGVGW

SEQ ID NO: 10069 - protein, 9 aa, Artificial Sequence
  Description of Artificial Sequence: Synthetic peptide
  Seed: VVGARGVGK (KRAS G12R)
VAGARGVGY

SEQ ID NO: 10070 - protein, 10 aa, Artificial Sequence
  Description of Artificial Sequence: Synthetic peptide
  Seed: VVVGARGVGK (KRAS G12R)
VAVGARGVGA

SEQ ID NO: 10071 - protein, 10 aa, Artificial Sequence
  Description of Artificial Sequence: Synthetic peptide
  Seed: VVVGARGVGK (KRAS G12R)
VAVGARGVGC

SEQ ID NO: 10072 - protein, 10 aa, Artificial Sequence
  Description of Artificial Sequence: Synthetic peptide
  Seed: VVVGARGVGK (KRAS G12R)
VAVGARGVGF

SEQ ID NO: 10073 - protein, 10 aa, Artificial Sequence
  Description of Artificial Sequence: Synthetic peptide
  Seed: VVVGARGVGK (KRAS G12R)
VAVGARGVGH

SEQ ID NO: 10074 - protein, 10 aa, Artificial Sequence
  Description of Artificial Sequence: Synthetic peptide
  Seed: VVVGARGVGK (KRAS G12R)
VAVGARGVGI

SEQ ID NO: 10075 - protein, 10 aa, Artificial Sequence
  Description of Artificial Sequence: Synthetic peptide
  Seed: VVVGARGVGK (KRAS G12R)
VAVGARGVGL

SEQ ID NO: 10076 - protein, 10 aa, Artificial Sequence
  Description of Artificial Sequence: Synthetic peptide
  Seed: VVVGARGVGK (KRAS G12R)
VAVGARGVGM

SEQ ID NO: 10077 - protein, 10 aa, Artificial Sequence
  Description of Artificial Sequence: Synthetic peptide
  Seed: VVVGARGVGK (KRAS G12R)
VAVGARGVGV

SEQ ID NO: 10078 - protein, 10 aa, Artificial Sequence
  Description of Artificial Sequence: Synthetic peptide
  Seed: VVVGARGVGK (KRAS G12R)
VAVGARGVGW

SEQ ID NO: 10079 - protein, 10 aa, Artificial Sequence
  Description of Artificial Sequence: Synthetic peptide
  Seed: VVVGARGVGK (KRAS G12R)
VAVGARGVGY

SEQ ID NO: 10080 - protein, 10 aa, Artificial Sequence
  Description of Artificial Sequence: Synthetic peptide
  Seed: VVVGARGVGK (KRAS G12R)
VCVGARGVGF

SEQ ID NO: 10081 - protein, 10 aa, Artificial Sequence
  Description of Artificial Sequence: Synthetic peptide
  Seed: VVVGARGVGK (KRAS G12R)
VCVGARGVGK

SEQ ID NO: 10082 - protein, 10 aa, Artificial Sequence
  Description of Artificial Sequence: Synthetic peptide
  Seed: VVVGARGVGK (KRAS G12R)
VCVGARGVGR

SEQ ID NO: 10083 - protein, 10 aa, Artificial Sequence
  Description of Artificial Sequence: Synthetic peptide
  Seed: VVVGARGVGK (KRAS G12R)
VCVGARGVGY

SEQ ID NO: 10084 - protein, 9 aa, Artificial Sequence
  Description of Artificial Sequence: Synthetic peptide
  Seed: VVGARGVGK (KRAS G12R)
VDGARGVGK

SEQ ID NO: 10085 - protein, 9 aa, Artificial Sequence
  Description of Artificial Sequence: Synthetic peptide
  Seed: VVGARGVGK (KRAS G12R)
VDGARGVGR

SEQ ID NO: 10086 - protein, 9 aa, Artificial Sequence
  Description of Artificial Sequence: Synthetic peptide
  Seed: VVGARGVGK (KRAS G12R)
VDGARGVGY

SEQ ID NO: 10087 - protein, 10 aa, Artificial Sequence
  Description of Artificial Sequence: Synthetic peptide
  Seed: VVVGARGVGK (KRAS G12R)
VDVGARGVGK

SEQ ID NO: 10088 - protein, 10 aa, Artificial Sequence
  Description of Artificial Sequence: Synthetic peptide
  Seed: VVVGARGVGK (KRAS G12R)
VDVGARGVGR

SEQ ID NO: 10089 - protein, 10 aa, Artificial Sequence
  Description of Artificial Sequence: Synthetic peptide
  Seed: VVVGARGVGK (KRAS G12R)
VDVGARGVGY

SEQ ID NO: 10090 - protein, 9 aa, Artificial Sequence
  Description of Artificial Sequence: Synthetic peptide
  Seed: VVGARGVGK (KRAS G12R)
VEGARGVGK

SEQ ID NO: 10091 - protein, 9 aa, Artificial Sequence
  Description of Artificial Sequence: Synthetic peptide
  Seed: VVGARGVGK (KRAS G12R)
VEGARGVGR

SEQ ID NO: 10092 - protein, 10 aa, Artificial Sequence
  Description of Artificial Sequence: Synthetic peptide
  Seed: VVVGARGVGK (KRAS G12R)
VEVGARGVGF

SEQ ID NO: 10093 - protein, 10 aa, Artificial Sequence
  Description of Artificial Sequence: Synthetic peptide
  Seed: VVVGARGVGK (KRAS G12R)
VEVGARGVGK

SEQ ID NO: 10094 - protein, 10 aa, Artificial Sequence
  Description of Artificial Sequence: Synthetic peptide
  Seed: VVVGARGVGK (KRAS G12R)
VEVGARGVGR

SEQ ID NO: 10095 - protein, 10 aa, Artificial Sequence
  Description of Artificial Sequence: Synthetic peptide
  Seed: VVVGARGVGK (KRAS G12R)
VEVGARGVGY

SEQ ID NO: 10096 - protein, 9 aa, Artificial Sequence
  Description of Artificial Sequence: Synthetic peptide
  Seed: VVGARGVGK (KRAS G12R)
VFGARGVGF

SEQ ID NO: 10097 - protein, 9 aa, Artificial Sequence
  Description of Artificial Sequence: Synthetic peptide
  Seed: VVGARGVGK (KRAS G12R)
VFGARGVGK

SEQ ID NO: 10098 - protein, 9 aa, Artificial Sequence
  Description of Artificial Sequence: Synthetic peptide
  Seed: VVGARGVGK (KRAS G12R)
VFGARGVGL

SEQ ID NO: 10099 - protein, 9 aa, Artificial Sequence
  Description of Artificial Sequence: Synthetic peptide
  Seed: VVGARGVGK (KRAS G12R)
VFGARGVGM

SEQ ID NO: 10100 - protein, 9 aa, Artificial Sequence
  Description of Artificial Sequence: Synthetic peptide
  Seed: VVGARGVGK (KRAS G12R)
VFGARGVGR

SEQ ID NO: 10101 - protein, 9 aa, Artificial Sequence
  Description of Artificial Sequence: Synthetic peptide
  Seed: VVGARGVGK (KRAS G12R)
VFGARGVGY

SEQ ID NO: 10102 - protein, 10 aa, Artificial Sequence
  Description of Artificial Sequence: Synthetic peptide
  Seed: VVVGARGVGK (KRAS G12R)
VFVGARGVGF

SEQ ID NO: 10103 - protein, 10 aa, Artificial Sequence
  Description of Artificial Sequence: Synthetic peptide
  Seed: VVVGARGVGK (KRAS G12R)
VFVGARGVGR

SEQ ID NO: 10104 - protein, 10 aa, Artificial Sequence
  Description of Artificial Sequence: Synthetic peptide
  Seed: VVVGARGVGK (KRAS G12R)
VFVGARGVGY

SEQ ID NO: 10105 - protein, 8 aa, Artificial Sequence
  Description of Artificial Sequence: Synthetic peptide
  Seed: VGARGVGK (KRAS G12R)
VGARGVGR

SEQ ID NO: 10106 - protein, 9 aa, Artificial Sequence
  Description of Artificial Sequence: Synthetic peptide
  Seed: VVGARGVGK (KRAS G12R)
VGGARGVGF

SEQ ID NO: 10107 - protein, 9 aa, Artificial Sequence
  Description of Artificial Sequence: Synthetic peptide
  Seed: VVGARGVGK (KRAS G12R)
VGGARGVGK

SEQ ID NO: 10108 - protein, 9 aa, Artificial Sequence
  Description of Artificial Sequence: Synthetic peptide
  Seed: VVGARGVGK (KRAS G12R)
VGGARGVGL

SEQ ID NO: 10109 - protein, 9 aa, Artificial Sequence
  Description of Artificial Sequence: Synthetic peptide
  Seed: VVGARGVGK (KRAS G12R)
VGGARGVGM

SEQ ID NO: 10110 - protein, 9 aa, Artificial Sequence
  Description of Artificial Sequence: Synthetic peptide
  Seed: VVGARGVGK (KRAS G12R)
VGGARGVGR

SEQ ID NO: 10111 - protein, 9 aa, Artificial Sequence
  Description of Artificial Sequence: Synthetic peptide
  Seed: VVGARGVGK (KRAS G12R)
VGGARGVGY

SEQ ID NO: 10112 - protein, 10 aa, Artificial Sequence
  Description of Artificial Sequence: Synthetic peptide
  Seed: VVVGARGVGK (KRAS G12R)
VGVGARGVGF

SEQ ID NO: 10113 - protein, 10 aa, Artificial Sequence
  Description of Artificial Sequence: Synthetic peptide
  Seed: VVVGARGVGK (KRAS G12R)
VGVGARGVGH

SEQ ID NO: 10114 - protein, 10 aa, Artificial Sequence
  Description of Artificial Sequence: Synthetic peptide
  Seed: VVVGARGVGK (KRAS G12R)
VGVGARGVGK

SEQ ID NO: 10115 - protein, 10 aa, Artificial Sequence
  Description of Artificial Sequence: Synthetic peptide
  Seed: VVVGARGVGK (KRAS G12R)
VGVGARGVGL

SEQ ID NO: 10116 - protein, 10 aa, Artificial Sequence
  Description of Artificial Sequence: Synthetic peptide
  Seed: VVVGARGVGK (KRAS G12R)
VGVGARGVGM

SEQ ID NO: 10117 - protein, 10 aa, Artificial Sequence
  Description of Artificial Sequence: Synthetic peptide
  Seed: VVVGARGVGK (KRAS G12R)
VGVGARGVGR

SEQ ID NO: 10118 - protein, 10 aa, Artificial Sequence
  Description of Artificial Sequence: Synthetic peptide
  Seed: VVVGARGVGK (KRAS G12R)
VGVGARGVGY

SEQ ID NO: 10119 - protein, 10 aa, Artificial Sequence
  Description of Artificial Sequence: Synthetic peptide
  Seed: VVVGARGVGK (KRAS G12R)
VHVGARGVGK

SEQ ID NO: 10120 - protein, 10 aa, Artificial Sequence
  Description of Artificial Sequence: Synthetic peptide
  Seed: VVVGARGVGK (KRAS G12R)
VHVGARGVGR

SEQ ID NO: 10121 - protein, 8 aa, Artificial Sequence
  Description of Artificial Sequence: Synthetic peptide
  Seed: VGARGVGK (KRAS G12R)
VIARGVGK

SEQ ID NO: 10122 - protein, 8 aa, Artificial Sequence
  Description of Artificial Sequence: Synthetic peptide
  Seed: VGARGVGK (KRAS G12R)
VIARGVGR

SEQ ID NO: 10123 - protein, 9 aa, Artificial Sequence
  Description of Artificial Sequence: Synthetic peptide
  Seed: VVGARGVGK (KRAS G12R)
VIGARGVGF

SEQ ID NO: 10124 - protein, 9 aa, Artificial Sequence
  Description of Artificial Sequence: Synthetic peptide
  Seed: VVGARGVGK (KRAS G12R)
VIGARGVGL

SEQ ID NO: 10125 - protein, 9 aa, Artificial Sequence
  Description of Artificial Sequence: Synthetic peptide
  Seed: VVGARGVGK (KRAS G12R)
VIGARGVGM

SEQ ID NO: 10126 - protein, 9 aa, Artificial Sequence
  Description of Artificial Sequence: Synthetic peptide
  Seed: VVGARGVGK (KRAS G12R)
VIGARGVGR

SEQ ID NO: 10127 - protein, 9 aa, Artificial Sequence
  Description of Artificial Sequence: Synthetic peptide
  Seed: VVGARGVGK (KRAS G12R)
VIGARGVGY

SEQ ID NO: 10128 - protein, 10 aa, Artificial Sequence
  Description of Artificial Sequence: Synthetic peptide
  Seed: VVVGARGVGK (KRAS G12R)
VIVGARGVGF

SEQ ID NO: 10129 - protein, 10 aa, Artificial Sequence
  Description of Artificial Sequence: Synthetic peptide
  Seed: VVVGARGVGK (KRAS G12R)
VIVGARGVGH

SEQ ID NO: 10130 - protein, 10 aa, Artificial Sequence
  Description of Artificial Sequence: Synthetic peptide
  Seed: VVVGARGVGK (KRAS G12R)
VIVGARGVGL

SEQ ID NO: 10131 - protein, 10 aa, Artificial Sequence
  Description of Artificial Sequence: Synthetic peptide
  Seed: VVVGARGVGK (KRAS G12R)
VIVGARGVGM

SEQ ID NO: 10132 - protein, 10 aa, Artificial Sequence
  Description of Artificial Sequence: Synthetic peptide
  Seed: VVVGARGVGK (KRAS G12R)
VIVGARGVGY

SEQ ID NO: 10133 - protein, 8 aa, Artificial Sequence
  Description of Artificial Sequence: Synthetic peptide
  Seed: VGARGVGK (KRAS G12R)
VLARGVGK

SEQ ID NO: 10134 - protein, 9 aa, Artificial Sequence
  Description of Artificial Sequence: Synthetic peptide
  Seed: VVGARGVGK (KRAS G12R)
VLGARGVGF

SEQ ID NO: 10135 - protein, 9 aa, Artificial Sequence
  Description of Artificial Sequence: Synthetic peptide
  Seed: VVGARGVGK (KRAS G12R)
VLGARGVGL

SEQ ID NO: 10136 - protein, 9 aa, Artificial Sequence
  Description of Artificial Sequence: Synthetic peptide
  Seed: VVGARGVGK (KRAS G12R)
VLGARGVGM

SEQ ID NO: 10137 - protein, 9 aa, Artificial Sequence
  Description of Artificial Sequence: Synthetic peptide
  Seed: VVGARGVGK (KRAS G12R)
VLGARGVGR

SEQ ID NO: 10138 - protein, 9 aa, Artificial Sequence
  Description of Artificial Sequence: Synthetic peptide
  Seed: VVGARGVGK (KRAS G12R)
VLGARGVGY

SEQ ID NO: 10139 - protein, 10 aa, Artificial Sequence
  Description of Artificial Sequence: Synthetic peptide
  Seed: VVVGARGVGK (KRAS G12R)
VLVGARGVGF

SEQ ID NO: 10140 - protein, 10 aa, Artificial Sequence
  Description of Artificial Sequence: Synthetic peptide
  Seed: VVVGARGVGK (KRAS G12R)
VLVGARGVGL

SEQ ID NO: 10141 - protein, 10 aa, Artificial Sequence
  Description of Artificial Sequence: Synthetic peptide
  Seed: VVVGARGVGK (KRAS G12R)
VLVGARGVGM

SEQ ID NO: 10142 - protein, 10 aa, Artificial Sequence
  Description of Artificial Sequence: Synthetic peptide
  Seed: VVVGARGVGK (KRAS G12R)
VLVGARGVGR

SEQ ID NO: 10143 - protein, 10 aa, Artificial Sequence
  Description of Artificial Sequence: Synthetic peptide
  Seed: VVVGARGVGK (KRAS G12R)
VLVGARGVGY

SEQ ID NO: 10144 - protein, 9 aa, Artificial Sequence
  Description of Artificial Sequence: Synthetic peptide
  Seed: VVGARGVGK (KRAS G12R)
VMGARGVGF

SEQ ID NO: 10145 - protein, 9 aa, Artificial Sequence
  Description of Artificial Sequence: Synthetic peptide
  Seed: VVGARGVGK (KRAS G12R)
VMGARGVGL

SEQ ID NO: 10146 - protein, 9 aa, Artificial Sequence
  Description of Artificial Sequence: Synthetic peptide
  Seed: VVGARGVGK (KRAS G12R)
VMGARGVGM

SEQ ID NO: 10147 - protein, 9 aa, Artificial Sequence
  Description of Artificial Sequence: Synthetic peptide
  Seed: VVGARGVGK (KRAS G12R)
VMGARGVGR

SEQ ID NO: 10148 - protein, 9 aa, Artificial Sequence
  Description of Artificial Sequence: Synthetic peptide
  Seed: VVGARGVGK (KRAS G12R)
VMGARGVGY

SEQ ID NO: 10149 - protein, 10 aa, Artificial Sequence
  Description of Artificial Sequence: Synthetic peptide
  Seed: VVVGARGVGK (KRAS G12R)
VMVGARGVGF

SEQ ID NO: 10150 - protein, 10 aa, Artificial Sequence
  Description of Artificial Sequence: Synthetic peptide
  Seed: VVVGARGVGK (KRAS G12R)
VMVGARGVGH

SEQ ID NO: 10151 - protein, 10 aa, Artificial Sequence
  Description of Artificial Sequence: Synthetic peptide
  Seed: VVVGARGVGK (KRAS G12R)
VMVGARGVGL

SEQ ID NO: 10152 - protein, 10 aa, Artificial Sequence
  Description of Artificial Sequence: Synthetic peptide
  Seed: VVVGARGVGK (KRAS G12R)
VMVGARGVGM

SEQ ID NO: 10153 - protein, 10 aa, Artificial Sequence
  Description of Artificial Sequence: Synthetic peptide
  Seed: VVVGARGVGK (KRAS G12R)
VMVGARGVGY

SEQ ID NO: 10154 - protein, 9 aa, Artificial Sequence
  Description of Artificial Sequence: Synthetic peptide
  Seed: VVGARGVGK (KRAS G12R)
VNGARGVGK

SEQ ID NO: 10155 - protein, 9 aa, Artificial Sequence
  Description of Artificial Sequence: Synthetic peptide
  Seed: VVGARGVGK (KRAS G12R)
VNGARGVGR

SEQ ID NO: 10156 - protein, 10 aa, Artificial Sequence
  Description of Artificial Sequence: Synthetic peptide
  Seed: VVVGARGVGK (KRAS G12R)
VNVGARGVGF

SEQ ID NO: 10157 - protein, 10 aa, Artificial Sequence
  Description of Artificial Sequence: Synthetic peptide
  Seed: VVVGARGVGK (KRAS G12R)
VNVGARGVGK

SEQ ID NO: 10158 - protein, 10 aa, Artificial Sequence
  Description of Artificial Sequence: Synthetic peptide
  Seed: VVVGARGVGK (KRAS G12R)
VNVGARGVGR

SEQ ID NO: 10159 - protein, 10 aa, Artificial Sequence
  Description of Artificial Sequence: Synthetic peptide
  Seed: VVVGARGVGK (KRAS G12R)
VNVGARGVGY

SEQ ID NO: 10160 - protein, 9 aa, Artificial Sequence
  Description of Artificial Sequence: Synthetic peptide
  Seed: VVGARGVGK (KRAS G12R)
VPGARGVGK

SEQ ID NO: 10161 - protein, 9 aa, Artificial Sequence
  Description of Artificial Sequence: Synthetic peptide
  Seed: VVGARGVGK (KRAS G12R)
VPGARGVGR

SEQ ID NO: 10162 - protein, 10 aa, Artificial Sequence
  Description of Artificial Sequence: Synthetic peptide
  Seed: VVVGARGVGK (KRAS G12R)
VPVGARGVGK

SEQ ID NO: 10163 - protein, 10 aa, Artificial Sequence
  Description of Artificial Sequence: Synthetic peptide
  Seed: VVVGARGVGK (KRAS G12R)
VPVGARGVGL

SEQ ID NO: 10164 - protein, 10 aa, Artificial Sequence
  Description of Artificial Sequence: Synthetic peptide
  Seed: VVVGARGVGK (KRAS G12R)
VPVGARGVGM

SEQ ID NO: 10165 - protein, 10 aa, Artificial Sequence
  Description of Artificial Sequence: Synthetic peptide
  Seed: VVVGARGVGK (KRAS G12R)
VPVGARGVGR

SEQ ID NO: 10166 - protein, 10 aa, Artificial Sequence
  Description of Artificial Sequence: Synthetic peptide
  Seed: VVVGARGVGK (KRAS G12R)
VPVGARGVGY

SEQ ID NO: 10167 - protein, 9 aa, Artificial Sequence
  Description of Artificial Sequence: Synthetic peptide
  Seed: VVGARGVGK (KRAS G12R)
VQGARGVGK

SEQ ID NO: 10168 - protein, 9 aa, Artificial Sequence
  Description of Artificial Sequence: Synthetic peptide
  Seed: VVGARGVGK (KRAS G12R)
VQGARGVGR

SEQ ID NO: 10169 - protein, 10 aa, Artificial Sequence
  Description of Artificial Sequence: Synthetic peptide
  Seed: VVVGARGVGK (KRAS G12R)
VQVGARGVGF

SEQ ID NO: 10170 - protein, 10 aa, Artificial Sequence
  Description of Artificial Sequence: Synthetic peptide
  Seed: VVVGARGVGK (KRAS G12R)
VQVGARGVGH

SEQ ID NO: 10171 - protein, 10 aa, Artificial Sequence
  Description of Artificial Sequence: Synthetic peptide
  Seed: VVVGARGVGK (KRAS G12R)
VQVGARGVGL

SEQ ID NO: 10172 - protein, 10 aa, Artificial Sequence
  Description of Artificial Sequence: Synthetic peptide
  Seed: VVVGARGVGK (KRAS G12R)
VQVGARGVGM

SEQ ID NO: 10173 - protein, 10 aa, Artificial Sequence
  Description of Artificial Sequence: Synthetic peptide
  Seed: VVVGARGVGK (KRAS G12R)
VQVGARGVGR

SEQ ID NO: 10174 - protein, 10 aa, Artificial Sequence
  Description of Artificial Sequence: Synthetic peptide
  Seed: VVVGARGVGK (KRAS G12R)
VQVGARGVGY

SEQ ID NO: 10175 - protein, 8 aa, Artificial Sequence
  Description of Artificial Sequence: Synthetic peptide
  Seed: VGARGVGK (KRAS G12R)
VSARGVGK

SEQ ID NO: 10176 - protein, 8 aa, Artificial Sequence
  Description of Artificial Sequence: Synthetic peptide
  Seed: VGARGVGK (KRAS G12R)
VSARGVGL

SEQ ID NO: 10177 - protein, 9 aa, Artificial Sequence
  Description of Artificial Sequence: Synthetic peptide
  Seed: VVGARGVGK (KRAS G12R)
VSGARGVGF

SEQ ID NO: 10178 - protein, 9 aa, Artificial Sequence
  Description of Artificial Sequence: Synthetic peptide
  Seed: VVGARGVGK (KRAS G12R)
VSGARGVGI

SEQ ID NO: 10179 - protein, 9 aa, Artificial Sequence
  Description of Artificial Sequence: Synthetic peptide
  Seed: VVGARGVGK (KRAS G12R)
VSGARGVGL

SEQ ID NO: 10180 - protein, 9 aa, Artificial Sequence
  Description of Artificial Sequence: Synthetic peptide
  Seed: VVGARGVGK (KRAS G12R)
VSGARGVGM

SEQ ID NO: 10181 - protein, 9 aa, Artificial Sequence
  Description of Artificial Sequence: Synthetic peptide
  Seed: VVGARGVGK (KRAS G12R)
VSGARGVGR

SEQ ID NO: 10182 - protein, 9 aa, Artificial Sequence
  Description of Artificial Sequence: Synthetic peptide
  Seed: VVGARGVGK (KRAS G12R)
VSGARGVGV

SEQ ID NO: 10183 - protein, 9 aa, Artificial Sequence
  Description of Artificial Sequence: Synthetic peptide
  Seed: VVGARGVGK (KRAS G12R)
VSGARGVGW

SEQ ID NO: 10184 - protein, 9 aa, Artificial Sequence
  Description of Artificial Sequence: Synthetic peptide
  Seed: VVGARGVGK (KRAS G12R)
VSGARGVGY

SEQ ID NO: 10185 - protein, 10 aa, Artificial Sequence
  Description of Artificial Sequence: Synthetic peptide
  Seed: VVVGARGVGK (KRAS G12R)
VSVGARGVGF

SEQ ID NO: 10186 - protein, 10 aa, Artificial Sequence
  Description of Artificial Sequence: Synthetic peptide
  Seed: VVVGARGVGK (KRAS G12R)
VSVGARGVGH

SEQ ID NO: 10187 - protein, 10 aa, Artificial Sequence
  Description of Artificial Sequence: Synthetic peptide
  Seed: VVVGARGVGK (KRAS G12R)
VSVGARGVGI

SEQ ID NO: 10188 - protein, 10 aa, Artificial Sequence
  Description of Artificial Sequence: Synthetic peptide
  Seed: VVVGARGVGK (KRAS G12R)
VSVGARGVGL

SEQ ID NO: 10189 - protein, 10 aa, Artificial Sequence
  Description of Artificial Sequence: Synthetic peptide
  Seed: VVVGARGVGK (KRAS G12R)
VSVGARGVGM

SEQ ID NO: 10190 - protein, 10 aa, Artificial Sequence
  Description of Artificial Sequence: Synthetic peptide
  Seed: VVVGARGVGK (KRAS G12R)
VSVGARGVGV

SEQ ID NO: 10191 - protein, 10 aa, Artificial Sequence
  Description of Artificial Sequence: Synthetic peptide
  Seed: VVVGARGVGK (KRAS G12R)
VSVGARGVGW

SEQ ID NO: 10192 - protein, 10 aa, Artificial Sequence
  Description of Artificial Sequence: Synthetic peptide
  Seed: VVVGARGVGK (KRAS G12R)
VSVGARGVGY

SEQ ID NO: 10193 - protein, 8 aa, Artificial Sequence
  Description of Artificial Sequence: Synthetic peptide
  Seed: VGARGVGK (KRAS G12R)
VTARGVGL

SEQ ID NO: 10194 - protein, 9 aa, Artificial Sequence
  Description of Artificial Sequence: Synthetic peptide
  Seed: VVGARGVGK (KRAS G12R)
VTGARGVGF

SEQ ID NO: 10195 - protein, 9 aa, Artificial Sequence
  Description of Artificial Sequence: Synthetic peptide
  Seed: VVGARGVGK (KRAS G12R)
VTGARGVGH

SEQ ID NO: 10196 - protein, 9 aa, Artificial Sequence
  Description of Artificial Sequence: Synthetic peptide
  Seed: VVGARGVGK (KRAS G12R)
VTGARGVGI

SEQ ID NO: 10197 - protein, 9 aa, Artificial Sequence
  Description of Artificial Sequence: Synthetic peptide
  Seed: VVGARGVGK (KRAS G12R)
VTGARGVGL

SEQ ID NO: 10198 - protein, 9 aa, Artificial Sequence
  Description of Artificial Sequence: Synthetic peptide
  Seed: VVGARGVGK (KRAS G12R)
VTGARGVGM

SEQ ID NO: 10199 - protein, 9 aa, Artificial Sequence
  Description of Artificial Sequence: Synthetic peptide
  Seed: VVGARGVGK (KRAS G12R)
VTGARGVGR

SEQ ID NO: 10200 - protein, 9 aa, Artificial Sequence
  Description of Artificial Sequence: Synthetic peptide
  Seed: VVGARGVGK (KRAS G12R)
VTGARGVGV

SEQ ID NO: 10201 - protein, 9 aa, Artificial Sequence
  Description of Artificial Sequence: Synthetic peptide
  Seed: VVGARGVGK (KRAS G12R)
VTGARGVGY

SEQ ID NO: 10202 - protein, 10 aa, Artificial Sequence
  Description of Artificial Sequence: Synthetic peptide
  Seed: VVVGARGVGK (KRAS G12R)
VTVGARGVGF

SEQ ID NO: 10203 - protein, 10 aa, Artificial Sequence
  Description of Artificial Sequence: Synthetic peptide
  Seed: VVVGARGVGK (KRAS G12R)
VTVGARGVGH

SEQ ID NO: 10204 - protein, 10 aa, Artificial Sequence
  Description of Artificial Sequence: Synthetic peptide
  Seed: VVVGARGVGK (KRAS G12R)
VTVGARGVGI

SEQ ID NO: 10205 - protein, 10 aa, Artificial Sequence
  Description of Artificial Sequence: Synthetic peptide
  Seed: VVVGARGVGK (KRAS G12R)
VTVGARGVGL

SEQ ID NO: 10206 - protein, 10 aa, Artificial Sequence
  Description of Artificial Sequence: Synthetic peptide
  Seed: VVVGARGVGK (KRAS G12R)
VTVGARGVGM

SEQ ID NO: 10207 - protein, 10 aa, Artificial Sequence
  Description of Artificial Sequence: Synthetic peptide
  Seed: VVVGARGVGK (KRAS G12R)
VTVGARGVGW

SEQ ID NO: 10208 - protein, 10 aa, Artificial Sequence
  Description of Artificial Sequence: Synthetic peptide
  Seed: VVVGARGVGK (KRAS G12R)
VTVGARGVGY

SEQ ID NO: 10209 - protein, 8 aa, Artificial Sequence
  Description of Artificial Sequence: Synthetic peptide
  Seed: VGARGVGK (KRAS G12R)
VVARGVGK

SEQ ID NO: 10210 - protein, 8 aa, Artificial Sequence
  Description of Artificial Sequence: Synthetic peptide
  Seed: VGARGVGK (KRAS G12R)
VVARGVGR

SEQ ID NO: 10211 - protein, 9 aa, Artificial Sequence
  Description of Artificial Sequence: Synthetic peptide
  Seed: VVGARGVGK (KRAS G12R)
VVGARGVGF

SEQ ID NO: 10212 - protein, 9 aa, Artificial Sequence
  Description of Artificial Sequence: Synthetic peptide
  Seed: VVGARGVGK (KRAS G12R)
VVGARGVGL

SEQ ID NO: 10213 - protein, 9 aa, Artificial Sequence
  Description of Artificial Sequence: Synthetic peptide
  Seed: VVGARGVGK (KRAS G12R)
VVGARGVGM

SEQ ID NO: 10214 - protein, 9 aa, Artificial Sequence
  Description of Artificial Sequence: Synthetic peptide
  Seed: VVGARGVGK (KRAS G12R)
VVGARGVGY

SEQ ID NO: 10215 - protein, 10 aa, Artificial Sequence
  Description of Artificial Sequence: Synthetic peptide
  Seed: VVVGARGVGK (KRAS G12R)
VVVGARGVGF

SEQ ID NO: 10216 - protein, 10 aa, Artificial Sequence
  Description of Artificial Sequence: Synthetic peptide
  Seed: VVVGARGVGK (KRAS G12R)
VVVGARGVGH

SEQ ID NO: 10217 - protein, 10 aa, Artificial Sequence
  Description of Artificial Sequence: Synthetic peptide
  Seed: VVVGARGVGK (KRAS G12R)
VVVGARGVGL

SEQ ID NO: 10218 - protein, 10 aa, Artificial Sequence
  Description of Artificial Sequence: Synthetic peptide
  Seed: VVVGARGVGK (KRAS G12R)
VVVGARGVGM

SEQ ID NO: 10219 - protein, 10 aa, Artificial Sequence
  Description of Artificial Sequence: Synthetic peptide
  Seed: VVVGARGVGK (KRAS G12R)
VVVGARGVGY

SEQ ID NO: 10220 - protein, 9 aa, Artificial Sequence
  Description of Artificial Sequence: Synthetic peptide
  Seed: VVGARGVGK (KRAS G12R)
VWGARGVGR

SEQ ID NO: 10221 - protein, 10 aa, Artificial Sequence
  Description of Artificial Sequence: Synthetic peptide
  Seed: VVVGARGVGK (KRAS G12R)
VWVGARGVGK

SEQ ID NO: 10222 - protein, 10 aa, Artificial Sequence
  Description of Artificial Sequence: Synthetic peptide
  Seed: VVVGARGVGK (KRAS G12R)
VWVGARGVGR

SEQ ID NO: 10223 - protein, 9 aa, Artificial Sequence
  Description of Artificial Sequence: Synthetic peptide
  Seed: VVGARGVGK (KRAS G12R)
VYGARGVGK

SEQ ID NO: 10224 - protein, 9 aa, Artificial Sequence
  Description of Artificial Sequence: Synthetic peptide
  Seed: VVGARGVGK (KRAS G12R)
VYGARGVGR

SEQ ID NO: 10225 - protein, 9 aa, Artificial Sequence
  Description of Artificial Sequence: Synthetic peptide
  Seed: VVGARGVGK (KRAS G12R)
VYGARGVGY

SEQ ID NO: 10226 - protein, 10 aa, Artificial Sequence
  Description of Artificial Sequence: Synthetic peptide
  Seed: VVVGARGVGK (KRAS G12R)
VYVGARGVGK

SEQ ID NO: 10227 - protein, 10 aa, Artificial Sequence
  Description of Artificial Sequence: Synthetic peptide
  Seed: VVVGARGVGK (KRAS G12R)
VYVGARGVGR

SEQ ID NO: 10228 - protein, 10 aa, Artificial Sequence
  Description of Artificial Sequence: Synthetic peptide
  Seed: VVVGARGVGK (KRAS G12R)
VYVGARGVGY

SEQ ID NO: 10229 - protein, 10 aa, Homo sapiens
  Native (KRAS G12R)
GARGVGKSAL

SEQ ID NO: 10230 - protein, 10 aa, Homo sapiens
  Native (KRAS G12R)
KLVVVGARGV

SEQ ID NO: 10231 - protein, 9 aa, Homo sapiens
  Native (KRAS G12R)
LVVVGARGV

SEQ ID NO: 10232 - protein, 9 aa, Homo sapiens
  Native (KRAS G12R)
VVGARGVGK

SEQ ID NO: 10233 - protein, 9 aa, Homo sapiens
  Native (KRAS G12R)
GARGVGKSA

SEQ ID NO: 10234 - protein, 11 aa, Homo sapiens
  Native (KRAS G12R)
LVVVGARGVGK

SEQ ID NO: 10235 - protein, 10 aa, Homo sapiens
  Native (KRAS G12R)
RGVGKSALTI

SEQ ID NO: 10236 - protein, 8 aa, Homo sapiens
  Native (KRAS G12R)
VGARGVGK

SEQ ID NO: 10237 - protein, 10 aa, Artificial Sequence
  Description of Artificial Sequence: Synthetic peptide
  Seed: KLVVVGASGV (KRAS G12S)
KAVVVGASGV

SEQ ID NO: 10238 - protein, 10 aa, Artificial Sequence
  Description of Artificial Sequence: Synthetic peptide
  Seed: KLVVVGASGV (KRAS G12S)
KCVVVGASGV

SEQ ID NO: 10239 - protein, 10 aa, Artificial Sequence
  Description of Artificial Sequence: Synthetic peptide
  Seed: KLVVVGASGV (KRAS G12S)
KDVVVGASGV

SEQ ID NO: 10240 - protein, 10 aa, Artificial Sequence
  Description of Artificial Sequence: Synthetic peptide
  Seed: KLVVVGASGV (KRAS G12S)
KEVVVGASGV

SEQ ID NO: 10241 - protein, 10 aa, Artificial Sequence
  Description of Artificial Sequence: Synthetic peptide
  Seed: KLVVVGASGV (KRAS G12S)
KFVVVGASGV

SEQ ID NO: 10242 - protein, 10 aa, Artificial Sequence
  Description of Artificial Sequence: Synthetic peptide
  Seed: KLVVVGASGV (KRAS G12S)
KGVVVGASGV

SEQ ID NO: 10243 - protein, 10 aa, Artificial Sequence
  Description of Artificial Sequence: Synthetic peptide
  Seed: KLVVVGASGV (KRAS G12S)
KHVVVGASGV

SEQ ID NO: 10244 - protein, 10 aa, Artificial Sequence
  Description of Artificial Sequence: Synthetic peptide
  Seed: KLVVVGASGV (KRAS G12S)
KIVVVGASGV

SEQ ID NO: 10245 - protein, 10 aa, Artificial Sequence
  Description of Artificial Sequence: Synthetic peptide
  Seed: KLVVVGASGV (KRAS G12S)
KKVVVGASGV

SEQ ID NO: 10246 - protein, 10 aa, Artificial Sequence
  Description of Artificial Sequence: Synthetic peptide
  Seed: KLVVVGASGV (KRAS G12S)
KLVVVGASGA

SEQ ID NO: 10247 - protein, 10 aa, Artificial Sequence
  Description of Artificial Sequence: Synthetic peptide
  Seed: KLVVVGASGV (KRAS G12S)
KLVVVGASGI

SEQ ID NO: 10248 - protein, 10 aa, Artificial Sequence
  Description of Artificial Sequence: Synthetic peptide
  Seed: KLVVVGASGV (KRAS G12S)
KLVVVGASGL

SEQ ID NO: 10249 - protein, 10 aa, Artificial Sequence
  Description of Artificial Sequence: Synthetic peptide
  Seed: KLVVVGASGV (KRAS G12S)
KMVVVGASGA

SEQ ID NO: 10250 - protein, 10 aa, Artificial Sequence
  Description of Artificial Sequence: Synthetic peptide
  Seed: KLVVVGASGV (KRAS G12S)
KMVVVGASGI

SEQ ID NO: 10251 - protein, 10 aa, Artificial Sequence
  Description of Artificial Sequence: Synthetic peptide
  Seed: KLVVVGASGV (KRAS G12S)
KMVVVGASGL

SEQ ID NO: 10252 - protein, 10 aa, Artificial Sequence
  Description of Artificial Sequence: Synthetic peptide
  Seed: KLVVVGASGV (KRAS G12S)
KMVVVGASGM

SEQ ID NO: 10253 - protein, 10 aa, Artificial Sequence
  Description of Artificial Sequence: Synthetic peptide
  Seed: KLVVVGASGV (KRAS G12S)
KMVVVGASGV

SEQ ID NO: 10254 - protein, 10 aa, Artificial Sequence
  Description of Artificial Sequence: Synthetic peptide
  Seed: KLVVVGASGV (KRAS G12S)
KNVVVGASGV

SEQ ID NO: 10255 - protein, 10 aa, Artificial Sequence
  Description of Artificial Sequence: Synthetic peptide
  Seed: KLVVVGASGV (KRAS G12S)
KPVVVGASGV

SEQ ID NO: 10256 - protein, 10 aa, Artificial Sequence
  Description of Artificial Sequence: Synthetic peptide
  Seed: KLVVVGASGV (KRAS G12S)
KQVVVGASGI

SEQ ID NO: 10257 - protein, 10 aa, Artificial Sequence
  Description of Artificial Sequence: Synthetic peptide
  Seed: KLVVVGASGV (KRAS G12S)
KQVVVGASGL

SEQ ID NO: 10258 - protein, 10 aa, Artificial Sequence
  Description of Artificial Sequence: Synthetic peptide
  Seed: KLVVVGASGV (KRAS G12S)
KQVVVGASGV

SEQ ID NO: 10259 - protein, 10 aa, Artificial Sequence
  Description of Artificial Sequence: Synthetic peptide
  Seed: KLVVVGASGV (KRAS G12S)
KRVVVGASGV

SEQ ID NO: 10260 - protein, 10 aa, Artificial Sequence
  Description of Artificial Sequence: Synthetic peptide
  Seed: KLVVVGASGV (KRAS G12S)
KSVVVGASGV

SEQ ID NO: 10261 - protein, 10 aa, Artificial Sequence
  Description of Artificial Sequence: Synthetic peptide
  Seed: KLVVVGASGV (KRAS G12S)
KTVVVGASGV

SEQ ID NO: 10262 - protein, 10 aa, Artificial Sequence
  Description of Artificial Sequence: Synthetic peptide
  Seed: KLVVVGASGV (KRAS G12S)
KVVVVGASGV

SEQ ID NO: 10263 - protein, 10 aa, Artificial Sequence
  Description of Artificial Sequence: Synthetic peptide
  Seed: KLVVVGASGV (KRAS G12S)
KWVVVGASGV

SEQ ID NO: 10264 - protein, 10 aa, Artificial Sequence
  Description of Artificial Sequence: Synthetic peptide
  Seed: KLVVVGASGV (KRAS G12S)
KYVVVGASGV

SEQ ID NO: 10265 - protein, 9 aa, Artificial Sequence
  Description of Artificial Sequence: Synthetic peptide
  Seed: LVVVGASGV (KRAS G12S)
LAVVGASGV

SEQ ID NO: 10266 - protein, 9 aa, Artificial Sequence
  Description of Artificial Sequence: Synthetic peptide
  Seed: LVVVGASGV (KRAS G12S)
LIVVGASGA

SEQ ID NO: 10267 - protein, 9 aa, Artificial Sequence
  Description of Artificial Sequence: Synthetic peptide
  Seed: LVVVGASGV (KRAS G12S)
LIVVGASGI

SEQ ID NO: 10268 - protein, 9 aa, Artificial Sequence
  Description of Artificial Sequence: Synthetic peptide
  Seed: LVVVGASGV (KRAS G12S)
LIVVGASGL

SEQ ID NO: 10269 - protein, 9 aa, Artificial Sequence
  Description of Artificial Sequence: Synthetic peptide
  Seed: LVVVGASGV (KRAS G12S)
LIVVGASGV

SEQ ID NO: 10270 - protein, 9 aa, Artificial Sequence
  Description of Artificial Sequence: Synthetic peptide
  Seed: LVVVGASGV (KRAS G12S)
LLVVGASGA

SEQ ID NO: 10271 - protein, 9 aa, Artificial Sequence
  Description of Artificial Sequence: Synthetic peptide
  Seed: LVVVGASGV (KRAS G12S)
LLVVGASGI

SEQ ID NO: 10272 - protein, 9 aa, Artificial Sequence
  Description of Artificial Sequence: Synthetic peptide
  Seed: LVVVGASGV (KRAS G12S)
LLVVGASGL

SEQ ID NO: 10273 - protein, 9 aa, Artificial Sequence
  Description of Artificial Sequence: Synthetic peptide
  Seed: LVVVGASGV (KRAS G12S)
LLVVGASGM

SEQ ID NO: 10274 - protein, 9 aa, Artificial Sequence
  Description of Artificial Sequence: Synthetic peptide
  Seed: LVVVGASGV (KRAS G12S)
LLVVGASGT

SEQ ID NO: 10275 - protein, 9 aa, Artificial Sequence
  Description of Artificial Sequence: Synthetic peptide
  Seed: LVVVGASGV (KRAS G12S)
LLVVGASGV

SEQ ID NO: 10276 - protein, 9 aa, Artificial Sequence
  Description of Artificial Sequence: Synthetic peptide
  Seed: LVVVGASGV (KRAS G12S)
LMVVGASGA

SEQ ID NO: 10277 - protein, 9 aa, Artificial Sequence
  Description of Artificial Sequence: Synthetic peptide
  Seed: LVVVGASGV (KRAS G12S)
LMVVGASGI

SEQ ID NO: 10278 - protein, 9 aa, Artificial Sequence
  Description of Artificial Sequence: Synthetic peptide
  Seed: LVVVGASGV (KRAS G12S)
LMVVGASGL

SEQ ID NO: 10279 - protein, 9 aa, Artificial Sequence
  Description of Artificial Sequence: Synthetic peptide
  Seed: LVVVGASGV (KRAS G12S)
LMVVGASGM

SEQ ID NO: 10280 - protein, 9 aa, Artificial Sequence
  Description of Artificial Sequence: Synthetic peptide
  Seed: LVVVGASGV (KRAS G12S)
LMVVGASGT

SEQ ID NO: 10281 - protein, 9 aa, Artificial Sequence
  Description of Artificial Sequence: Synthetic peptide
  Seed: LVVVGASGV (KRAS G12S)
LQVVGASGI

SEQ ID NO: 10282 - protein, 9 aa, Artificial Sequence
  Description of Artificial Sequence: Synthetic peptide
  Seed: LVVVGASGV (KRAS G12S)
LQVVGASGL

SEQ ID NO: 10283 - protein, 9 aa, Artificial Sequence
  Description of Artificial Sequence: Synthetic peptide
  Seed: LVVVGASGV (KRAS G12S)
LQVVGASGM

SEQ ID NO: 10284 - protein, 9 aa, Artificial Sequence
  Description of Artificial Sequence: Synthetic peptide
  Seed: LVVVGASGV (KRAS G12S)
LSVVGASGV

SEQ ID NO: 10285 - protein, 9 aa, Artificial Sequence
  Description of Artificial Sequence: Synthetic peptide
  Seed: LVVVGASGV (KRAS G12S)
LTVVGASGA

SEQ ID NO: 10286 - protein, 9 aa, Artificial Sequence
  Description of Artificial Sequence: Synthetic peptide
  Seed: LVVVGASGV (KRAS G12S)
LTVVGASGI

SEQ ID NO: 10287 - protein, 9 aa, Artificial Sequence
  Description of Artificial Sequence: Synthetic peptide
  Seed: LVVVGASGV (KRAS G12S)
LTVVGASGL

SEQ ID NO: 10288 - protein, 9 aa, Artificial Sequence
  Description of Artificial Sequence: Synthetic peptide
  Seed: LVVVGASGV (KRAS G12S)
LVVVGASGI

SEQ ID NO: 10289 - protein, 9 aa, Artificial Sequence
  Description of Artificial Sequence: Synthetic peptide
  Seed: LVVVGASGV (KRAS G12S)
LVVVGASGL

SEQ ID NO: 10290 - protein, 9 aa, Artificial Sequence
  Description of Artificial Sequence: Synthetic peptide
  Seed: VVGASGVGK (KRAS G12S)
VAGASGVGK

SEQ ID NO: 10291 - protein, 10 aa, Artificial Sequence
  Description of Artificial Sequence: Synthetic peptide
  Seed: VVVGASGVGK (KRAS G12S)
VAVGASGVGK

SEQ ID NO: 10292 - protein, 10 aa, Artificial Sequence
  Description of Artificial Sequence: Synthetic peptide
  Seed: VVVGASGVGK (KRAS G12S)
VAVGASGVGR

SEQ ID NO: 10293 - protein, 10 aa, Artificial Sequence
  Description of Artificial Sequence: Synthetic peptide
  Seed: VVVGASGVGK (KRAS G12S)
VCVGASGVGK

SEQ ID NO: 10294 - protein, 10 aa, Artificial Sequence
  Description of Artificial Sequence: Synthetic peptide
  Seed: VVVGASGVGK (KRAS G12S)
VDVGASGVGK

SEQ ID NO: 10295 - protein, 10 aa, Artificial Sequence
  Description of Artificial Sequence: Synthetic peptide
  Seed: VVVGASGVGK (KRAS G12S)
VDVGASGVGR

SEQ ID NO: 10296 - protein, 10 aa, Artificial Sequence
  Description of Artificial Sequence: Synthetic peptide
  Seed: VVVGASGVGK (KRAS G12S)
VEVGASGVGK

SEQ ID NO: 10297 - protein, 10 aa, Artificial Sequence
  Description of Artificial Sequence: Synthetic peptide
  Seed: VVVGASGVGK (KRAS G12S)
VEVGASGVGR

SEQ ID NO: 10298 - protein, 10 aa, Artificial Sequence
  Description of Artificial Sequence: Synthetic peptide
  Seed: VVVGASGVGK (KRAS G12S)
VFVGASGVGK

SEQ ID NO: 10299 - protein, 10 aa, Artificial Sequence
  Description of Artificial Sequence: Synthetic peptide
  Seed: VVVGASGVGK (KRAS G12S)
VFVGASGVGR

SEQ ID NO: 10300 - protein, 10 aa, Artificial Sequence
  Description of Artificial Sequence: Synthetic peptide
  Seed: VVVGASGVGK (KRAS G12S)
VGVGASGVGK

SEQ ID NO: 10301 - protein, 10 aa, Artificial Sequence
  Description of Artificial Sequence: Synthetic peptide
  Seed: VVVGASGVGK (KRAS G12S)
VHVGASGVGK

SEQ ID NO: 10302 - protein, 10 aa, Artificial Sequence
  Description of Artificial Sequence: Synthetic peptide
  Seed: VVVGASGVGK (KRAS G12S)
VHVGASGVGR

SEQ ID NO: 10303 - protein, 9 aa, Artificial Sequence
  Description of Artificial Sequence: Synthetic peptide
  Seed: VVGASGVGK (KRAS G12S)
VIGASGVGK

SEQ ID NO: 10304 - protein, 10 aa, Artificial Sequence
  Description of Artificial Sequence: Synthetic peptide
  Seed: VVVGASGVGK (KRAS G12S)
VIVGASGVGK

SEQ ID NO: 10305 - protein, 10 aa, Artificial Sequence
  Description of Artificial Sequence: Synthetic peptide
  Seed: VVVGASGVGK (KRAS G12S)
VIVGASGVGR

SEQ ID NO: 10306 - protein, 10 aa, Artificial Sequence
  Description of Artificial Sequence: Synthetic peptide
  Seed: VVVGASGVGK (KRAS G12S)
VKVGASGVGK

SEQ ID NO: 10307 - protein, 9 aa, Artificial Sequence
  Description of Artificial Sequence: Synthetic peptide
  Seed: VVGASGVGK (KRAS G12S)
VLGASGVGK

SEQ ID NO: 10308 - protein, 9 aa, Artificial Sequence
  Description of Artificial Sequence: Synthetic peptide
  Seed: VVGASGVGK (KRAS G12S)
VLGASGVGR

SEQ ID NO: 10309 - protein, 10 aa, Artificial Sequence
  Description of Artificial Sequence: Synthetic peptide
  Seed: VVVGASGVGK (KRAS G12S)
VLVGASGVGK

SEQ ID NO: 10310 - protein, 10 aa, Artificial Sequence
  Description of Artificial Sequence: Synthetic peptide
  Seed: VVVGASGVGK (KRAS G12S)
VLVGASGVGR

SEQ ID NO: 10311 - protein, 9 aa, Artificial Sequence
  Description of Artificial Sequence: Synthetic peptide
  Seed: VVGASGVGK (KRAS G12S)
VMGASGVGK

SEQ ID NO: 10312 - protein, 9 aa, Artificial Sequence
  Description of Artificial Sequence: Synthetic peptide
  Seed: VVGASGVGK (KRAS G12S)
VMGASGVGR

SEQ ID NO: 10313 - protein, 10 aa, Artificial Sequence
  Description of Artificial Sequence: Synthetic peptide
  Seed: VVVGASGVGK (KRAS G12S)
VMVGASGVGK

SEQ ID NO: 10314 - protein, 10 aa, Artificial Sequence
  Description of Artificial Sequence: Synthetic peptide
  Seed: VVVGASGVGK (KRAS G12S)
VMVGASGVGR

SEQ ID NO: 10315 - protein, 10 aa, Artificial Sequence
  Description of Artificial Sequence: Synthetic peptide
  Seed: VVVGASGVGK (KRAS G12S)
VNVGASGVGK

SEQ ID NO: 10316 - protein, 10 aa, Artificial Sequence
  Description of Artificial Sequence: Synthetic peptide
  Seed: VVVGASGVGK (KRAS G12S)
VNVGASGVGR

SEQ ID NO: 10317 - protein, 10 aa, Artificial Sequence
  Description of Artificial Sequence: Synthetic peptide
  Seed: VVVGASGVGK (KRAS G12S)
VPVGASGVGK

SEQ ID NO: 10318 - protein, 10 aa, Artificial Sequence
  Description of Artificial Sequence: Synthetic peptide
  Seed: VVVGASGVGK (KRAS G12S)
VPVGASGVGR

SEQ ID NO: 10319 - protein, 9 aa, Artificial Sequence
  Description of Artificial Sequence: Synthetic peptide
  Seed: VVGASGVGK (KRAS G12S)
VQGASGVGK

SEQ ID NO: 10320 - protein, 10 aa, Artificial Sequence
  Description of Artificial Sequence: Synthetic peptide
  Seed: VVVGASGVGK (KRAS G12S)
VQVGASGVGK

SEQ ID NO: 10321 - protein, 10 aa, Artificial Sequence
  Description of Artificial Sequence: Synthetic peptide
  Seed: VVVGASGVGK (KRAS G12S)
VRVGASGVGK

SEQ ID NO: 10322 - protein, 9 aa, Artificial Sequence
  Description of Artificial Sequence: Synthetic peptide
  Seed: VVGASGVGK (KRAS G12S)
VSGASGVGK

SEQ ID NO: 10323 - protein, 10 aa, Artificial Sequence
  Description of Artificial Sequence: Synthetic peptide
  Seed: VVVGASGVGK (KRAS G12S)
VSVGASGVGK

SEQ ID NO: 10324 - protein, 10 aa, Artificial Sequence
  Description of Artificial Sequence: Synthetic peptide
  Seed: VVVGASGVGK (KRAS G12S)
VSVGASGVGR

SEQ ID NO: 10325 - protein, 9 aa, Artificial Sequence
  Description of Artificial Sequence: Synthetic peptide
  Seed: VVGASGVGK (KRAS G12S)
VTGASGVGK

SEQ ID NO: 10326 - protein, 9 aa, Artificial Sequence
  Description of Artificial Sequence: Synthetic peptide
  Seed: VVGASGVGK (KRAS G12S)
VVGASGVGR

SEQ ID NO: 10327 - protein, 10 aa, Artificial Sequence
  Description of Artificial Sequence: Synthetic peptide
  Seed: VVVGASGVGK (KRAS G12S)
VWVGASGVGK

SEQ ID NO: 10328 - protein, 10 aa, Artificial Sequence
  Description of Artificial Sequence: Synthetic peptide
  Seed: VVVGASGVGK (KRAS G12S)
VWVGASGVGR

SEQ ID NO: 10329 - protein, 10 aa, Artificial Sequence
  Description of Artificial Sequence: Synthetic peptide
  Seed: VVVGASGVGK (KRAS G12S)
VYVGASGVGK

SEQ ID NO: 10330 - protein, 10 aa, Artificial Sequence
  Description of Artificial Sequence: Synthetic peptide
  Seed: VVVGASGVGK (KRAS G12S)
VYVGASGVGR

SEQ ID NO: 10331 - protein, 10 aa, Artificial Sequence
  Description of Artificial Sequence: Synthetic peptide
  Seed: GASGVGKSAL (KRAS G12S)
GASGVGKSAA

SEQ ID NO: 10332 - protein, 10 aa, Artificial Sequence
  Description of Artificial Sequence: Synthetic peptide
  Seed: GASGVGKSAL (KRAS G12S)
GASGVGKSAF

SEQ ID NO: 10333 - protein, 10 aa, Artificial Sequence
  Description of Artificial Sequence: Synthetic peptide
  Seed: GASGVGKSAL (KRAS G12S)
GASGVGKSAH

SEQ ID NO: 10334 - protein, 10 aa, Artificial Sequence
  Description of Artificial Sequence: Synthetic peptide
  Seed: GASGVGKSAL (KRAS G12S)
GASGVGKSAI

SEQ ID NO: 10335 - protein, 10 aa, Artificial Sequence
  Description of Artificial Sequence: Synthetic peptide
  Seed: GASGVGKSAL (KRAS G12S)
GASGVGKSAK

SEQ ID NO: 10336 - protein, 10 aa, Artificial Sequence
  Description of Artificial Sequence: Synthetic peptide
  Seed: GASGVGKSAL (KRAS G12S)
GASGVGKSAM

SEQ ID NO: 10337 - protein, 10 aa, Artificial Sequence
  Description of Artificial Sequence: Synthetic peptide
  Seed: GASGVGKSAL (KRAS G12S)
GASGVGKSAR

SEQ ID NO: 10338 - protein, 10 aa, Artificial Sequence
  Description of Artificial Sequence: Synthetic peptide
  Seed: GASGVGKSAL (KRAS G12S)
GASGVGKSAV

SEQ ID NO: 10339 - protein, 10 aa, Artificial Sequence
  Description of Artificial Sequence: Synthetic peptide
  Seed: GASGVGKSAL (KRAS G12S)
GASGVGKSAW

SEQ ID NO: 10340 - protein, 10 aa, Artificial Sequence
  Description of Artificial Sequence: Synthetic peptide
  Seed: GASGVGKSAL (KRAS G12S)
GASGVGKSAY

SEQ ID NO: 10341 - protein, 9 aa, Artificial Sequence
  Description of Artificial Sequence: Synthetic peptide
  Seed: GASGVGKSA (KRAS G12S)
GASGVGKSC

SEQ ID NO: 10342 - protein, 9 aa, Artificial Sequence
  Description of Artificial Sequence: Synthetic peptide
  Seed: GASGVGKSA (KRAS G12S)
GASGVGKSF

SEQ ID NO: 10343 - protein, 9 aa, Artificial Sequence
  Description of Artificial Sequence: Synthetic peptide
  Seed: GASGVGKSA (KRAS G12S)
GASGVGKSH

SEQ ID NO: 10344 - protein, 9 aa, Artificial Sequence
  Description of Artificial Sequence: Synthetic peptide
  Seed: GASGVGKSA (KRAS G12S)
GASGVGKSI

SEQ ID NO: 10345 - protein, 9 aa, Artificial Sequence
  Description of Artificial Sequence: Synthetic peptide
  Seed: GASGVGKSA (KRAS G12S)
GASGVGKSK

SEQ ID NO: 10346 - protein, 9 aa, Artificial Sequence
  Description of Artificial Sequence: Synthetic peptide
  Seed: GASGVGKSA (KRAS G12S)
GASGVGKSM

SEQ ID NO: 10347 - protein, 9 aa, Artificial Sequence
  Description of Artificial Sequence: Synthetic peptide
  Seed: GASGVGKSA (KRAS G12S)
GASGVGKSP

SEQ ID NO: 10348 - protein, 9 aa, Artificial Sequence
  Description of Artificial Sequence: Synthetic peptide
  Seed: GASGVGKSA (KRAS G12S)
GASGVGKSQ

SEQ ID NO: 10349 - protein, 9 aa, Artificial Sequence
  Description of Artificial Sequence: Synthetic peptide
  Seed: GASGVGKSA (KRAS G12S)
GASGVGKSR

SEQ ID NO: 10350 - protein, 9 aa, Artificial Sequence
  Description of Artificial Sequence: Synthetic peptide
  Seed: GASGVGKSA (KRAS G12S)
GASGVGKSS

SEQ ID NO: 10351 - protein, 9 aa, Artificial Sequence
  Description of Artificial Sequence: Synthetic peptide
  Seed: GASGVGKSA (KRAS G12S)
GASGVGKST

SEQ ID NO: 10352 - protein, 9 aa, Artificial Sequence
  Description of Artificial Sequence: Synthetic peptide
  Seed: GASGVGKSA (KRAS G12S)
GASGVGKSV

SEQ ID NO: 10353 - protein, 9 aa, Artificial Sequence
  Description of Artificial Sequence: Synthetic peptide
  Seed: GASGVGKSA (KRAS G12S)
GASGVGKSW

SEQ ID NO: 10354 - protein, 9 aa, Artificial Sequence
  Description of Artificial Sequence: Synthetic peptide
  Seed: GASGVGKSA (KRAS G12S)
GASGVGKSY

SEQ ID NO: 10355 - protein, 10 aa, Artificial Sequence
  Description of Artificial Sequence: Synthetic peptide
  Seed: GASGVGKSAL (KRAS G12S)
GCSGVGKSAF

SEQ ID NO: 10356 - protein, 10 aa, Artificial Sequence
  Description of Artificial Sequence: Synthetic peptide
  Seed: GASGVGKSAL (KRAS G12S)
GCSGVGKSAK

SEQ ID NO: 10357 - protein, 10 aa, Artificial Sequence
  Description of Artificial Sequence: Synthetic peptide
  Seed: GASGVGKSAL (KRAS G12S)
GCSGVGKSAR

SEQ ID NO: 10358 - protein, 10 aa, Artificial Sequence
  Description of Artificial Sequence: Synthetic peptide
  Seed: GASGVGKSAL (KRAS G12S)
GCSGVGKSAY

SEQ ID NO: 10359 - protein, 9 aa, Artificial Sequence
  Description of Artificial Sequence: Synthetic peptide
  Seed: GASGVGKSA (KRAS G12S)
GCSGVGKSF

SEQ ID NO: 10360 - protein, 9 aa, Artificial Sequence
  Description of Artificial Sequence: Synthetic peptide
  Seed: GASGVGKSA (KRAS G12S)
GCSGVGKSK

SEQ ID NO: 10361 - protein, 9 aa, Artificial Sequence
  Description of Artificial Sequence: Synthetic peptide
  Seed: GASGVGKSA (KRAS G12S)
GCSGVGKSL

SEQ ID NO: 10362 - protein, 9 aa, Artificial Sequence
  Description of Artificial Sequence: Synthetic peptide
  Seed: GASGVGKSA (KRAS G12S)
GCSGVGKSM

SEQ ID NO: 10363 - protein, 9 aa, Artificial Sequence
  Description of Artificial Sequence: Synthetic peptide
  Seed: GASGVGKSA (KRAS G12S)
GCSGVGKSR

SEQ ID NO: 10364 - protein, 9 aa, Artificial Sequence
  Description of Artificial Sequence: Synthetic peptide
  Seed: GASGVGKSA (KRAS G12S)
GCSGVGKSY

SEQ ID NO: 10365 - protein, 10 aa, Artificial Sequence
  Description of Artificial Sequence: Synthetic peptide
  Seed: GASGVGKSAL (KRAS G12S)
GDSGVGKSAK

SEQ ID NO: 10366 - protein, 10 aa, Artificial Sequence
  Description of Artificial Sequence: Synthetic peptide
  Seed: GASGVGKSAL (KRAS G12S)
GDSGVGKSAR

SEQ ID NO: 10367 - protein, 9 aa, Artificial Sequence
  Description of Artificial Sequence: Synthetic peptide
  Seed: GASGVGKSA (KRAS G12S)
GDSGVGKSF

SEQ ID NO: 10368 - protein, 9 aa, Artificial Sequence
  Description of Artificial Sequence: Synthetic peptide
  Seed: GASGVGKSA (KRAS G12S)
GDSGVGKSK

SEQ ID NO: 10369 - protein, 9 aa, Artificial Sequence
  Description of Artificial Sequence: Synthetic peptide
  Seed: GASGVGKSA (KRAS G12S)
GDSGVGKSR

SEQ ID NO: 10370 - protein, 9 aa, Artificial Sequence
  Description of Artificial Sequence: Synthetic peptide
  Seed: GASGVGKSA (KRAS G12S)
GDSGVGKSY

SEQ ID NO: 10371 - protein, 10 aa, Artificial Sequence
  Description of Artificial Sequence: Synthetic peptide
  Seed: GASGVGKSAL (KRAS G12S)
GESGVGKSAF

SEQ ID NO: 10372 - protein, 10 aa, Artificial Sequence
  Description of Artificial Sequence: Synthetic peptide
  Seed: GASGVGKSAL (KRAS G12S)
GESGVGKSAK

SEQ ID NO: 10373 - protein, 10 aa, Artificial Sequence
  Description of Artificial Sequence: Synthetic peptide
  Seed: GASGVGKSAL (KRAS G12S)
GESGVGKSAL

SEQ ID NO: 10374 - protein, 10 aa, Artificial Sequence
  Description of Artificial Sequence: Synthetic peptide
  Seed: GASGVGKSAL (KRAS G12S)
GESGVGKSAR

SEQ ID NO: 10375 - protein, 10 aa, Artificial Sequence
  Description of Artificial Sequence: Synthetic peptide
  Seed: GASGVGKSAL (KRAS G12S)
GESGVGKSAY

SEQ ID NO: 10376 - protein, 9 aa, Artificial Sequence
  Description of Artificial Sequence: Synthetic peptide
  Seed: GASGVGKSA (KRAS G12S)
GESGVGKSF

SEQ ID NO: 10377 - protein, 9 aa, Artificial Sequence
  Description of Artificial Sequence: Synthetic peptide
  Seed: GASGVGKSA (KRAS G12S)
GESGVGKSK

SEQ ID NO: 10378 - protein, 9 aa, Artificial Sequence
  Description of Artificial Sequence: Synthetic peptide
  Seed: GASGVGKSA (KRAS G12S)
GESGVGKSL

SEQ ID NO: 10379 - protein, 9 aa, Artificial Sequence
  Description of Artificial Sequence: Synthetic peptide
  Seed: GASGVGKSA (KRAS G12S)
GESGVGKSM

SEQ ID NO: 10380 - protein, 9 aa, Artificial Sequence
  Description of Artificial Sequence: Synthetic peptide
  Seed: GASGVGKSA (KRAS G12S)
GESGVGKSR

SEQ ID NO: 10381 - protein, 9 aa, Artificial Sequence
  Description of Artificial Sequence: Synthetic peptide
  Seed: GASGVGKSA (KRAS G12S)
GESGVGKSY

SEQ ID NO: 10382 - protein, 10 aa, Artificial Sequence
  Description of Artificial Sequence: Synthetic peptide
  Seed: GASGVGKSAL (KRAS G12S)
GFSGVGKSAF

SEQ ID NO: 10383 - protein, 10 aa, Artificial Sequence
  Description of Artificial Sequence: Synthetic peptide
  Seed: GASGVGKSAL (KRAS G12S)
GFSGVGKSAK

SEQ ID NO: 10384 - protein, 10 aa, Artificial Sequence
  Description of Artificial Sequence: Synthetic peptide
  Seed: GASGVGKSAL (KRAS G12S)
GFSGVGKSAL

SEQ ID NO: 10385 - protein, 10 aa, Artificial Sequence
  Description of Artificial Sequence: Synthetic peptide
  Seed: GASGVGKSAL (KRAS G12S)
GFSGVGKSAY

SEQ ID NO: 10386 - protein, 9 aa, Artificial Sequence
  Description of Artificial Sequence: Synthetic peptide
  Seed: GASGVGKSA (KRAS G12S)
GFSGVGKSF

SEQ ID NO: 10387 - protein, 9 aa, Artificial Sequence
  Description of Artificial Sequence: Synthetic peptide
  Seed: GASGVGKSA (KRAS G12S)
GFSGVGKSK

SEQ ID NO: 10388 - protein, 9 aa, Artificial Sequence
  Description of Artificial Sequence: Synthetic peptide
  Seed: GASGVGKSA (KRAS G12S)
GFSGVGKSL

SEQ ID NO: 10389 - protein, 9 aa, Artificial Sequence
  Description of Artificial Sequence: Synthetic peptide
  Seed: GASGVGKSA (KRAS G12S)
GFSGVGKSM

SEQ ID NO: 10390 - protein, 9 aa, Artificial Sequence
  Description of Artificial Sequence: Synthetic peptide
  Seed: GASGVGKSA (KRAS G12S)
GFSGVGKSR

SEQ ID NO: 10391 - protein, 9 aa, Artificial Sequence
  Description of Artificial Sequence: Synthetic peptide
  Seed: GASGVGKSA (KRAS G12S)
GFSGVGKSY

SEQ ID NO: 10392 - protein, 10 aa, Artificial Sequence
  Description of Artificial Sequence: Synthetic peptide
  Seed: GASGVGKSAL (KRAS G12S)
GGSGVGKSAF

SEQ ID NO: 10393 - protein, 10 aa, Artificial Sequence
  Description of Artificial Sequence: Synthetic peptide
  Seed: GASGVGKSAL (KRAS G12S)
GGSGVGKSAK

SEQ ID NO: 10394 - protein, 10 aa, Artificial Sequence
  Description of Artificial Sequence: Synthetic peptide
  Seed: GASGVGKSAL (KRAS G12S)
GGSGVGKSAL

SEQ ID NO: 10395 - protein, 10 aa, Artificial Sequence
  Description of Artificial Sequence: Synthetic peptide
  Seed: GASGVGKSAL (KRAS G12S)
GGSGVGKSAM

SEQ ID NO: 10396 - protein, 10 aa, Artificial Sequence
  Description of Artificial Sequence: Synthetic peptide
  Seed: GASGVGKSAL (KRAS G12S)
GGSGVGKSAR

SEQ ID NO: 10397 - protein, 10 aa, Artificial Sequence
  Description of Artificial Sequence: Synthetic peptide
  Seed: GASGVGKSAL (KRAS G12S)
GGSGVGKSAY

SEQ ID NO: 10398 - protein, 9 aa, Artificial Sequence
  Description of Artificial Sequence: Synthetic peptide
  Seed: GASGVGKSA (KRAS G12S)
GGSGVGKSF

SEQ ID NO: 10399 - protein, 9 aa, Artificial Sequence
  Description of Artificial Sequence: Synthetic peptide
  Seed: GASGVGKSA (KRAS G12S)
GGSGVGKSH

SEQ ID NO: 10400 - protein, 9 aa, Artificial Sequence
  Description of Artificial Sequence: Synthetic peptide
  Seed: GASGVGKSA (KRAS G12S)
GGSGVGKSI

SEQ ID NO: 10401 - protein, 9 aa, Artificial Sequence
  Description of Artificial Sequence: Synthetic peptide
  Seed: GASGVGKSA (KRAS G12S)
GGSGVGKSK

SEQ ID NO: 10402 - protein, 9 aa, Artificial Sequence
  Description of Artificial Sequence: Synthetic peptide
  Seed: GASGVGKSA (KRAS G12S)
GGSGVGKSL

SEQ ID NO: 10403 - protein, 9 aa, Artificial Sequence
  Description of Artificial Sequence: Synthetic peptide
  Seed: GASGVGKSA (KRAS G12S)
GGSGVGKSM

SEQ ID NO: 10404 - protein, 9 aa, Artificial Sequence
  Description of Artificial Sequence: Synthetic peptide
  Seed: GASGVGKSA (KRAS G12S)
GGSGVGKSR

SEQ ID NO: 10405 - protein, 9 aa, Artificial Sequence
  Description of Artificial Sequence: Synthetic peptide
  Seed: GASGVGKSA (KRAS G12S)
GGSGVGKSV

SEQ ID NO: 10406 - protein, 9 aa, Artificial Sequence
  Description of Artificial Sequence: Synthetic peptide
  Seed: GASGVGKSA (KRAS G12S)
GGSGVGKSY

SEQ ID NO: 10407 - protein, 10 aa, Artificial Sequence
  Description of Artificial Sequence: Synthetic peptide
  Seed: GASGVGKSAL (KRAS G12S)
GHSGVGKSAF

SEQ ID NO: 10408 - protein, 10 aa, Artificial Sequence
  Description of Artificial Sequence: Synthetic peptide
  Seed: GASGVGKSAL (KRAS G12S)
GHSGVGKSAL

SEQ ID NO: 10409 - protein, 10 aa, Artificial Sequence
  Description of Artificial Sequence: Synthetic peptide
  Seed: GASGVGKSAL (KRAS G12S)
GHSGVGKSAM

SEQ ID NO: 10410 - protein, 10 aa, Artificial Sequence
  Description of Artificial Sequence: Synthetic peptide
  Seed: GASGVGKSAL (KRAS G12S)
GHSGVGKSAY

SEQ ID NO: 10411 - protein, 9 aa, Artificial Sequence
  Description of Artificial Sequence: Synthetic peptide
  Seed: GASGVGKSA (KRAS G12S)
GISGVGKSA

SEQ ID NO: 10412 - protein, 10 aa, Artificial Sequence
  Description of Artificial Sequence: Synthetic peptide
  Seed: GASGVGKSAL (KRAS G12S)
GISGVGKSAF

SEQ ID NO: 10413 - protein, 10 aa, Artificial Sequence
  Description of Artificial Sequence: Synthetic peptide
  Seed: GASGVGKSAL (KRAS G12S)
GISGVGKSAH

SEQ ID NO: 10414 - protein, 10 aa, Artificial Sequence
  Description of Artificial Sequence: Synthetic peptide
  Seed: GASGVGKSAL (KRAS G12S)
GISGVGKSAK

SEQ ID NO: 10415 - protein, 10 aa, Artificial Sequence
  Description of Artificial Sequence: Synthetic peptide
  Seed: GASGVGKSAL (KRAS G12S)
GISGVGKSAL

SEQ ID NO: 10416 - protein, 10 aa, Artificial Sequence
  Description of Artificial Sequence: Synthetic peptide
  Seed: GASGVGKSAL (KRAS G12S)
GISGVGKSAM

SEQ ID NO: 10417 - protein, 10 aa, Artificial Sequence
  Description of Artificial Sequence: Synthetic peptide
  Seed: GASGVGKSAL (KRAS G12S)
GISGVGKSAR

SEQ ID NO: 10418 - protein, 10 aa, Artificial Sequence
  Description of Artificial Sequence: Synthetic peptide
  Seed: GASGVGKSAL (KRAS G12S)
GISGVGKSAW

SEQ ID NO: 10419 - protein, 10 aa, Artificial Sequence
  Description of Artificial Sequence: Synthetic peptide
  Seed: GASGVGKSAL (KRAS G12S)
GISGVGKSAY

SEQ ID NO: 10420 - protein, 9 aa, Artificial Sequence
  Description of Artificial Sequence: Synthetic peptide
  Seed: GASGVGKSA (KRAS G12S)
GISGVGKSF

SEQ ID NO: 10421 - protein, 9 aa, Artificial Sequence
  Description of Artificial Sequence: Synthetic peptide
  Seed: GASGVGKSA (KRAS G12S)
GISGVGKSH

SEQ ID NO: 10422 - protein, 9 aa, Artificial Sequence
  Description of Artificial Sequence: Synthetic peptide
  Seed: GASGVGKSA (KRAS G12S)
GISGVGKSI

SEQ ID NO: 10423 - protein, 9 aa, Artificial Sequence
  Description of Artificial Sequence: Synthetic peptide
  Seed: GASGVGKSA (KRAS G12S)
GISGVGKSK

SEQ ID NO: 10424 - protein, 9 aa, Artificial Sequence
  Description of Artificial Sequence: Synthetic peptide
  Seed: GASGVGKSA (KRAS G12S)
GISGVGKSL

SEQ ID NO: 10425 - protein, 9 aa, Artificial Sequence
  Description of Artificial Sequence: Synthetic peptide
  Seed: GASGVGKSA (KRAS G12S)
GISGVGKSM

SEQ ID NO: 10426 - protein, 9 aa, Artificial Sequence
  Description of Artificial Sequence: Synthetic peptide
  Seed: GASGVGKSA (KRAS G12S)
GISGVGKSR

SEQ ID NO: 10427 - protein, 9 aa, Artificial Sequence
  Description of Artificial Sequence: Synthetic peptide
  Seed: GASGVGKSA (KRAS G12S)
GISGVGKSV

SEQ ID NO: 10428 - protein, 9 aa, Artificial Sequence
  Description of Artificial Sequence: Synthetic peptide
  Seed: GASGVGKSA (KRAS G12S)
GISGVGKSW

SEQ ID NO: 10429 - protein, 9 aa, Artificial Sequence
  Description of Artificial Sequence: Synthetic peptide
  Seed: GASGVGKSA (KRAS G12S)
GISGVGKSY

SEQ ID NO: 10430 - protein, 10 aa, Artificial Sequence
  Description of Artificial Sequence: Synthetic peptide
  Seed: GASGVGKSAL (KRAS G12S)
GKSGVGKSAF

SEQ ID NO: 10431 - protein, 10 aa, Artificial Sequence
  Description of Artificial Sequence: Synthetic peptide
  Seed: GASGVGKSAL (KRAS G12S)
GKSGVGKSAY

SEQ ID NO: 10432 - protein, 10 aa, Artificial Sequence
  Description of Artificial Sequence: Synthetic peptide
  Seed: GASGVGKSAL (KRAS G12S)
GLSGVGKSAF

SEQ ID NO: 10433 - protein, 10 aa, Artificial Sequence
  Description of Artificial Sequence: Synthetic peptide
  Seed: GASGVGKSAL (KRAS G12S)
GLSGVGKSAK

SEQ ID NO: 10434 - protein, 10 aa, Artificial Sequence
  Description of Artificial Sequence: Synthetic peptide
  Seed: GASGVGKSAL (KRAS G12S)
GLSGVGKSAL

SEQ ID NO: 10435 - protein, 10 aa, Artificial Sequence
  Description of Artificial Sequence: Synthetic peptide
  Seed: GASGVGKSAL (KRAS G12S)
GLSGVGKSAM

SEQ ID NO: 10436 - protein, 10 aa, Artificial Sequence
  Description of Artificial Sequence: Synthetic peptide
  Seed: GASGVGKSAL (KRAS G12S)
GLSGVGKSAR

SEQ ID NO: 10437 - protein, 10 aa, Artificial Sequence
  Description of Artificial Sequence: Synthetic peptide
  Seed: GASGVGKSAL (KRAS G12S)
GLSGVGKSAW

SEQ ID NO: 10438 - protein, 10 aa, Artificial Sequence
  Description of Artificial Sequence: Synthetic peptide
  Seed: GASGVGKSAL (KRAS G12S)
GLSGVGKSAY

SEQ ID NO: 10439 - protein, 9 aa, Artificial Sequence
  Description of Artificial Sequence: Synthetic peptide
  Seed: GASGVGKSA (KRAS G12S)
GLSGVGKSF

SEQ ID NO: 10440 - protein, 9 aa, Artificial Sequence
  Description of Artificial Sequence: Synthetic peptide
  Seed: GASGVGKSA (KRAS G12S)
GLSGVGKSH

SEQ ID NO: 10441 - protein, 9 aa, Artificial Sequence
  Description of Artificial Sequence: Synthetic peptide
  Seed: GASGVGKSA (KRAS G12S)
GLSGVGKSK

SEQ ID NO: 10442 - protein, 9 aa, Artificial Sequence
  Description of Artificial Sequence: Synthetic peptide
  Seed: GASGVGKSA (KRAS G12S)
GLSGVGKSL

SEQ ID NO: 10443 - protein, 9 aa, Artificial Sequence
  Description of Artificial Sequence: Synthetic peptide
  Seed: GASGVGKSA (KRAS G12S)
GLSGVGKSM

SEQ ID NO: 10444 - protein, 9 aa, Artificial Sequence
  Description of Artificial Sequence: Synthetic peptide
  Seed: GASGVGKSA (KRAS G12S)
GLSGVGKSR

SEQ ID NO: 10445 - protein, 9 aa, Artificial Sequence
  Description of Artificial Sequence: Synthetic peptide
  Seed: GASGVGKSA (KRAS G12S)
GLSGVGKSY

SEQ ID NO: 10446 - protein, 10 aa, Artificial Sequence
  Description of Artificial Sequence: Synthetic peptide
  Seed: GASGVGKSAL (KRAS G12S)
GMSGVGKSAF

SEQ ID NO: 10447 - protein, 10 aa, Artificial Sequence
  Description of Artificial Sequence: Synthetic peptide
  Seed: GASGVGKSAL (KRAS G12S)
GMSGVGKSAH

SEQ ID NO: 10448 - protein, 10 aa, Artificial Sequence
  Description of Artificial Sequence: Synthetic peptide
  Seed: GASGVGKSAL (KRAS G12S)
GMSGVGKSAK

SEQ ID NO: 10449 - protein, 10 aa, Artificial Sequence
  Description of Artificial Sequence: Synthetic peptide
  Seed: GASGVGKSAL (KRAS G12S)
GMSGVGKSAL

SEQ ID NO: 10450 - protein, 10 aa, Artificial Sequence
  Description of Artificial Sequence: Synthetic peptide
  Seed: GASGVGKSAL (KRAS G12S)
GMSGVGKSAM

SEQ ID NO: 10451 - protein, 10 aa, Artificial Sequence
  Description of Artificial Sequence: Synthetic peptide
  Seed: GASGVGKSAL (KRAS G12S)
GMSGVGKSAR

SEQ ID NO: 10452 - protein, 10 aa, Artificial Sequence
  Description of Artificial Sequence: Synthetic peptide
  Seed: GASGVGKSAL (KRAS G12S)
GMSGVGKSAW

SEQ ID NO: 10453 - protein, 10 aa, Artificial Sequence
  Description of Artificial Sequence: Synthetic peptide
  Seed: GASGVGKSAL (KRAS G12S)
GMSGVGKSAY

SEQ ID NO: 10454 - protein, 9 aa, Artificial Sequence
  Description of Artificial Sequence: Synthetic peptide
  Seed: GASGVGKSA (KRAS G12S)
GMSGVGKSF

SEQ ID NO: 10455 - protein, 9 aa, Artificial Sequence
  Description of Artificial Sequence: Synthetic peptide
  Seed: GASGVGKSA (KRAS G12S)
GMSGVGKSH

SEQ ID NO: 10456 - protein, 9 aa, Artificial Sequence
  Description of Artificial Sequence: Synthetic peptide
  Seed: GASGVGKSA (KRAS G12S)
GMSGVGKSK

SEQ ID NO: 10457 - protein, 9 aa, Artificial Sequence
  Description of Artificial Sequence: Synthetic peptide
  Seed: GASGVGKSA (KRAS G12S)
GMSGVGKSL

SEQ ID NO: 10458 - protein, 9 aa, Artificial Sequence
  Description of Artificial Sequence: Synthetic peptide
  Seed: GASGVGKSA (KRAS G12S)
GMSGVGKSM

SEQ ID NO: 10459 - protein, 9 aa, Artificial Sequence
  Description of Artificial Sequence: Synthetic peptide
  Seed: GASGVGKSA (KRAS G12S)
GMSGVGKSR

SEQ ID NO: 10460 - protein, 9 aa, Artificial Sequence
  Description of Artificial Sequence: Synthetic peptide
  Seed: GASGVGKSA (KRAS G12S)
GMSGVGKSY

SEQ ID NO: 10461 - protein, 10 aa, Artificial Sequence
  Description of Artificial Sequence: Synthetic peptide
  Seed: GASGVGKSAL (KRAS G12S)
GNSGVGKSAF

SEQ ID NO: 10462 - protein, 10 aa, Artificial Sequence
  Description of Artificial Sequence: Synthetic peptide
  Seed: GASGVGKSAL (KRAS G12S)
GNSGVGKSAK

SEQ ID NO: 10463 - protein, 10 aa, Artificial Sequence
  Description of Artificial Sequence: Synthetic peptide
  Seed: GASGVGKSAL (KRAS G12S)
GNSGVGKSAR

SEQ ID NO: 10464 - protein, 10 aa, Artificial Sequence
  Description of Artificial Sequence: Synthetic peptide
  Seed: GASGVGKSAL (KRAS G12S)
GNSGVGKSAY

SEQ ID NO: 10465 - protein, 9 aa, Artificial Sequence
  Description of Artificial Sequence: Synthetic peptide
  Seed: GASGVGKSA (KRAS G12S)
GNSGVGKSF

SEQ ID NO: 10466 - protein, 9 aa, Artificial Sequence
  Description of Artificial Sequence: Synthetic peptide
  Seed: GASGVGKSA (KRAS G12S)
GNSGVGKSK

SEQ ID NO: 10467 - protein, 9 aa, Artificial Sequence
  Description of Artificial Sequence: Synthetic peptide
  Seed: GASGVGKSA (KRAS G12S)
GNSGVGKSL

SEQ ID NO: 10468 - protein, 9 aa, Artificial Sequence
  Description of Artificial Sequence: Synthetic peptide
  Seed: GASGVGKSA (KRAS G12S)
GNSGVGKSM

SEQ ID NO: 10469 - protein, 9 aa, Artificial Sequence
  Description of Artificial Sequence: Synthetic peptide
  Seed: GASGVGKSA (KRAS G12S)
GNSGVGKSR

SEQ ID NO: 10470 - protein, 9 aa, Artificial Sequence
  Description of Artificial Sequence: Synthetic peptide
  Seed: GASGVGKSA (KRAS G12S)
GNSGVGKSY

SEQ ID NO: 10471 - protein, 9 aa, Artificial Sequence
  Description of Artificial Sequence: Synthetic peptide
  Seed: GASGVGKSA (KRAS G12S)
GPSGVGKSA

SEQ ID NO: 10472 - protein, 10 aa, Artificial Sequence
  Description of Artificial Sequence: Synthetic peptide
  Seed: GASGVGKSAL (KRAS G12S)
GPSGVGKSAA

SEQ ID NO: 10473 - protein, 10 aa, Artificial Sequence
  Description of Artificial Sequence: Synthetic peptide
  Seed: GASGVGKSAL (KRAS G12S)
GPSGVGKSAC

SEQ ID NO: 10474 - protein, 10 aa, Artificial Sequence
  Description of Artificial Sequence: Synthetic peptide
  Seed: GASGVGKSAL (KRAS G12S)
GPSGVGKSAF

SEQ ID NO: 10475 - protein, 10 aa, Artificial Sequence
  Description of Artificial Sequence: Synthetic peptide
  Seed: GASGVGKSAL (KRAS G12S)
GPSGVGKSAG

SEQ ID NO: 10476 - protein, 10 aa, Artificial Sequence
  Description of Artificial Sequence: Synthetic peptide
  Seed: GASGVGKSAL (KRAS G12S)
GPSGVGKSAH

SEQ ID NO: 10477 - protein, 10 aa, Artificial Sequence
  Description of Artificial Sequence: Synthetic peptide
  Seed: GASGVGKSAL (KRAS G12S)
GPSGVGKSAI

SEQ ID NO: 10478 - protein, 10 aa, Artificial Sequence
  Description of Artificial Sequence: Synthetic peptide
  Seed: GASGVGKSAL (KRAS G12S)
GPSGVGKSAP

SEQ ID NO: 10479 - protein, 10 aa, Artificial Sequence
  Description of Artificial Sequence: Synthetic peptide
  Seed: GASGVGKSAL (KRAS G12S)
GPSGVGKSAS

SEQ ID NO: 10480 - protein, 10 aa, Artificial Sequence
  Description of Artificial Sequence: Synthetic peptide
  Seed: GASGVGKSAL (KRAS G12S)
GPSGVGKSAT

SEQ ID NO: 10481 - protein, 10 aa, Artificial Sequence
  Description of Artificial Sequence: Synthetic peptide
  Seed: GASGVGKSAL (KRAS G12S)
GPSGVGKSAV

SEQ ID NO: 10482 - protein, 10 aa, Artificial Sequence
  Description of Artificial Sequence: Synthetic peptide
  Seed: GASGVGKSAL (KRAS G12S)
GPSGVGKSAW

SEQ ID NO: 10483 - protein, 10 aa, Artificial Sequence
  Description of Artificial Sequence: Synthetic peptide
  Seed: GASGVGKSAL (KRAS G12S)
GPSGVGKSAY

SEQ ID NO: 10484 - protein, 9 aa, Artificial Sequence
  Description of Artificial Sequence: Synthetic peptide
  Seed: GASGVGKSA (KRAS G12S)
GPSGVGKSC

SEQ ID NO: 10485 - protein, 9 aa, Artificial Sequence
  Description of Artificial Sequence: Synthetic peptide
  Seed: GASGVGKSA (KRAS G12S)
GPSGVGKSF

SEQ ID NO: 10486 - protein, 9 aa, Artificial Sequence
  Description of Artificial Sequence: Synthetic peptide
  Seed: GASGVGKSA (KRAS G12S)
GPSGVGKSG

SEQ ID NO: 10487 - protein, 9 aa, Artificial Sequence
  Description of Artificial Sequence: Synthetic peptide
  Seed: GASGVGKSA (KRAS G12S)
GPSGVGKSI

SEQ ID NO: 10488 - protein, 9 aa, Artificial Sequence
  Description of Artificial Sequence: Synthetic peptide
  Seed: GASGVGKSA (KRAS G12S)
GPSGVGKSK

SEQ ID NO: 10489 - protein, 9 aa, Artificial Sequence
  Description of Artificial Sequence: Synthetic peptide
  Seed: GASGVGKSA (KRAS G12S)
GPSGVGKSL

SEQ ID NO: 10490 - protein, 9 aa, Artificial Sequence
  Description of Artificial Sequence: Synthetic peptide
  Seed: GASGVGKSA (KRAS G12S)
GPSGVGKSM

SEQ ID NO: 10491 - protein, 9 aa, Artificial Sequence
  Description of Artificial Sequence: Synthetic peptide
  Seed: GASGVGKSA (KRAS G12S)
GPSGVGKSP

SEQ ID NO: 10492 - protein, 9 aa, Artificial Sequence
  Description of Artificial Sequence: Synthetic peptide
  Seed: GASGVGKSA (KRAS G12S)
GPSGVGKSR

SEQ ID NO: 10493 - protein, 9 aa, Artificial Sequence
  Description of Artificial Sequence: Synthetic peptide
  Seed: GASGVGKSA (KRAS G12S)
GPSGVGKSS

SEQ ID NO: 10494 - protein, 9 aa, Artificial Sequence
  Description of Artificial Sequence: Synthetic peptide
  Seed: GASGVGKSA (KRAS G12S)
GPSGVGKST

SEQ ID NO: 10495 - protein, 9 aa, Artificial Sequence
  Description of Artificial Sequence: Synthetic peptide
  Seed: GASGVGKSA (KRAS G12S)
GPSGVGKSV

SEQ ID NO: 10496 - protein, 9 aa, Artificial Sequence
  Description of Artificial Sequence: Synthetic peptide
  Seed: GASGVGKSA (KRAS G12S)
GPSGVGKSW

SEQ ID NO: 10497 - protein, 9 aa, Artificial Sequence
  Description of Artificial Sequence: Synthetic peptide
  Seed: GASGVGKSA (KRAS G12S)
GPSGVGKSY

SEQ ID NO: 10498 - protein, 10 aa, Artificial Sequence
  Description of Artificial Sequence: Synthetic peptide
  Seed: GASGVGKSAL (KRAS G12S)
GQSGVGKSAF

SEQ ID NO: 10499 - protein, 10 aa, Artificial Sequence
  Description of Artificial Sequence: Synthetic peptide
  Seed: GASGVGKSAL (KRAS G12S)
GQSGVGKSAH

SEQ ID NO: 10500 - protein, 10 aa, Artificial Sequence
  Description of Artificial Sequence: Synthetic peptide
  Seed: GASGVGKSAL (KRAS G12S)
GQSGVGKSAI

SEQ ID NO: 10501 - protein, 10 aa, Artificial Sequence
  Description of Artificial Sequence: Synthetic peptide
  Seed: GASGVGKSAL (KRAS G12S)
GQSGVGKSAK

SEQ ID NO: 10502 - protein, 10 aa, Artificial Sequence
  Description of Artificial Sequence: Synthetic peptide
  Seed: GASGVGKSAL (KRAS G12S)
GQSGVGKSAL

SEQ ID NO: 10503 - protein, 10 aa, Artificial Sequence
  Description of Artificial Sequence: Synthetic peptide
  Seed: GASGVGKSAL (KRAS G12S)
GQSGVGKSAM

SEQ ID NO: 10504 - protein, 10 aa, Artificial Sequence
  Description of Artificial Sequence: Synthetic peptide
  Seed: GASGVGKSAL (KRAS G12S)
GQSGVGKSAR

SEQ ID NO: 10505 - protein, 10 aa, Artificial Sequence
  Description of Artificial Sequence: Synthetic peptide
  Seed: GASGVGKSAL (KRAS G12S)
GQSGVGKSAW

SEQ ID NO: 10506 - protein, 10 aa, Artificial Sequence
  Description of Artificial Sequence: Synthetic peptide
  Seed: GASGVGKSAL (KRAS G12S)
GQSGVGKSAY

SEQ ID NO: 10507 - protein, 9 aa, Artificial Sequence
  Description of Artificial Sequence: Synthetic peptide
  Seed: GASGVGKSA (KRAS G12S)
GQSGVGKSF

SEQ ID NO: 10508 - protein, 9 aa, Artificial Sequence
  Description of Artificial Sequence: Synthetic peptide
  Seed: GASGVGKSA (KRAS G12S)
GQSGVGKSH

SEQ ID NO: 10509 - protein, 9 aa, Artificial Sequence
  Description of Artificial Sequence: Synthetic peptide
  Seed: GASGVGKSA (KRAS G12S)
GQSGVGKSK

SEQ ID NO: 10510 - protein, 9 aa, Artificial Sequence
  Description of Artificial Sequence: Synthetic peptide
  Seed: GASGVGKSA (KRAS G12S)
GQSGVGKSL

SEQ ID NO: 10511 - protein, 9 aa, Artificial Sequence
  Description of Artificial Sequence: Synthetic peptide
  Seed: GASGVGKSA (KRAS G12S)
GQSGVGKSM

SEQ ID NO: 10512 - protein, 9 aa, Artificial Sequence
  Description of Artificial Sequence: Synthetic peptide
  Seed: GASGVGKSA (KRAS G12S)
GQSGVGKSR

SEQ ID NO: 10513 - protein, 9 aa, Artificial Sequence
  Description of Artificial Sequence: Synthetic peptide
  Seed: GASGVGKSA (KRAS G12S)
GQSGVGKSW

SEQ ID NO: 10514 - protein, 9 aa, Artificial Sequence
  Description of Artificial Sequence: Synthetic peptide
  Seed: GASGVGKSA (KRAS G12S)
GQSGVGKSY

SEQ ID NO: 10515 - protein, 10 aa, Artificial Sequence
  Description of Artificial Sequence: Synthetic peptide
  Seed: GASGVGKSAL (KRAS G12S)
GRSGVGKSAF

SEQ ID NO: 10516 - protein, 10 aa, Artificial Sequence
  Description of Artificial Sequence: Synthetic peptide
  Seed: GASGVGKSAL (KRAS G12S)
GRSGVGKSAI

SEQ ID NO: 10517 - protein, 10 aa, Artificial Sequence
  Description of Artificial Sequence: Synthetic peptide
  Seed: GASGVGKSAL (KRAS G12S)
GRSGVGKSAL

SEQ ID NO: 10518 - protein, 10 aa, Artificial Sequence
  Description of Artificial Sequence: Synthetic peptide
  Seed: GASGVGKSAL (KRAS G12S)
GRSGVGKSAM

SEQ ID NO: 10519 - protein, 10 aa, Artificial Sequence
  Description of Artificial Sequence: Synthetic peptide
  Seed: GASGVGKSAL (KRAS G12S)
GRSGVGKSAV

SEQ ID NO: 10520 - protein, 10 aa, Artificial Sequence
  Description of Artificial Sequence: Synthetic peptide
  Seed: GASGVGKSAL (KRAS G12S)
GRSGVGKSAY

SEQ ID NO: 10521 - protein, 9 aa, Artificial Sequence
  Description of Artificial Sequence: Synthetic peptide
  Seed: GASGVGKSA (KRAS G12S)
GSSGVGKSA

SEQ ID NO: 10522 - protein, 10 aa, Artificial Sequence
  Description of Artificial Sequence: Synthetic peptide
  Seed: GASGVGKSAL (KRAS G12S)
GSSGVGKSAF

SEQ ID NO: 10523 - protein, 10 aa, Artificial Sequence
  Description of Artificial Sequence: Synthetic peptide
  Seed: GASGVGKSAL (KRAS G12S)
GSSGVGKSAH

SEQ ID NO: 10524 - protein, 10 aa, Artificial Sequence
  Description of Artificial Sequence: Synthetic peptide
  Seed: GASGVGKSAL (KRAS G12S)
GSSGVGKSAI

SEQ ID NO: 10525 - protein, 10 aa, Artificial Sequence
  Description of Artificial Sequence: Synthetic peptide
  Seed: GASGVGKSAL (KRAS G12S)
GSSGVGKSAK

SEQ ID NO: 10526 - protein, 10 aa, Artificial Sequence
  Description of Artificial Sequence: Synthetic peptide
  Seed: GASGVGKSAL (KRAS G12S)
GSSGVGKSAL

SEQ ID NO: 10527 - protein, 10 aa, Artificial Sequence
  Description of Artificial Sequence: Synthetic peptide
  Seed: GASGVGKSAL (KRAS G12S)
GSSGVGKSAM

SEQ ID NO: 10528 - protein, 10 aa, Artificial Sequence
  Description of Artificial Sequence: Synthetic peptide
  Seed: GASGVGKSAL (KRAS G12S)
GSSGVGKSAR

SEQ ID NO: 10529 - protein, 10 aa, Artificial Sequence
  Description of Artificial Sequence: Synthetic peptide
  Seed: GASGVGKSAL (KRAS G12S)
GSSGVGKSAV

SEQ ID NO: 10530 - protein, 10 aa, Artificial Sequence
  Description of Artificial Sequence: Synthetic peptide
  Seed: GASGVGKSAL (KRAS G12S)
GSSGVGKSAW

SEQ ID NO: 10531 - protein, 10 aa, Artificial Sequence
  Description of Artificial Sequence: Synthetic peptide
  Seed: GASGVGKSAL (KRAS G12S)
GSSGVGKSAY

SEQ ID NO: 10532 - protein, 9 aa, Artificial Sequence
  Description of Artificial Sequence: Synthetic peptide
  Seed: GASGVGKSA (KRAS G12S)
GSSGVGKSF

SEQ ID NO: 10533 - protein, 9 aa, Artificial Sequence
  Description of Artificial Sequence: Synthetic peptide
  Seed: GASGVGKSA (KRAS G12S)
GSSGVGKSH

SEQ ID NO: 10534 - protein, 9 aa, Artificial Sequence
  Description of Artificial Sequence: Synthetic peptide
  Seed: GASGVGKSA (KRAS G12S)
GSSGVGKSI

SEQ ID NO: 10535 - protein, 9 aa, Artificial Sequence
  Description of Artificial Sequence: Synthetic peptide
  Seed: GASGVGKSA (KRAS G12S)
GSSGVGKSK

SEQ ID NO: 10536 - protein, 9 aa, Artificial Sequence
  Description of Artificial Sequence: Synthetic peptide
  Seed: GASGVGKSA (KRAS G12S)
GSSGVGKSL

SEQ ID NO: 10537 - protein, 9 aa, Artificial Sequence
  Description of Artificial Sequence: Synthetic peptide
  Seed: GASGVGKSA (KRAS G12S)
GSSGVGKSM

SEQ ID NO: 10538 - protein, 9 aa, Artificial Sequence
  Description of Artificial Sequence: Synthetic peptide
  Seed: GASGVGKSA (KRAS G12S)
GSSGVGKSR

SEQ ID NO: 10539 - protein, 9 aa, Artificial Sequence
  Description of Artificial Sequence: Synthetic peptide
  Seed: GASGVGKSA (KRAS G12S)
GSSGVGKSV

SEQ ID NO: 10540 - protein, 9 aa, Artificial Sequence
  Description of Artificial Sequence: Synthetic peptide
  Seed: GASGVGKSA (KRAS G12S)
GSSGVGKSW

SEQ ID NO: 10541 - protein, 9 aa, Artificial Sequence
  Description of Artificial Sequence: Synthetic peptide
  Seed: GASGVGKSA (KRAS G12S)
GSSGVGKSY

SEQ ID NO: 10542 - protein, 9 aa, Artificial Sequence
  Description of Artificial Sequence: Synthetic peptide
  Seed: GASGVGKSA (KRAS G12S)
GTSGVGKSA

SEQ ID NO: 10543 - protein, 10 aa, Artificial Sequence
  Description of Artificial Sequence: Synthetic peptide
  Seed: GASGVGKSAL (KRAS G12S)
GTSGVGKSAF

SEQ ID NO: 10544 - protein, 10 aa, Artificial Sequence
  Description of Artificial Sequence: Synthetic peptide
  Seed: GASGVGKSAL (KRAS G12S)
GTSGVGKSAH

SEQ ID NO: 10545 - protein, 10 aa, Artificial Sequence
  Description of Artificial Sequence: Synthetic peptide
  Seed: GASGVGKSAL (KRAS G12S)
GTSGVGKSAI

SEQ ID NO: 10546 - protein, 10 aa, Artificial Sequence
  Description of Artificial Sequence: Synthetic peptide
  Seed: GASGVGKSAL (KRAS G12S)
GTSGVGKSAK

SEQ ID NO: 10547 - protein, 10 aa, Artificial Sequence
  Description of Artificial Sequence: Synthetic peptide
  Seed: GASGVGKSAL (KRAS G12S)
GTSGVGKSAL

SEQ ID NO: 10548 - protein, 10 aa, Artificial Sequence
  Description of Artificial Sequence: Synthetic peptide
  Seed: GASGVGKSAL (KRAS G12S)
GTSGVGKSAM

SEQ ID NO: 10549 - protein, 10 aa, Artificial Sequence
  Description of Artificial Sequence: Synthetic peptide
  Seed: GASGVGKSAL (KRAS G12S)
GTSGVGKSAR

SEQ ID NO: 10550 - protein, 10 aa, Artificial Sequence
  Description of Artificial Sequence: Synthetic peptide
  Seed: GASGVGKSAL (KRAS G12S)
GTSGVGKSAY

SEQ ID NO: 10551 - protein, 9 aa, Artificial Sequence
  Description of Artificial Sequence: Synthetic peptide
  Seed: GASGVGKSA (KRAS G12S)
GTSGVGKSF

SEQ ID NO: 10552 - protein, 9 aa, Artificial Sequence
  Description of Artificial Sequence: Synthetic peptide
  Seed: GASGVGKSA (KRAS G12S)
GTSGVGKSH

SEQ ID NO: 10553 - protein, 9 aa, Artificial Sequence
  Description of Artificial Sequence: Synthetic peptide
  Seed: GASGVGKSA (KRAS G12S)
GTSGVGKSI

SEQ ID NO: 10554 - protein, 9 aa, Artificial Sequence
  Description of Artificial Sequence: Synthetic peptide
  Seed: GASGVGKSA (KRAS G12S)
GTSGVGKSK

SEQ ID NO: 10555 - protein, 9 aa, Artificial Sequence
  Description of Artificial Sequence: Synthetic peptide
  Seed: GASGVGKSA (KRAS G12S)
GTSGVGKSL

SEQ ID NO: 10556 - protein, 9 aa, Artificial Sequence
  Description of Artificial Sequence: Synthetic peptide
  Seed: GASGVGKSA (KRAS G12S)
GTSGVGKSM

SEQ ID NO: 10557 - protein, 9 aa, Artificial Sequence
  Description of Artificial Sequence: Synthetic peptide
  Seed: GASGVGKSA (KRAS G12S)
GTSGVGKSR

SEQ ID NO: 10558 - protein, 9 aa, Artificial Sequence
  Description of Artificial Sequence: Synthetic peptide
  Seed: GASGVGKSA (KRAS G12S)
GTSGVGKSV

SEQ ID NO: 10559 - protein, 9 aa, Artificial Sequence
  Description of Artificial Sequence: Synthetic peptide
  Seed: GASGVGKSA (KRAS G12S)
GTSGVGKSW

SEQ ID NO: 10560 - protein, 9 aa, Artificial Sequence
  Description of Artificial Sequence: Synthetic peptide
  Seed: GASGVGKSA (KRAS G12S)
GTSGVGKSY

SEQ ID NO: 10561 - protein, 9 aa, Artificial Sequence
  Description of Artificial Sequence: Synthetic peptide
  Seed: GASGVGKSA (KRAS G12S)
GVSGVGKSA

SEQ ID NO: 10562 - protein, 10 aa, Artificial Sequence
  Description of Artificial Sequence: Synthetic peptide
  Seed: GASGVGKSAL (KRAS G12S)
GVSGVGKSAF

SEQ ID NO: 10563 - protein, 10 aa, Artificial Sequence
  Description of Artificial Sequence: Synthetic peptide
  Seed: GASGVGKSAL (KRAS G12S)
GVSGVGKSAH

SEQ ID NO: 10564 - protein, 10 aa, Artificial Sequence
  Description of Artificial Sequence: Synthetic peptide
  Seed: GASGVGKSAL (KRAS G12S)
GVSGVGKSAK

SEQ ID NO: 10565 - protein, 10 aa, Artificial Sequence
  Description of Artificial Sequence: Synthetic peptide
  Seed: GASGVGKSAL (KRAS G12S)
GVSGVGKSAL

SEQ ID NO: 10566 - protein, 10 aa, Artificial Sequence
  Description of Artificial Sequence: Synthetic peptide
  Seed: GASGVGKSAL (KRAS G12S)
GVSGVGKSAM

SEQ ID NO: 10567 - protein, 10 aa, Artificial Sequence
  Description of Artificial Sequence: Synthetic peptide
  Seed: GASGVGKSAL (KRAS G12S)
GVSGVGKSAR

SEQ ID NO: 10568 - protein, 10 aa, Artificial Sequence
  Description of Artificial Sequence: Synthetic peptide
  Seed: GASGVGKSAL (KRAS G12S)
GVSGVGKSAW

SEQ ID NO: 10569 - protein, 10 aa, Artificial Sequence
  Description of Artificial Sequence: Synthetic peptide
  Seed: GASGVGKSAL (KRAS G12S)
GVSGVGKSAY

SEQ ID NO: 10570 - protein, 9 aa, Artificial Sequence
  Description of Artificial Sequence: Synthetic peptide
  Seed: GASGVGKSA (KRAS G12S)
GVSGVGKSF

SEQ ID NO: 10571 - protein, 9 aa, Artificial Sequence
  Description of Artificial Sequence: Synthetic peptide
  Seed: GASGVGKSA (KRAS G12S)
GVSGVGKSH

SEQ ID NO: 10572 - protein, 9 aa, Artificial Sequence
  Description of Artificial Sequence: Synthetic peptide
  Seed: GASGVGKSA (KRAS G12S)
GVSGVGKSI

SEQ ID NO: 10573 - protein, 9 aa, Artificial Sequence
  Description of Artificial Sequence: Synthetic peptide
  Seed: GASGVGKSA (KRAS G12S)
GVSGVGKSK

SEQ ID NO: 10574 - protein, 9 aa, Artificial Sequence
  Description of Artificial Sequence: Synthetic peptide
  Seed: GASGVGKSA (KRAS G12S)
GVSGVGKSL

SEQ ID NO: 10575 - protein, 9 aa, Artificial Sequence
  Description of Artificial Sequence: Synthetic peptide
  Seed: GASGVGKSA (KRAS G12S)
GVSGVGKSM

SEQ ID NO: 10576 - protein, 9 aa, Artificial Sequence
  Description of Artificial Sequence: Synthetic peptide
  Seed: GASGVGKSA (KRAS G12S)
GVSGVGKSR

SEQ ID NO: 10577 - protein, 9 aa, Artificial Sequence
  Description of Artificial Sequence: Synthetic peptide
  Seed: GASGVGKSA (KRAS G12S)
GVSGVGKSV

SEQ ID NO: 10578 - protein, 9 aa, Artificial Sequence
  Description of Artificial Sequence: Synthetic peptide
  Seed: GASGVGKSA (KRAS G12S)
GVSGVGKSW

SEQ ID NO: 10579 - protein, 9 aa, Artificial Sequence
  Description of Artificial Sequence: Synthetic peptide
  Seed: GASGVGKSA (KRAS G12S)
GVSGVGKSY

SEQ ID NO: 10580 - protein, 10 aa, Artificial Sequence
  Description of Artificial Sequence: Synthetic peptide
  Seed: GASGVGKSAL (KRAS G12S)
GWSGVGKSAF

SEQ ID NO: 10581 - protein, 10 aa, Artificial Sequence
  Description of Artificial Sequence: Synthetic peptide
  Seed: GASGVGKSAL (KRAS G12S)
GWSGVGKSAY

SEQ ID NO: 10582 - protein, 9 aa, Artificial Sequence
  Description of Artificial Sequence: Synthetic peptide
  Seed: GASGVGKSA (KRAS G12S)
GWSGVGKSK

SEQ ID NO: 10583 - protein, 9 aa, Artificial Sequence
  Description of Artificial Sequence: Synthetic peptide
  Seed: GASGVGKSA (KRAS G12S)
GWSGVGKSY

SEQ ID NO: 10584 - protein, 10 aa, Artificial Sequence
  Description of Artificial Sequence: Synthetic peptide
  Seed: GASGVGKSAL (KRAS G12S)
GYSGVGKSAF

SEQ ID NO: 10585 - protein, 10 aa, Artificial Sequence
  Description of Artificial Sequence: Synthetic peptide
  Seed: GASGVGKSAL (KRAS G12S)
GYSGVGKSAL

SEQ ID NO: 10586 - protein, 10 aa, Artificial Sequence
  Description of Artificial Sequence: Synthetic peptide
  Seed: GASGVGKSAL (KRAS G12S)
GYSGVGKSAM

SEQ ID NO: 10587 - protein, 10 aa, Artificial Sequence
  Description of Artificial Sequence: Synthetic peptide
  Seed: GASGVGKSAL (KRAS G12S)
GYSGVGKSAY

SEQ ID NO: 10588 - protein, 9 aa, Artificial Sequence
  Description of Artificial Sequence: Synthetic peptide
  Seed: GASGVGKSA (KRAS G12S)
GYSGVGKSF

SEQ ID NO: 10589 - protein, 9 aa, Artificial Sequence
  Description of Artificial Sequence: Synthetic peptide
  Seed: GASGVGKSA (KRAS G12S)
GYSGVGKSK

SEQ ID NO: 10590 - protein, 9 aa, Artificial Sequence
  Description of Artificial Sequence: Synthetic peptide
  Seed: GASGVGKSA (KRAS G12S)
GYSGVGKSM

SEQ ID NO: 10591 - protein, 9 aa, Artificial Sequence
  Description of Artificial Sequence: Synthetic peptide
  Seed: GASGVGKSA (KRAS G12S)
GYSGVGKSY

SEQ ID NO: 10592 - protein, 10 aa, Artificial Sequence
  Description of Artificial Sequence: Synthetic peptide
  Seed: KLVVVGASGV (KRAS G12S)
KIVVVGASGA

SEQ ID NO: 10593 - protein, 10 aa, Artificial Sequence
  Description of Artificial Sequence: Synthetic peptide
  Seed: KLVVVGASGV (KRAS G12S)
KIVVVGASGI

SEQ ID NO: 10594 - protein, 10 aa, Artificial Sequence
  Description of Artificial Sequence: Synthetic peptide
  Seed: KLVVVGASGV (KRAS G12S)
KIVVVGASGL

SEQ ID NO: 10595 - protein, 10 aa, Artificial Sequence
  Description of Artificial Sequence: Synthetic peptide
  Seed: KLVVVGASGV (KRAS G12S)
KLVVVGASGM

SEQ ID NO: 10596 - protein, 10 aa, Artificial Sequence
  Description of Artificial Sequence: Synthetic peptide
  Seed: KLVVVGASGV (KRAS G12S)
KQVVVGASGA

SEQ ID NO: 10597 - protein, 10 aa, Artificial Sequence
  Description of Artificial Sequence: Synthetic peptide
  Seed: KLVVVGASGV (KRAS G12S)
KQVVVGASGF

SEQ ID NO: 10598 - protein, 10 aa, Artificial Sequence
  Description of Artificial Sequence: Synthetic peptide
  Seed: KLVVVGASGV (KRAS G12S)
KQVVVGASGM

SEQ ID NO: 10599 - protein, 10 aa, Artificial Sequence
  Description of Artificial Sequence: Synthetic peptide
  Seed: KLVVVGASGV (KRAS G12S)
KQVVVGASGW

SEQ ID NO: 10600 - protein, 10 aa, Artificial Sequence
  Description of Artificial Sequence: Synthetic peptide
  Seed: KLVVVGASGV (KRAS G12S)
KTVVVGASGI

SEQ ID NO: 10601 - protein, 10 aa, Artificial Sequence
  Description of Artificial Sequence: Synthetic peptide
  Seed: KLVVVGASGV (KRAS G12S)
KTVVVGASGL

SEQ ID NO: 10602 - protein, 10 aa, Artificial Sequence
  Description of Artificial Sequence: Synthetic peptide
  Seed: KLVVVGASGV (KRAS G12S)
KVVVVGASGA

SEQ ID NO: 10603 - protein, 10 aa, Artificial Sequence
  Description of Artificial Sequence: Synthetic peptide
  Seed: KLVVVGASGV (KRAS G12S)
KVVVVGASGI

SEQ ID NO: 10604 - protein, 10 aa, Artificial Sequence
  Description of Artificial Sequence: Synthetic peptide
  Seed: KLVVVGASGV (KRAS G12S)
KVVVVGASGL

SEQ ID NO: 10605 - protein, 9 aa, Artificial Sequence
  Description of Artificial Sequence: Synthetic peptide
  Seed: LVVVGASGV (KRAS G12S)
LAVVGASGI

SEQ ID NO: 10606 - protein, 9 aa, Artificial Sequence
  Description of Artificial Sequence: Synthetic peptide
  Seed: LVVVGASGV (KRAS G12S)
LAVVGASGL

SEQ ID NO: 10607 - protein, 11 aa, Artificial Sequence
  Description of Artificial Sequence: Synthetic peptide
  Seed: LVVVGASGVGK (KRAS G12S)
LAVVGASGVGF

SEQ ID NO: 10608 - protein, 11 aa, Artificial Sequence
  Description of Artificial Sequence: Synthetic peptide
  Seed: LVVVGASGVGK (KRAS G12S)
LAVVGASGVGH

SEQ ID NO: 10609 - protein, 11 aa, Artificial Sequence
  Description of Artificial Sequence: Synthetic peptide
  Seed: LVVVGASGVGK (KRAS G12S)
LAVVGASGVGI

SEQ ID NO: 10610 - protein, 11 aa, Artificial Sequence
  Description of Artificial Sequence: Synthetic peptide
  Seed: LVVVGASGVGK (KRAS G12S)
LAVVGASGVGK

SEQ ID NO: 10611 - protein, 11 aa, Artificial Sequence
  Description of Artificial Sequence: Synthetic peptide
  Seed: LVVVGASGVGK (KRAS G12S)
LAVVGASGVGL

SEQ ID NO: 10612 - protein, 11 aa, Artificial Sequence
  Description of Artificial Sequence: Synthetic peptide
  Seed: LVVVGASGVGK (KRAS G12S)
LAVVGASGVGM

SEQ ID NO: 10613 - protein, 11 aa, Artificial Sequence
  Description of Artificial Sequence: Synthetic peptide
  Seed: LVVVGASGVGK (KRAS G12S)
LAVVGASGVGR

SEQ ID NO: 10614 - protein, 11 aa, Artificial Sequence
  Description of Artificial Sequence: Synthetic peptide
  Seed: LVVVGASGVGK (KRAS G12S)
LAVVGASGVGW

SEQ ID NO: 10615 - protein, 11 aa, Artificial Sequence
  Description of Artificial Sequence: Synthetic peptide
  Seed: LVVVGASGVGK (KRAS G12S)
LAVVGASGVGY

SEQ ID NO: 10616 - protein, 11 aa, Artificial Sequence
  Description of Artificial Sequence: Synthetic peptide
  Seed: LVVVGASGVGK (KRAS G12S)
LCVVGASGVGK

SEQ ID NO: 10617 - protein, 11 aa, Artificial Sequence
  Description of Artificial Sequence: Synthetic peptide
  Seed: LVVVGASGVGK (KRAS G12S)
LCVVGASGVGR

SEQ ID NO: 10618 - protein, 11 aa, Artificial Sequence
  Description of Artificial Sequence: Synthetic peptide
  Seed: LVVVGASGVGK (KRAS G12S)
LDVVGASGVGK

SEQ ID NO: 10619 - protein, 11 aa, Artificial Sequence
  Description of Artificial Sequence: Synthetic peptide
  Seed: LVVVGASGVGK (KRAS G12S)
LDVVGASGVGR

SEQ ID NO: 10620 - protein, 11 aa, Artificial Sequence
  Description of Artificial Sequence: Synthetic peptide
  Seed: LVVVGASGVGK (KRAS G12S)
LEVVGASGVGK

SEQ ID NO: 10621 - protein, 11 aa, Artificial Sequence
  Description of Artificial Sequence: Synthetic peptide
  Seed: LVVVGASGVGK (KRAS G12S)
LEVVGASGVGR

SEQ ID NO: 10622 - protein, 11 aa, Artificial Sequence
  Description of Artificial Sequence: Synthetic peptide
  Seed: LVVVGASGVGK (KRAS G12S)
LFVVGASGVGK

SEQ ID NO: 10623 - protein, 11 aa, Artificial Sequence
  Description of Artificial Sequence: Synthetic peptide
  Seed: LVVVGASGVGK (KRAS G12S)
LFVVGASGVGR

SEQ ID NO: 10624 - protein, 11 aa, Artificial Sequence
  Description of Artificial Sequence: Synthetic peptide
  Seed: LVVVGASGVGK (KRAS G12S)
LGVVGASGVGK

SEQ ID NO: 10625 - protein, 11 aa, Artificial Sequence
  Description of Artificial Sequence: Synthetic peptide
  Seed: LVVVGASGVGK (KRAS G12S)
LGVVGASGVGL

SEQ ID NO: 10626 - protein, 11 aa, Artificial Sequence
  Description of Artificial Sequence: Synthetic peptide
  Seed: LVVVGASGVGK (KRAS G12S)
LGVVGASGVGR

SEQ ID NO: 10627 - protein, 11 aa, Artificial Sequence
  Description of Artificial Sequence: Synthetic peptide
  Seed: LVVVGASGVGK (KRAS G12S)
LGVVGASGVGY

SEQ ID NO: 10628 - protein, 11 aa, Artificial Sequence
  Description of Artificial Sequence: Synthetic peptide
  Seed: LVVVGASGVGK (KRAS G12S)
LHVVGASGVGK

SEQ ID NO: 10629 - protein, 11 aa, Artificial Sequence
  Description of Artificial Sequence: Synthetic peptide
  Seed: LVVVGASGVGK (KRAS G12S)
LHVVGASGVGR

SEQ ID NO: 10630 - protein, 11 aa, Artificial Sequence
  Description of Artificial Sequence: Synthetic peptide
  Seed: LVVVGASGVGK (KRAS G12S)
LIVVGASGVGK

SEQ ID NO: 10631 - protein, 11 aa, Artificial Sequence
  Description of Artificial Sequence: Synthetic peptide
  Seed: LVVVGASGVGK (KRAS G12S)
LIVVGASGVGR

SEQ ID NO: 10632 - protein, 11 aa, Artificial Sequence
  Description of Artificial Sequence: Synthetic peptide
  Seed: LVVVGASGVGK (KRAS G12S)
LIVVGASGVGY

SEQ ID NO: 10633 - protein, 11 aa, Artificial Sequence
  Description of Artificial Sequence: Synthetic peptide
  Seed: LVVVGASGVGK (KRAS G12S)
LLVVGASGVGK

SEQ ID NO: 10634 - protein, 11 aa, Artificial Sequence
  Description of Artificial Sequence: Synthetic peptide
  Seed: LVVVGASGVGK (KRAS G12S)
LLVVGASGVGR

SEQ ID NO: 10635 - protein, 11 aa, Artificial Sequence
  Description of Artificial Sequence: Synthetic peptide
  Seed: LVVVGASGVGK (KRAS G12S)
LMVVGASGVGK

SEQ ID NO: 10636 - protein, 11 aa, Artificial Sequence
  Description of Artificial Sequence: Synthetic peptide
  Seed: LVVVGASGVGK (KRAS G12S)
LMVVGASGVGR

SEQ ID NO: 10637 - protein, 11 aa, Artificial Sequence
  Description of Artificial Sequence: Synthetic peptide
  Seed: LVVVGASGVGK (KRAS G12S)
LMVVGASGVGY

SEQ ID NO: 10638 - protein, 11 aa, Artificial Sequence
  Description of Artificial Sequence: Synthetic peptide
  Seed: LVVVGASGVGK (KRAS G12S)
LNVVGASGVGK

SEQ ID NO: 10639 - protein, 11 aa, Artificial Sequence
  Description of Artificial Sequence: Synthetic peptide
  Seed: LVVVGASGVGK (KRAS G12S)
LNVVGASGVGR

SEQ ID NO: 10640 - protein, 11 aa, Artificial Sequence
  Description of Artificial Sequence: Synthetic peptide
  Seed: LVVVGASGVGK (KRAS G12S)
LPVVGASGVGK

SEQ ID NO: 10641 - protein, 11 aa, Artificial Sequence
  Description of Artificial Sequence: Synthetic peptide
  Seed: LVVVGASGVGK (KRAS G12S)
LPVVGASGVGR

SEQ ID NO: 10642 - protein, 9 aa, Artificial Sequence
  Description of Artificial Sequence: Synthetic peptide
  Seed: LVVVGASGV (KRAS G12S)
LQVVGASGA

SEQ ID NO: 10643 - protein, 11 aa, Artificial Sequence
  Description of Artificial Sequence: Synthetic peptide
  Seed: LVVVGASGVGK (KRAS G12S)
LQVVGASGVGK

SEQ ID NO: 10644 - protein, 11 aa, Artificial Sequence
  Description of Artificial Sequence: Synthetic peptide
  Seed: LVVVGASGVGK (KRAS G12S)
LQVVGASGVGR

SEQ ID NO: 10645 - protein, 11 aa, Artificial Sequence
  Description of Artificial Sequence: Synthetic peptide
  Seed: LVVVGASGVGK (KRAS G12S)
LQVVGASGVGY

SEQ ID NO: 10646 - protein, 9 aa, Artificial Sequence
  Description of Artificial Sequence: Synthetic peptide
  Seed: LVVVGASGV (KRAS G12S)
LSVVGASGI

SEQ ID NO: 10647 - protein, 11 aa, Artificial Sequence
  Description of Artificial Sequence: Synthetic peptide
  Seed: LVVVGASGVGK (KRAS G12S)
LSVVGASGVGF

SEQ ID NO: 10648 - protein, 11 aa, Artificial Sequence
  Description of Artificial Sequence: Synthetic peptide
  Seed: LVVVGASGVGK (KRAS G12S)
LSVVGASGVGH

SEQ ID NO: 10649 - protein, 11 aa, Artificial Sequence
  Description of Artificial Sequence: Synthetic peptide
  Seed: LVVVGASGVGK (KRAS G12S)
LSVVGASGVGK

SEQ ID NO: 10650 - protein, 11 aa, Artificial Sequence
  Description of Artificial Sequence: Synthetic peptide
  Seed: LVVVGASGVGK (KRAS G12S)
LSVVGASGVGL

SEQ ID NO: 10651 - protein, 11 aa, Artificial Sequence
  Description of Artificial Sequence: Synthetic peptide
  Seed: LVVVGASGVGK (KRAS G12S)
LSVVGASGVGM

SEQ ID NO: 10652 - protein, 11 aa, Artificial Sequence
  Description of Artificial Sequence: Synthetic peptide
  Seed: LVVVGASGVGK (KRAS G12S)
LSVVGASGVGR

SEQ ID NO: 10653 - protein, 11 aa, Artificial Sequence
  Description of Artificial Sequence: Synthetic peptide
  Seed: LVVVGASGVGK (KRAS G12S)
LSVVGASGVGY

SEQ ID NO: 10654 - protein, 11 aa, Artificial Sequence
  Description of Artificial Sequence: Synthetic peptide
  Seed: LVVVGASGVGK (KRAS G12S)
LTVVGASGVGF

SEQ ID NO: 10655 - protein, 11 aa, Artificial Sequence
  Description of Artificial Sequence: Synthetic peptide
  Seed: LVVVGASGVGK (KRAS G12S)
LTVVGASGVGH

SEQ ID NO: 10656 - protein, 11 aa, Artificial Sequence
  Description of Artificial Sequence: Synthetic peptide
  Seed: LVVVGASGVGK (KRAS G12S)
LTVVGASGVGK

SEQ ID NO: 10657 - protein, 11 aa, Artificial Sequence
  Description of Artificial Sequence: Synthetic peptide
  Seed: LVVVGASGVGK (KRAS G12S)
LTVVGASGVGL

SEQ ID NO: 10658 - protein, 11 aa, Artificial Sequence
  Description of Artificial Sequence: Synthetic peptide
  Seed: LVVVGASGVGK (KRAS G12S)
LTVVGASGVGR

SEQ ID NO: 10659 - protein, 11 aa, Artificial Sequence
  Description of Artificial Sequence: Synthetic peptide
  Seed: LVVVGASGVGK (KRAS G12S)
LTVVGASGVGY

SEQ ID NO: 10660 - protein, 9 aa, Artificial Sequence
  Description of Artificial Sequence: Synthetic peptide
  Seed: LVVVGASGV (KRAS G12S)
LVVVGASGA

SEQ ID NO: 10661 - protein, 11 aa, Artificial Sequence
  Description of Artificial Sequence: Synthetic peptide
  Seed: LVVVGASGVGK (KRAS G12S)
LVVVGASGVGF

SEQ ID NO: 10662 - protein, 11 aa, Artificial Sequence
  Description of Artificial Sequence: Synthetic peptide
  Seed: LVVVGASGVGK (KRAS G12S)
LVVVGASGVGH

SEQ ID NO: 10663 - protein, 11 aa, Artificial Sequence
  Description of Artificial Sequence: Synthetic peptide
  Seed: LVVVGASGVGK (KRAS G12S)
LVVVGASGVGL

SEQ ID NO: 10664 - protein, 11 aa, Artificial Sequence
  Description of Artificial Sequence: Synthetic peptide
  Seed: LVVVGASGVGK (KRAS G12S)
LVVVGASGVGR

SEQ ID NO: 10665 - protein, 11 aa, Artificial Sequence
  Description of Artificial Sequence: Synthetic peptide
  Seed: LVVVGASGVGK (KRAS G12S)
LVVVGASGVGY

SEQ ID NO: 10666 - protein, 11 aa, Artificial Sequence
  Description of Artificial Sequence: Synthetic peptide
  Seed: LVVVGASGVGK (KRAS G12S)
LWVVGASGVGK

SEQ ID NO: 10667 - protein, 11 aa, Artificial Sequence
  Description of Artificial Sequence: Synthetic peptide
  Seed: LVVVGASGVGK (KRAS G12S)
LWVVGASGVGR

SEQ ID NO: 10668 - protein, 11 aa, Artificial Sequence
  Description of Artificial Sequence: Synthetic peptide
  Seed: LVVVGASGVGK (KRAS G12S)
LYVVGASGVGK

SEQ ID NO: 10669 - protein, 8 aa, Artificial Sequence
  Description of Artificial Sequence: Synthetic peptide
  Seed: VGASGVGK (KRAS G12S)
VAASGVGF

SEQ ID NO: 10670 - protein, 8 aa, Artificial Sequence
  Description of Artificial Sequence: Synthetic peptide
  Seed: VGASGVGK (KRAS G12S)
VAASGVGH

SEQ ID NO: 10671 - protein, 8 aa, Artificial Sequence
  Description of Artificial Sequence: Synthetic peptide
  Seed: VGASGVGK (KRAS G12S)
VAASGVGI

SEQ ID NO: 10672 - protein, 8 aa, Artificial Sequence
  Description of Artificial Sequence: Synthetic peptide
  Seed: VGASGVGK (KRAS G12S)
VAASGVGK

SEQ ID NO: 10673 - protein, 11 aa, Artificial Sequence
  Description of Artificial Sequence: Synthetic peptide
  Seed: VGASGVGKSAL (KRAS G12S)
VAASGVGKSAA

SEQ ID NO: 10674 - protein, 11 aa, Artificial Sequence
  Description of Artificial Sequence: Synthetic peptide
  Seed: VGASGVGKSAL (KRAS G12S)
VAASGVGKSAC

SEQ ID NO: 10675 - protein, 11 aa, Artificial Sequence
  Description of Artificial Sequence: Synthetic peptide
  Seed: VGASGVGKSAL (KRAS G12S)
VAASGVGKSAF

SEQ ID NO: 10676 - protein, 11 aa, Artificial Sequence
  Description of Artificial Sequence: Synthetic peptide
  Seed: VGASGVGKSAL (KRAS G12S)
VAASGVGKSAH

SEQ ID NO: 10677 - protein, 11 aa, Artificial Sequence
  Description of Artificial Sequence: Synthetic peptide
  Seed: VGASGVGKSAL (KRAS G12S)
VAASGVGKSAI

SEQ ID NO: 10678 - protein, 11 aa, Artificial Sequence
  Description of Artificial Sequence: Synthetic peptide
  Seed: VGASGVGKSAL (KRAS G12S)
VAASGVGKSAK

SEQ ID NO: 10679 - protein, 11 aa, Artificial Sequence
  Description of Artificial Sequence: Synthetic peptide
  Seed: VGASGVGKSAL (KRAS G12S)
VAASGVGKSAL

SEQ ID NO: 10680 - protein, 11 aa, Artificial Sequence
  Description of Artificial Sequence: Synthetic peptide
  Seed: VGASGVGKSAL (KRAS G12S)
VAASGVGKSAM

SEQ ID NO: 10681 - protein, 11 aa, Artificial Sequence
  Description of Artificial Sequence: Synthetic peptide
  Seed: VGASGVGKSAL (KRAS G12S)
VAASGVGKSAQ

SEQ ID NO: 10682 - protein, 11 aa, Artificial Sequence
  Description of Artificial Sequence: Synthetic peptide
  Seed: VGASGVGKSAL (KRAS G12S)
VAASGVGKSAR

SEQ ID NO: 10683 - protein, 11 aa, Artificial Sequence
  Description of Artificial Sequence: Synthetic peptide
  Seed: VGASGVGKSAL (KRAS G12S)
VAASGVGKSAV

SEQ ID NO: 10684 - protein, 11 aa, Artificial Sequence
  Description of Artificial Sequence: Synthetic peptide
  Seed: VGASGVGKSAL (KRAS G12S)
VAASGVGKSAW

SEQ ID NO: 10685 - protein, 11 aa, Artificial Sequence
  Description of Artificial Sequence: Synthetic peptide
  Seed: VGASGVGKSAL (KRAS G12S)
VAASGVGKSAY

SEQ ID NO: 10686 - protein, 8 aa, Artificial Sequence
  Description of Artificial Sequence: Synthetic peptide
  Seed: VGASGVGK (KRAS G12S)
VAASGVGL

SEQ ID NO: 10687 - protein, 8 aa, Artificial Sequence
  Description of Artificial Sequence: Synthetic peptide
  Seed: VGASGVGK (KRAS G12S)
VAASGVGM

SEQ ID NO: 10688 - protein, 8 aa, Artificial Sequence
  Description of Artificial Sequence: Synthetic peptide
  Seed: VGASGVGK (KRAS G12S)
VAASGVGR

SEQ ID NO: 10689 - protein, 8 aa, Artificial Sequence
  Description of Artificial Sequence: Synthetic peptide
  Seed: VGASGVGK (KRAS G12S)
VAASGVGV

SEQ ID NO: 10690 - protein, 8 aa, Artificial Sequence
  Description of Artificial Sequence: Synthetic peptide
  Seed: VGASGVGK (KRAS G12S)
VAASGVGY

SEQ ID NO: 10691 - protein, 9 aa, Artificial Sequence
  Description of Artificial Sequence: Synthetic peptide
  Seed: VVGASGVGK (KRAS G12S)
VAGASGVGA

SEQ ID NO: 10692 - protein, 9 aa, Artificial Sequence
  Description of Artificial Sequence: Synthetic peptide
  Seed: VVGASGVGK (KRAS G12S)
VAGASGVGF

SEQ ID NO: 10693 - protein, 9 aa, Artificial Sequence
  Description of Artificial Sequence: Synthetic peptide
  Seed: VVGASGVGK (KRAS G12S)
VAGASGVGH

SEQ ID NO: 10694 - protein, 9 aa, Artificial Sequence
  Description of Artificial Sequence: Synthetic peptide
  Seed: VVGASGVGK (KRAS G12S)
VAGASGVGI

SEQ ID NO: 10695 - protein, 9 aa, Artificial Sequence
  Description of Artificial Sequence: Synthetic peptide
  Seed: VVGASGVGK (KRAS G12S)
VAGASGVGL

SEQ ID NO: 10696 - protein, 9 aa, Artificial Sequence
  Description of Artificial Sequence: Synthetic peptide
  Seed: VVGASGVGK (KRAS G12S)
VAGASGVGM

SEQ ID NO: 10697 - protein, 9 aa, Artificial Sequence
  Description of Artificial Sequence: Synthetic peptide
  Seed: VVGASGVGK (KRAS G12S)
VAGASGVGR

SEQ ID NO: 10698 - protein, 9 aa, Artificial Sequence
  Description of Artificial Sequence: Synthetic peptide
  Seed: VVGASGVGK (KRAS G12S)
VAGASGVGV

SEQ ID NO: 10699 - protein, 9 aa, Artificial Sequence
  Description of Artificial Sequence: Synthetic peptide
  Seed: VVGASGVGK (KRAS G12S)
VAGASGVGW

SEQ ID NO: 10700 - protein, 9 aa, Artificial Sequence
  Description of Artificial Sequence: Synthetic peptide
  Seed: VVGASGVGK (KRAS G12S)
VAGASGVGY

SEQ ID NO: 10701 - protein, 10 aa, Artificial Sequence
  Description of Artificial Sequence: Synthetic peptide
  Seed: VVVGASGVGK (KRAS G12S)
VAVGASGVGA

SEQ ID NO: 10702 - protein, 10 aa, Artificial Sequence
  Description of Artificial Sequence: Synthetic peptide
  Seed: VVVGASGVGK (KRAS G12S)
VAVGASGVGC

SEQ ID NO: 10703 - protein, 10 aa, Artificial Sequence
  Description of Artificial Sequence: Synthetic peptide
  Seed: VVVGASGVGK (KRAS G12S)
VAVGASGVGE

SEQ ID NO: 10704 - protein, 10 aa, Artificial Sequence
  Description of Artificial Sequence: Synthetic peptide
  Seed: VVVGASGVGK (KRAS G12S)
VAVGASGVGF

SEQ ID NO: 10705 - protein, 10 aa, Artificial Sequence
  Description of Artificial Sequence: Synthetic peptide
  Seed: VVVGASGVGK (KRAS G12S)
VAVGASGVGH

SEQ ID NO: 10706 - protein, 10 aa, Artificial Sequence
  Description of Artificial Sequence: Synthetic peptide
  Seed: VVVGASGVGK (KRAS G12S)
VAVGASGVGI

SEQ ID NO: 10707 - protein, 10 aa, Artificial Sequence
  Description of Artificial Sequence: Synthetic peptide
  Seed: VVVGASGVGK (KRAS G12S)
VAVGASGVGL

SEQ ID NO: 10708 - protein, 10 aa, Artificial Sequence
  Description of Artificial Sequence: Synthetic peptide
  Seed: VVVGASGVGK (KRAS G12S)
VAVGASGVGM

SEQ ID NO: 10709 - protein, 10 aa, Artificial Sequence
  Description of Artificial Sequence: Synthetic peptide
  Seed: VVVGASGVGK (KRAS G12S)
VAVGASGVGQ

SEQ ID NO: 10710 - protein, 10 aa, Artificial Sequence
  Description of Artificial Sequence: Synthetic peptide
  Seed: VVVGASGVGK (KRAS G12S)
VAVGASGVGV

SEQ ID NO: 10711 - protein, 10 aa, Artificial Sequence
  Description of Artificial Sequence: Synthetic peptide
  Seed: VVVGASGVGK (KRAS G12S)
VAVGASGVGW

SEQ ID NO: 10712 - protein, 8 aa, Artificial Sequence
  Description of Artificial Sequence: Synthetic peptide
  Seed: VGASGVGK (KRAS G12S)
VCASGVGK

SEQ ID NO: 10713 - protein, 11 aa, Artificial Sequence
  Description of Artificial Sequence: Synthetic peptide
  Seed: VGASGVGKSAL (KRAS G12S)
VCASGVGKSAF

SEQ ID NO: 10714 - protein, 11 aa, Artificial Sequence
  Description of Artificial Sequence: Synthetic peptide
  Seed: VGASGVGKSAL (KRAS G12S)
VCASGVGKSAK

SEQ ID NO: 10715 - protein, 11 aa, Artificial Sequence
  Description of Artificial Sequence: Synthetic peptide
  Seed: VGASGVGKSAL (KRAS G12S)
VCASGVGKSAL

SEQ ID NO: 10716 - protein, 11 aa, Artificial Sequence
  Description of Artificial Sequence: Synthetic peptide
  Seed: VGASGVGKSAL (KRAS G12S)
VCASGVGKSAR

SEQ ID NO: 10717 - protein, 11 aa, Artificial Sequence
  Description of Artificial Sequence: Synthetic peptide
  Seed: VGASGVGKSAL (KRAS G12S)
VCASGVGKSAY

SEQ ID NO: 10718 - protein, 9 aa, Artificial Sequence
  Description of Artificial Sequence: Synthetic peptide
  Seed: VVGASGVGK (KRAS G12S)
VCGASGVGK

SEQ ID NO: 10719 - protein, 9 aa, Artificial Sequence
  Description of Artificial Sequence: Synthetic peptide
  Seed: VVGASGVGK (KRAS G12S)
VCGASGVGR

SEQ ID NO: 10720 - protein, 9 aa, Artificial Sequence
  Description of Artificial Sequence: Synthetic peptide
  Seed: VVGASGVGK (KRAS G12S)
VCGASGVGY

SEQ ID NO: 10721 - protein, 10 aa, Artificial Sequence
  Description of Artificial Sequence: Synthetic peptide
  Seed: VVVGASGVGK (KRAS G12S)
VCVGASGVGF

SEQ ID NO: 10722 - protein, 10 aa, Artificial Sequence
  Description of Artificial Sequence: Synthetic peptide
  Seed: VVVGASGVGK (KRAS G12S)
VCVGASGVGL

SEQ ID NO: 10723 - protein, 10 aa, Artificial Sequence
  Description of Artificial Sequence: Synthetic peptide
  Seed: VVVGASGVGK (KRAS G12S)
VCVGASGVGM

SEQ ID NO: 10724 - protein, 10 aa, Artificial Sequence
  Description of Artificial Sequence: Synthetic peptide
  Seed: VVVGASGVGK (KRAS G12S)
VCVGASGVGR

SEQ ID NO: 10725 - protein, 10 aa, Artificial Sequence
  Description of Artificial Sequence: Synthetic peptide
  Seed: VVVGASGVGK (KRAS G12S)
VCVGASGVGY

SEQ ID NO: 10726 - protein, 8 aa, Artificial Sequence
  Description of Artificial Sequence: Synthetic peptide
  Seed: VGASGVGK (KRAS G12S)
VDASGVGK

SEQ ID NO: 10727 - protein, 11 aa, Artificial Sequence
  Description of Artificial Sequence: Synthetic peptide
  Seed: VGASGVGKSAL (KRAS G12S)
VDASGVGKSAK

SEQ ID NO: 10728 - protein, 11 aa, Artificial Sequence
  Description of Artificial Sequence: Synthetic peptide
  Seed: VGASGVGKSAL (KRAS G12S)
VDASGVGKSAR

SEQ ID NO: 10729 - protein, 8 aa, Artificial Sequence
  Description of Artificial Sequence: Synthetic peptide
  Seed: VGASGVGK (KRAS G12S)
VDASGVGR

SEQ ID NO: 10730 - protein, 9 aa, Artificial Sequence
  Description of Artificial Sequence: Synthetic peptide
  Seed: VVGASGVGK (KRAS G12S)
VDGASGVGK

SEQ ID NO: 10731 - protein, 9 aa, Artificial Sequence
  Description of Artificial Sequence: Synthetic peptide
  Seed: VVGASGVGK (KRAS G12S)
VDGASGVGR

SEQ ID NO: 10732 - protein, 9 aa, Artificial Sequence
  Description of Artificial Sequence: Synthetic peptide
  Seed: VVGASGVGK (KRAS G12S)
VDGASGVGY

SEQ ID NO: 10733 - protein, 10 aa, Artificial Sequence
  Description of Artificial Sequence: Synthetic peptide
  Seed: VVVGASGVGK (KRAS G12S)
VDVGASGVGY

SEQ ID NO: 10734 - protein, 8 aa, Artificial Sequence
  Description of Artificial Sequence: Synthetic peptide
  Seed: VGASGVGK (KRAS G12S)
VEASGVGK

SEQ ID NO: 10735 - protein, 11 aa, Artificial Sequence
  Description of Artificial Sequence: Synthetic peptide
  Seed: VGASGVGKSAL (KRAS G12S)
VEASGVGKSAF

SEQ ID NO: 10736 - protein, 11 aa, Artificial Sequence
  Description of Artificial Sequence: Synthetic peptide
  Seed: VGASGVGKSAL (KRAS G12S)
VEASGVGKSAK

SEQ ID NO: 10737 - protein, 11 aa, Artificial Sequence
  Description of Artificial Sequence: Synthetic peptide
  Seed: VGASGVGKSAL (KRAS G12S)
VEASGVGKSAL

SEQ ID NO: 10738 - protein, 11 aa, Artificial Sequence
  Description of Artificial Sequence: Synthetic peptide
  Seed: VGASGVGKSAL (KRAS G12S)
VEASGVGKSAR

SEQ ID NO: 10739 - protein, 11 aa, Artificial Sequence
  Description of Artificial Sequence: Synthetic peptide
  Seed: VGASGVGKSAL (KRAS G12S)
VEASGVGKSAY

SEQ ID NO: 10740 - protein, 9 aa, Artificial Sequence
  Description of Artificial Sequence: Synthetic peptide
  Seed: VVGASGVGK (KRAS G12S)
VEGASGVGK

SEQ ID NO: 10741 - protein, 9 aa, Artificial Sequence
  Description of Artificial Sequence: Synthetic peptide
  Seed: VVGASGVGK (KRAS G12S)
VEGASGVGR

SEQ ID NO: 10742 - protein, 10 aa, Artificial Sequence
  Description of Artificial Sequence: Synthetic peptide
  Seed: VVVGASGVGK (KRAS G12S)
VEVGASGVGF

SEQ ID NO: 10743 - protein, 10 aa, Artificial Sequence
  Description of Artificial Sequence: Synthetic peptide
  Seed: VVVGASGVGK (KRAS G12S)
VEVGASGVGY

SEQ ID NO: 10744 - protein, 8 aa, Artificial Sequence
  Description of Artificial Sequence: Synthetic peptide
  Seed: VGASGVGK (KRAS G12S)
VFASGVGK

SEQ ID NO: 10745 - protein, 11 aa, Artificial Sequence
  Description of Artificial Sequence: Synthetic peptide
  Seed: VGASGVGKSAL (KRAS G12S)
VFASGVGKSAK

SEQ ID NO: 10746 - protein, 11 aa, Artificial Sequence
  Description of Artificial Sequence: Synthetic peptide
  Seed: VGASGVGKSAL (KRAS G12S)
VFASGVGKSAL

SEQ ID NO: 10747 - protein, 11 aa, Artificial Sequence
  Description of Artificial Sequence: Synthetic peptide
  Seed: VGASGVGKSAL (KRAS G12S)
VFASGVGKSAR

SEQ ID NO: 10748 - protein, 8 aa, Artificial Sequence
  Description of Artificial Sequence: Synthetic peptide
  Seed: VGASGVGK (KRAS G12S)
VFASGVGR

SEQ ID NO: 10749 - protein, 9 aa, Artificial Sequence
  Description of Artificial Sequence: Synthetic peptide
  Seed: VVGASGVGK (KRAS G12S)
VFGASGVGF

SEQ ID NO: 10750 - protein, 9 aa, Artificial Sequence
  Description of Artificial Sequence: Synthetic peptide
  Seed: VVGASGVGK (KRAS G12S)
VFGASGVGK

SEQ ID NO: 10751 - protein, 9 aa, Artificial Sequence
  Description of Artificial Sequence: Synthetic peptide
  Seed: VVGASGVGK (KRAS G12S)
VFGASGVGR

SEQ ID NO: 10752 - protein, 9 aa, Artificial Sequence
  Description of Artificial Sequence: Synthetic peptide
  Seed: VVGASGVGK (KRAS G12S)
VFGASGVGY

SEQ ID NO: 10753 - protein, 10 aa, Artificial Sequence
  Description of Artificial Sequence: Synthetic peptide
  Seed: VVVGASGVGK (KRAS G12S)
VFVGASGVGF

SEQ ID NO: 10754 - protein, 10 aa, Artificial Sequence
  Description of Artificial Sequence: Synthetic peptide
  Seed: VVVGASGVGK (KRAS G12S)
VFVGASGVGY

SEQ ID NO: 10755 - protein, 11 aa, Artificial Sequence
  Description of Artificial Sequence: Synthetic peptide
  Seed: VGASGVGKSAL (KRAS G12S)
VGASGVGKSAF

SEQ ID NO: 10756 - protein, 11 aa, Artificial Sequence
  Description of Artificial Sequence: Synthetic peptide
  Seed: VGASGVGKSAL (KRAS G12S)
VGASGVGKSAH

SEQ ID NO: 10757 - protein, 11 aa, Artificial Sequence
  Description of Artificial Sequence: Synthetic peptide
  Seed: VGASGVGKSAL (KRAS G12S)
VGASGVGKSAK

SEQ ID NO: 10758 - protein, 11 aa, Artificial Sequence
  Description of Artificial Sequence: Synthetic peptide
  Seed: VGASGVGKSAL (KRAS G12S)
VGASGVGKSAM

SEQ ID NO: 10759 - protein, 11 aa, Artificial Sequence
  Description of Artificial Sequence: Synthetic peptide
  Seed: VGASGVGKSAL (KRAS G12S)
VGASGVGKSAN

SEQ ID NO: 10760 - protein, 11 aa, Artificial Sequence
  Description of Artificial Sequence: Synthetic peptide
  Seed: VGASGVGKSAL (KRAS G12S)
VGASGVGKSAR

SEQ ID NO: 10761 - protein, 11 aa, Artificial Sequence
  Description of Artificial Sequence: Synthetic peptide
  Seed: VGASGVGKSAL (KRAS G12S)
VGASGVGKSAY

SEQ ID NO: 10762 - protein, 8 aa, Artificial Sequence
  Description of Artificial Sequence: Synthetic peptide
  Seed: VGASGVGK (KRAS G12S)
VGASGVGR

SEQ ID NO: 10763 - protein, 8 aa, Artificial Sequence
  Description of Artificial Sequence: Synthetic peptide
  Seed: VGASGVGK (KRAS G12S)
VGASGVGY

SEQ ID NO: 10764 - protein, 9 aa, Artificial Sequence
  Description of Artificial Sequence: Synthetic peptide
  Seed: VVGASGVGK (KRAS G12S)
VGGASGVGF

SEQ ID NO: 10765 - protein, 9 aa, Artificial Sequence
  Description of Artificial Sequence: Synthetic peptide
  Seed: VVGASGVGK (KRAS G12S)
VGGASGVGK

SEQ ID NO: 10766 - protein, 9 aa, Artificial Sequence
  Description of Artificial Sequence: Synthetic peptide
  Seed: VVGASGVGK (KRAS G12S)
VGGASGVGM

SEQ ID NO: 10767 - protein, 9 aa, Artificial Sequence
  Description of Artificial Sequence: Synthetic peptide
  Seed: VVGASGVGK (KRAS G12S)
VGGASGVGR

SEQ ID NO: 10768 - protein, 9 aa, Artificial Sequence
  Description of Artificial Sequence: Synthetic peptide
  Seed: VVGASGVGK (KRAS G12S)
VGGASGVGY

SEQ ID NO: 10769 - protein, 10 aa, Artificial Sequence
  Description of Artificial Sequence: Synthetic peptide
  Seed: VVVGASGVGK (KRAS G12S)
VGVGASGVGF

SEQ ID NO: 10770 - protein, 10 aa, Artificial Sequence
  Description of Artificial Sequence: Synthetic peptide
  Seed: VVVGASGVGK (KRAS G12S)
VGVGASGVGH

SEQ ID NO: 10771 - protein, 10 aa, Artificial Sequence
  Description of Artificial Sequence: Synthetic peptide
  Seed: VVVGASGVGK (KRAS G12S)
VGVGASGVGL

SEQ ID NO: 10772 - protein, 10 aa, Artificial Sequence
  Description of Artificial Sequence: Synthetic peptide
  Seed: VVVGASGVGK (KRAS G12S)
VGVGASGVGM

SEQ ID NO: 10773 - protein, 10 aa, Artificial Sequence
  Description of Artificial Sequence: Synthetic peptide
  Seed: VVVGASGVGK (KRAS G12S)
VGVGASGVGQ

SEQ ID NO: 10774 - protein, 10 aa, Artificial Sequence
  Description of Artificial Sequence: Synthetic peptide
  Seed: VVVGASGVGK (KRAS G12S)
VGVGASGVGR

SEQ ID NO: 10775 - protein, 10 aa, Artificial Sequence
  Description of Artificial Sequence: Synthetic peptide
  Seed: VVVGASGVGK (KRAS G12S)
VGVGASGVGY

SEQ ID NO: 10776 - protein, 11 aa, Artificial Sequence
  Description of Artificial Sequence: Synthetic peptide
  Seed: VGASGVGKSAL (KRAS G12S)
VHASGVGKSAK

SEQ ID NO: 10777 - protein, 11 aa, Artificial Sequence
  Description of Artificial Sequence: Synthetic peptide
  Seed: VGASGVGKSAL (KRAS G12S)
VHASGVGKSAL

SEQ ID NO: 10778 - protein, 11 aa, Artificial Sequence
  Description of Artificial Sequence: Synthetic peptide
  Seed: VGASGVGKSAL (KRAS G12S)
VHASGVGKSAM

SEQ ID NO: 10779 - protein, 9 aa, Artificial Sequence
  Description of Artificial Sequence: Synthetic peptide
  Seed: VVGASGVGK (KRAS G12S)
VHGASGVGK

SEQ ID NO: 10780 - protein, 10 aa, Artificial Sequence
  Description of Artificial Sequence: Synthetic peptide
  Seed: VVVGASGVGK (KRAS G12S)
VHVGASGVGY

SEQ ID NO: 10781 - protein, 8 aa, Artificial Sequence
  Description of Artificial Sequence: Synthetic peptide
  Seed: VGASGVGK (KRAS G12S)
VIASGVGK

SEQ ID NO: 10782 - protein, 11 aa, Artificial Sequence
  Description of Artificial Sequence: Synthetic peptide
  Seed: VGASGVGKSAL (KRAS G12S)
VIASGVGKSAF

SEQ ID NO: 10783 - protein, 11 aa, Artificial Sequence
  Description of Artificial Sequence: Synthetic peptide
  Seed: VGASGVGKSAL (KRAS G12S)
VIASGVGKSAH

SEQ ID NO: 10784 - protein, 11 aa, Artificial Sequence
  Description of Artificial Sequence: Synthetic peptide
  Seed: VGASGVGKSAL (KRAS G12S)
VIASGVGKSAK

SEQ ID NO: 10785 - protein, 11 aa, Artificial Sequence
  Description of Artificial Sequence: Synthetic peptide
  Seed: VGASGVGKSAL (KRAS G12S)
VIASGVGKSAL

SEQ ID NO: 10786 - protein, 11 aa, Artificial Sequence
  Description of Artificial Sequence: Synthetic peptide
  Seed: VGASGVGKSAL (KRAS G12S)
VIASGVGKSAM

SEQ ID NO: 10787 - protein, 11 aa, Artificial Sequence
  Description of Artificial Sequence: Synthetic peptide
  Seed: VGASGVGKSAL (KRAS G12S)
VIASGVGKSAR

SEQ ID NO: 10788 - protein, 11 aa, Artificial Sequence
  Description of Artificial Sequence: Synthetic peptide
  Seed: VGASGVGKSAL (KRAS G12S)
VIASGVGKSAY

SEQ ID NO: 10789 - protein, 8 aa, Artificial Sequence
  Description of Artificial Sequence: Synthetic peptide
  Seed: VGASGVGK (KRAS G12S)
VIASGVGR

SEQ ID NO: 10790 - protein, 8 aa, Artificial Sequence
  Description of Artificial Sequence: Synthetic peptide
  Seed: VGASGVGK (KRAS G12S)
VIASGVGY

SEQ ID NO: 10791 - protein, 9 aa, Artificial Sequence
  Description of Artificial Sequence: Synthetic peptide
  Seed: VVGASGVGK (KRAS G12S)
VIGASGVGF

SEQ ID NO: 10792 - protein, 9 aa, Artificial Sequence
  Description of Artificial Sequence: Synthetic peptide
  Seed: VVGASGVGK (KRAS G12S)
VIGASGVGH

SEQ ID NO: 10793 - protein, 9 aa, Artificial Sequence
  Description of Artificial Sequence: Synthetic peptide
  Seed: VVGASGVGK (KRAS G12S)
VIGASGVGL

SEQ ID NO: 10794 - protein, 9 aa, Artificial Sequence
  Description of Artificial Sequence: Synthetic peptide
  Seed: VVGASGVGK (KRAS G12S)
VIGASGVGM

SEQ ID NO: 10795 - protein, 9 aa, Artificial Sequence
  Description of Artificial Sequence: Synthetic peptide
  Seed: VVGASGVGK (KRAS G12S)
VIGASGVGR

SEQ ID NO: 10796 - protein, 9 aa, Artificial Sequence
  Description of Artificial Sequence: Synthetic peptide
  Seed: VVGASGVGK (KRAS G12S)
VIGASGVGY

SEQ ID NO: 10797 - protein, 10 aa, Artificial Sequence
  Description of Artificial Sequence: Synthetic peptide
  Seed: VVVGASGVGK (KRAS G12S)
VIVGASGVGF

SEQ ID NO: 10798 - protein, 10 aa, Artificial Sequence
  Description of Artificial Sequence: Synthetic peptide
  Seed: VVVGASGVGK (KRAS G12S)
VIVGASGVGH

SEQ ID NO: 10799 - protein, 10 aa, Artificial Sequence
  Description of Artificial Sequence: Synthetic peptide
  Seed: VVVGASGVGK (KRAS G12S)
VIVGASGVGL

SEQ ID NO: 10800 - protein, 10 aa, Artificial Sequence
  Description of Artificial Sequence: Synthetic peptide
  Seed: VVVGASGVGK (KRAS G12S)
VIVGASGVGM

SEQ ID NO: 10801 - protein, 10 aa, Artificial Sequence
  Description of Artificial Sequence: Synthetic peptide
  Seed: VVVGASGVGK (KRAS G12S)
VIVGASGVGQ

SEQ ID NO: 10802 - protein, 10 aa, Artificial Sequence
  Description of Artificial Sequence: Synthetic peptide
  Seed: VVVGASGVGK (KRAS G12S)
VIVGASGVGY

SEQ ID NO: 10803 - protein, 10 aa, Artificial Sequence
  Description of Artificial Sequence: Synthetic peptide
  Seed: VVVGASGVGK (KRAS G12S)
VKVGASGVGR

SEQ ID NO: 10804 - protein, 10 aa, Artificial Sequence
  Description of Artificial Sequence: Synthetic peptide
  Seed: VVVGASGVGK (KRAS G12S)
VKVGASGVGY

SEQ ID NO: 10805 - protein, 8 aa, Artificial Sequence
  Description of Artificial Sequence: Synthetic peptide
  Seed: VGASGVGK (KRAS G12S)
VLASGVGK

SEQ ID NO: 10806 - protein, 11 aa, Artificial Sequence
  Description of Artificial Sequence: Synthetic peptide
  Seed: VGASGVGKSAL (KRAS G12S)
VLASGVGKSAF

SEQ ID NO: 10807 - protein, 11 aa, Artificial Sequence
  Description of Artificial Sequence: Synthetic peptide
  Seed: VGASGVGKSAL (KRAS G12S)
VLASGVGKSAH

SEQ ID NO: 10808 - protein, 11 aa, Artificial Sequence
  Description of Artificial Sequence: Synthetic peptide
  Seed: VGASGVGKSAL (KRAS G12S)
VLASGVGKSAK

SEQ ID NO: 10809 - protein, 11 aa, Artificial Sequence
  Description of Artificial Sequence: Synthetic peptide
  Seed: VGASGVGKSAL (KRAS G12S)
VLASGVGKSAL

SEQ ID NO: 10810 - protein, 11 aa, Artificial Sequence
  Description of Artificial Sequence: Synthetic peptide
  Seed: VGASGVGKSAL (KRAS G12S)
VLASGVGKSAM

SEQ ID NO: 10811 - protein, 11 aa, Artificial Sequence
  Description of Artificial Sequence: Synthetic peptide
  Seed: VGASGVGKSAL (KRAS G12S)
VLASGVGKSAR

SEQ ID NO: 10812 - protein, 11 aa, Artificial Sequence
  Description of Artificial Sequence: Synthetic peptide
  Seed: VGASGVGKSAL (KRAS G12S)
VLASGVGKSAY

SEQ ID NO: 10813 - protein, 8 aa, Artificial Sequence
  Description of Artificial Sequence: Synthetic peptide
  Seed: VGASGVGK (KRAS G12S)
VLASGVGR

SEQ ID NO: 10814 - protein, 9 aa, Artificial Sequence
  Description of Artificial Sequence: Synthetic peptide
  Seed: VVGASGVGK (KRAS G12S)
VLGASGVGF

SEQ ID NO: 10815 - protein, 9 aa, Artificial Sequence
  Description of Artificial Sequence: Synthetic peptide
  Seed: VVGASGVGK (KRAS G12S)
VLGASGVGY

SEQ ID NO: 10816 - protein, 10 aa, Artificial Sequence
  Description of Artificial Sequence: Synthetic peptide
  Seed: VVVGASGVGK (KRAS G12S)
VLVGASGVGF

SEQ ID NO: 10817 - protein, 10 aa, Artificial Sequence
  Description of Artificial Sequence: Synthetic peptide
  Seed: VVVGASGVGK (KRAS G12S)
VLVGASGVGH

SEQ ID NO: 10818 - protein, 10 aa, Artificial Sequence
  Description of Artificial Sequence: Synthetic peptide
  Seed: VVVGASGVGK (KRAS G12S)
VLVGASGVGL

SEQ ID NO: 10819 - protein, 10 aa, Artificial Sequence
  Description of Artificial Sequence: Synthetic peptide
  Seed: VVVGASGVGK (KRAS G12S)
VLVGASGVGM

SEQ ID NO: 10820 - protein, 10 aa, Artificial Sequence
  Description of Artificial Sequence: Synthetic peptide
  Seed: VVVGASGVGK (KRAS G12S)
VLVGASGVGQ

SEQ ID NO: 10821 - protein, 10 aa, Artificial Sequence
  Description of Artificial Sequence: Synthetic peptide
  Seed: VVVGASGVGK (KRAS G12S)
VLVGASGVGY

SEQ ID NO: 10822 - protein, 8 aa, Artificial Sequence
  Description of Artificial Sequence: Synthetic peptide
  Seed: VGASGVGK (KRAS G12S)
VMASGVGK

SEQ ID NO: 10823 - protein, 11 aa, Artificial Sequence
  Description of Artificial Sequence: Synthetic peptide
  Seed: VGASGVGKSAL (KRAS G12S)
VMASGVGKSAF

SEQ ID NO: 10824 - protein, 11 aa, Artificial Sequence
  Description of Artificial Sequence: Synthetic peptide
  Seed: VGASGVGKSAL (KRAS G12S)
VMASGVGKSAH

SEQ ID NO: 10825 - protein, 11 aa, Artificial Sequence
  Description of Artificial Sequence: Synthetic peptide
  Seed: VGASGVGKSAL (KRAS G12S)
VMASGVGKSAK

SEQ ID NO: 10826 - protein, 11 aa, Artificial Sequence
  Description of Artificial Sequence: Synthetic peptide
  Seed: VGASGVGKSAL (KRAS G12S)
VMASGVGKSAL

SEQ ID NO: 10827 - protein, 11 aa, Artificial Sequence
  Description of Artificial Sequence: Synthetic peptide
  Seed: VGASGVGKSAL (KRAS G12S)
VMASGVGKSAM

SEQ ID NO: 10828 - protein, 11 aa, Artificial Sequence
  Description of Artificial Sequence: Synthetic peptide
  Seed: VGASGVGKSAL (KRAS G12S)
VMASGVGKSAR

SEQ ID NO: 10829 - protein, 11 aa, Artificial Sequence
  Description of Artificial Sequence: Synthetic peptide
  Seed: VGASGVGKSAL (KRAS G12S)
VMASGVGKSAY

SEQ ID NO: 10830 - protein, 8 aa, Artificial Sequence
  Description of Artificial Sequence: Synthetic peptide
  Seed: VGASGVGK (KRAS G12S)
VMASGVGR

SEQ ID NO: 10831 - protein, 9 aa, Artificial Sequence
  Description of Artificial Sequence: Synthetic peptide
  Seed: VVGASGVGK (KRAS G12S)
VMGASGVGF

SEQ ID NO: 10832 - protein, 9 aa, Artificial Sequence
  Description of Artificial Sequence: Synthetic peptide
  Seed: VVGASGVGK (KRAS G12S)
VMGASGVGY

SEQ ID NO: 10833 - protein, 10 aa, Artificial Sequence
  Description of Artificial Sequence: Synthetic peptide
  Seed: VVVGASGVGK (KRAS G12S)
VMVGASGVGF

SEQ ID NO: 10834 - protein, 10 aa, Artificial Sequence
  Description of Artificial Sequence: Synthetic peptide
  Seed: VVVGASGVGK (KRAS G12S)
VMVGASGVGH

SEQ ID NO: 10835 - protein, 10 aa, Artificial Sequence
  Description of Artificial Sequence: Synthetic peptide
  Seed: VVVGASGVGK (KRAS G12S)
VMVGASGVGL

SEQ ID NO: 10836 - protein, 10 aa, Artificial Sequence
  Description of Artificial Sequence: Synthetic peptide
  Seed: VVVGASGVGK (KRAS G12S)
VMVGASGVGM

SEQ ID NO: 10837 - protein, 10 aa, Artificial Sequence
  Description of Artificial Sequence: Synthetic peptide
  Seed: VVVGASGVGK (KRAS G12S)
VMVGASGVGW

SEQ ID NO: 10838 - protein, 10 aa, Artificial Sequence
  Description of Artificial Sequence: Synthetic peptide
  Seed: VVVGASGVGK (KRAS G12S)
VMVGASGVGY

SEQ ID NO: 10839 - protein, 8 aa, Artificial Sequence
  Description of Artificial Sequence: Synthetic peptide
  Seed: VGASGVGK (KRAS G12S)
VNASGVGK

SEQ ID NO: 10840 - protein, 11 aa, Artificial Sequence
  Description of Artificial Sequence: Synthetic peptide
  Seed: VGASGVGKSAL (KRAS G12S)
VNASGVGKSAF

SEQ ID NO: 10841 - protein, 11 aa, Artificial Sequence
  Description of Artificial Sequence: Synthetic peptide
  Seed: VGASGVGKSAL (KRAS G12S)
VNASGVGKSAK

SEQ ID NO: 10842 - protein, 11 aa, Artificial Sequence
  Description of Artificial Sequence: Synthetic peptide
  Seed: VGASGVGKSAL (KRAS G12S)
VNASGVGKSAL

SEQ ID NO: 10843 - protein, 11 aa, Artificial Sequence
  Description of Artificial Sequence: Synthetic peptide
  Seed: VGASGVGKSAL (KRAS G12S)
VNASGVGKSAR

SEQ ID NO: 10844 - protein, 11 aa, Artificial Sequence
  Description of Artificial Sequence: Synthetic peptide
  Seed: VGASGVGKSAL (KRAS G12S)
VNASGVGKSAY

SEQ ID NO: 10845 - protein, 8 aa, Artificial Sequence
  Description of Artificial Sequence: Synthetic peptide
  Seed: VGASGVGK (KRAS G12S)
VNASGVGR

SEQ ID NO: 10846 - protein, 9 aa, Artificial Sequence
  Description of Artificial Sequence: Synthetic peptide
  Seed: VVGASGVGK (KRAS G12S)
VNGASGVGK

SEQ ID NO: 10847 - protein, 9 aa, Artificial Sequence
  Description of Artificial Sequence: Synthetic peptide
  Seed: VVGASGVGK (KRAS G12S)
VNGASGVGR

SEQ ID NO: 10848 - protein, 9 aa, Artificial Sequence
  Description of Artificial Sequence: Synthetic peptide
  Seed: VVGASGVGK (KRAS G12S)
VNGASGVGY

SEQ ID NO: 10849 - protein, 10 aa, Artificial Sequence
  Description of Artificial Sequence: Synthetic peptide
  Seed: VVVGASGVGK (KRAS G12S)
VNVGASGVGF

SEQ ID NO: 10850 - protein, 10 aa, Artificial Sequence
  Description of Artificial Sequence: Synthetic peptide
  Seed: VVVGASGVGK (KRAS G12S)
VNVGASGVGM

SEQ ID NO: 10851 - protein, 10 aa, Artificial Sequence
  Description of Artificial Sequence: Synthetic peptide
  Seed: VVVGASGVGK (KRAS G12S)
VNVGASGVGY

SEQ ID NO: 10852 - protein, 11 aa, Artificial Sequence
  Description of Artificial Sequence: Synthetic peptide
  Seed: VGASGVGKSAL (KRAS G12S)
VPASGVGKSAI

SEQ ID NO: 10853 - protein, 11 aa, Artificial Sequence
  Description of Artificial Sequence: Synthetic peptide
  Seed: VGASGVGKSAL (KRAS G12S)
VPASGVGKSAK

SEQ ID NO: 10854 - protein, 11 aa, Artificial Sequence
  Description of Artificial Sequence: Synthetic peptide
  Seed: VGASGVGKSAL (KRAS G12S)
VPASGVGKSAL

SEQ ID NO: 10855 - protein, 11 aa, Artificial Sequence
  Description of Artificial Sequence: Synthetic peptide
  Seed: VGASGVGKSAL (KRAS G12S)
VPASGVGKSAM

SEQ ID NO: 10856 - protein, 11 aa, Artificial Sequence
  Description of Artificial Sequence: Synthetic peptide
  Seed: VGASGVGKSAL (KRAS G12S)
VPASGVGKSAY

SEQ ID NO: 10857 - protein, 9 aa, Artificial Sequence
  Description of Artificial Sequence: Synthetic peptide
  Seed: VVGASGVGK (KRAS G12S)
VPGASGVGK

SEQ ID NO: 10858 - protein, 9 aa, Artificial Sequence
  Description of Artificial Sequence: Synthetic peptide
  Seed: VVGASGVGK (KRAS G12S)
VPGASGVGR

SEQ ID NO: 10859 - protein, 10 aa, Artificial Sequence
  Description of Artificial Sequence: Synthetic peptide
  Seed: VVVGASGVGK (KRAS G12S)
VPVGASGVGF

SEQ ID NO: 10860 - protein, 10 aa, Artificial Sequence
  Description of Artificial Sequence: Synthetic peptide
  Seed: VVVGASGVGK (KRAS G12S)
VPVGASGVGL

SEQ ID NO: 10861 - protein, 10 aa, Artificial Sequence
  Description of Artificial Sequence: Synthetic peptide
  Seed: VVVGASGVGK (KRAS G12S)
VPVGASGVGM

SEQ ID NO: 10862 - protein, 10 aa, Artificial Sequence
  Description of Artificial Sequence: Synthetic peptide
  Seed: VVVGASGVGK (KRAS G12S)
VPVGASGVGY

SEQ ID NO: 10863 - protein, 8 aa, Artificial Sequence
  Description of Artificial Sequence: Synthetic peptide
  Seed: VGASGVGK (KRAS G12S)
VQASGVGK

SEQ ID NO: 10864 - protein, 11 aa, Artificial Sequence
  Description of Artificial Sequence: Synthetic peptide
  Seed: VGASGVGKSAL (KRAS G12S)
VQASGVGKSAF

SEQ ID NO: 10865 - protein, 11 aa, Artificial Sequence
  Description of Artificial Sequence: Synthetic peptide
  Seed: VGASGVGKSAL (KRAS G12S)
VQASGVGKSAH

SEQ ID NO: 10866 - protein, 11 aa, Artificial Sequence
  Description of Artificial Sequence: Synthetic peptide
  Seed: VGASGVGKSAL (KRAS G12S)
VQASGVGKSAK

SEQ ID NO: 10867 - protein, 11 aa, Artificial Sequence
  Description of Artificial Sequence: Synthetic peptide
  Seed: VGASGVGKSAL (KRAS G12S)
VQASGVGKSAL

SEQ ID NO: 10868 - protein, 11 aa, Artificial Sequence
  Description of Artificial Sequence: Synthetic peptide
  Seed: VGASGVGKSAL (KRAS G12S)
VQASGVGKSAM

SEQ ID NO: 10869 - protein, 11 aa, Artificial Sequence
  Description of Artificial Sequence: Synthetic peptide
  Seed: VGASGVGKSAL (KRAS G12S)
VQASGVGKSAR

SEQ ID NO: 10870 - protein, 11 aa, Artificial Sequence
  Description of Artificial Sequence: Synthetic peptide
  Seed: VGASGVGKSAL (KRAS G12S)
VQASGVGKSAW

SEQ ID NO: 10871 - protein, 11 aa, Artificial Sequence
  Description of Artificial Sequence: Synthetic peptide
  Seed: VGASGVGKSAL (KRAS G12S)
VQASGVGKSAY

SEQ ID NO: 10872 - protein, 8 aa, Artificial Sequence
  Description of Artificial Sequence: Synthetic peptide
  Seed: VGASGVGK (KRAS G12S)
VQASGVGR

SEQ ID NO: 10873 - protein, 8 aa, Artificial Sequence
  Description of Artificial Sequence: Synthetic peptide
  Seed: VGASGVGK (KRAS G12S)
VQASGVGY

SEQ ID NO: 10874 - protein, 9 aa, Artificial Sequence
  Description of Artificial Sequence: Synthetic peptide
  Seed: VVGASGVGK (KRAS G12S)
VQGASGVGF

SEQ ID NO: 10875 - protein, 9 aa, Artificial Sequence
  Description of Artificial Sequence: Synthetic peptide
  Seed: VVGASGVGK (KRAS G12S)
VQGASGVGR

SEQ ID NO: 10876 - protein, 9 aa, Artificial Sequence
  Description of Artificial Sequence: Synthetic peptide
  Seed: VVGASGVGK (KRAS G12S)
VQGASGVGY

SEQ ID NO: 10877 - protein, 10 aa, Artificial Sequence
  Description of Artificial Sequence: Synthetic peptide
  Seed: VVVGASGVGK (KRAS G12S)
VQVGASGVGF

SEQ ID NO: 10878 - protein, 10 aa, Artificial Sequence
  Description of Artificial Sequence: Synthetic peptide
  Seed: VVVGASGVGK (KRAS G12S)
VQVGASGVGH

SEQ ID NO: 10879 - protein, 10 aa, Artificial Sequence
  Description of Artificial Sequence: Synthetic peptide
  Seed: VVVGASGVGK (KRAS G12S)
VQVGASGVGL

SEQ ID NO: 10880 - protein, 10 aa, Artificial Sequence
  Description of Artificial Sequence: Synthetic peptide
  Seed: VVVGASGVGK (KRAS G12S)
VQVGASGVGM

SEQ ID NO: 10881 - protein, 10 aa, Artificial Sequence
  Description of Artificial Sequence: Synthetic peptide
  Seed: VVVGASGVGK (KRAS G12S)
VQVGASGVGR

SEQ ID NO: 10882 - protein, 10 aa, Artificial Sequence
  Description of Artificial Sequence: Synthetic peptide
  Seed: VVVGASGVGK (KRAS G12S)
VQVGASGVGY

SEQ ID NO: 10883 - protein, 11 aa, Artificial Sequence
  Description of Artificial Sequence: Synthetic peptide
  Seed: VGASGVGKSAL (KRAS G12S)
VRASGVGKSAF

SEQ ID NO: 10884 - protein, 11 aa, Artificial Sequence
  Description of Artificial Sequence: Synthetic peptide
  Seed: VGASGVGKSAL (KRAS G12S)
VRASGVGKSAH

SEQ ID NO: 10885 - protein, 11 aa, Artificial Sequence
  Description of Artificial Sequence: Synthetic peptide
  Seed: VGASGVGKSAL (KRAS G12S)
VRASGVGKSAI

SEQ ID NO: 10886 - protein, 11 aa, Artificial Sequence
  Description of Artificial Sequence: Synthetic peptide
  Seed: VGASGVGKSAL (KRAS G12S)
VRASGVGKSAK

SEQ ID NO: 10887 - protein, 11 aa, Artificial Sequence
  Description of Artificial Sequence: Synthetic peptide
  Seed: VGASGVGKSAL (KRAS G12S)
VRASGVGKSAL

SEQ ID NO: 10888 - protein, 11 aa, Artificial Sequence
  Description of Artificial Sequence: Synthetic peptide
  Seed: VGASGVGKSAL (KRAS G12S)
VRASGVGKSAM

SEQ ID NO: 10889 - protein, 11 aa, Artificial Sequence
  Description of Artificial Sequence: Synthetic peptide
  Seed: VGASGVGKSAL (KRAS G12S)
VRASGVGKSAR

SEQ ID NO: 10890 - protein, 11 aa, Artificial Sequence
  Description of Artificial Sequence: Synthetic peptide
  Seed: VGASGVGKSAL (KRAS G12S)
VRASGVGKSAV

SEQ ID NO: 10891 - protein, 11 aa, Artificial Sequence
  Description of Artificial Sequence: Synthetic peptide
  Seed: VGASGVGKSAL (KRAS G12S)
VRASGVGKSAW

SEQ ID NO: 10892 - protein, 11 aa, Artificial Sequence
  Description of Artificial Sequence: Synthetic peptide
  Seed: VGASGVGKSAL (KRAS G12S)
VRASGVGKSAY

SEQ ID NO: 10893 - protein, 10 aa, Artificial Sequence
  Description of Artificial Sequence: Synthetic peptide
  Seed: VVVGASGVGK (KRAS G12S)
VRVGASGVGF

SEQ ID NO: 10894 - protein, 10 aa, Artificial Sequence
  Description of Artificial Sequence: Synthetic peptide
  Seed: VVVGASGVGK (KRAS G12S)
VRVGASGVGI

SEQ ID NO: 10895 - protein, 10 aa, Artificial Sequence
  Description of Artificial Sequence: Synthetic peptide
  Seed: VVVGASGVGK (KRAS G12S)
VRVGASGVGL

SEQ ID NO: 10896 - protein, 10 aa, Artificial Sequence
  Description of Artificial Sequence: Synthetic peptide
  Seed: VVVGASGVGK (KRAS G12S)
VRVGASGVGM

SEQ ID NO: 10897 - protein, 10 aa, Artificial Sequence
  Description of Artificial Sequence: Synthetic peptide
  Seed: VVVGASGVGK (KRAS G12S)
VRVGASGVGR

SEQ ID NO: 10898 - protein, 10 aa, Artificial Sequence
  Description of Artificial Sequence: Synthetic peptide
  Seed: VVVGASGVGK (KRAS G12S)
VRVGASGVGV

SEQ ID NO: 10899 - protein, 10 aa, Artificial Sequence
  Description of Artificial Sequence: Synthetic peptide
  Seed: VVVGASGVGK (KRAS G12S)
VRVGASGVGY

SEQ ID NO: 10900 - protein, 8 aa, Artificial Sequence
  Description of Artificial Sequence: Synthetic peptide
  Seed: VGASGVGK (KRAS G12S)
VSASGVGF

SEQ ID NO: 10901 - protein, 8 aa, Artificial Sequence
  Description of Artificial Sequence: Synthetic peptide
  Seed: VGASGVGK (KRAS G12S)
VSASGVGK

SEQ ID NO: 10902 - protein, 11 aa, Artificial Sequence
  Description of Artificial Sequence: Synthetic peptide
  Seed: VGASGVGKSAL (KRAS G12S)
VSASGVGKSAF

SEQ ID NO: 10903 - protein, 11 aa, Artificial Sequence
  Description of Artificial Sequence: Synthetic peptide
  Seed: VGASGVGKSAL (KRAS G12S)
VSASGVGKSAH

SEQ ID NO: 10904 - protein, 11 aa, Artificial Sequence
  Description of Artificial Sequence: Synthetic peptide
  Seed: VGASGVGKSAL (KRAS G12S)
VSASGVGKSAI

SEQ ID NO: 10905 - protein, 11 aa, Artificial Sequence
  Description of Artificial Sequence: Synthetic peptide
  Seed: VGASGVGKSAL (KRAS G12S)
VSASGVGKSAK

SEQ ID NO: 10906 - protein, 11 aa, Artificial Sequence
  Description of Artificial Sequence: Synthetic peptide
  Seed: VGASGVGKSAL (KRAS G12S)
VSASGVGKSAL

SEQ ID NO: 10907 - protein, 11 aa, Artificial Sequence
  Description of Artificial Sequence: Synthetic peptide
  Seed: VGASGVGKSAL (KRAS G12S)
VSASGVGKSAM

SEQ ID NO: 10908 - protein, 11 aa, Artificial Sequence
  Description of Artificial Sequence: Synthetic peptide
  Seed: VGASGVGKSAL (KRAS G12S)
VSASGVGKSAR

SEQ ID NO: 10909 - protein, 11 aa, Artificial Sequence
  Description of Artificial Sequence: Synthetic peptide
  Seed: VGASGVGKSAL (KRAS G12S)
VSASGVGKSAV

SEQ ID NO: 10910 - protein, 11 aa, Artificial Sequence
  Description of Artificial Sequence: Synthetic peptide
  Seed: VGASGVGKSAL (KRAS G12S)
VSASGVGKSAW

SEQ ID NO: 10911 - protein, 11 aa, Artificial Sequence
  Description of Artificial Sequence: Synthetic peptide
  Seed: VGASGVGKSAL (KRAS G12S)
VSASGVGKSAY

SEQ ID NO: 10912 - protein, 8 aa, Artificial Sequence
  Description of Artificial Sequence: Synthetic peptide
  Seed: VGASGVGK (KRAS G12S)
VSASGVGL

SEQ ID NO: 10913 - protein, 8 aa, Artificial Sequence
  Description of Artificial Sequence: Synthetic peptide
  Seed: VGASGVGK (KRAS G12S)
VSASGVGM

SEQ ID NO: 10914 - protein, 8 aa, Artificial Sequence
  Description of Artificial Sequence: Synthetic peptide
  Seed: VGASGVGK (KRAS G12S)
VSASGVGR

SEQ ID NO: 10915 - protein, 8 aa, Artificial Sequence
  Description of Artificial Sequence: Synthetic peptide
  Seed: VGASGVGK (KRAS G12S)
VSASGVGY

SEQ ID NO: 10916 - protein, 9 aa, Artificial Sequence
  Description of Artificial Sequence: Synthetic peptide
  Seed: VVGASGVGK (KRAS G12S)
VSGASGVGF

SEQ ID NO: 10917 - protein, 9 aa, Artificial Sequence
  Description of Artificial Sequence: Synthetic peptide
  Seed: VVGASGVGK (KRAS G12S)
VSGASGVGH

SEQ ID NO: 10918 - protein, 9 aa, Artificial Sequence
  Description of Artificial Sequence: Synthetic peptide
  Seed: VVGASGVGK (KRAS G12S)
VSGASGVGL

SEQ ID NO: 10919 - protein, 9 aa, Artificial Sequence
  Description of Artificial Sequence: Synthetic peptide
  Seed: VVGASGVGK (KRAS G12S)
VSGASGVGM

SEQ ID NO: 10920 - protein, 9 aa, Artificial Sequence
  Description of Artificial Sequence: Synthetic peptide
  Seed: VVGASGVGK (KRAS G12S)
VSGASGVGR

SEQ ID NO: 10921 - protein, 9 aa, Artificial Sequence
  Description of Artificial Sequence: Synthetic peptide
  Seed: VVGASGVGK (KRAS G12S)
VSGASGVGY

SEQ ID NO: 10922 - protein, 10 aa, Artificial Sequence
  Description of Artificial Sequence: Synthetic peptide
  Seed: VVVGASGVGK (KRAS G12S)
VSVGASGVGF

SEQ ID NO: 10923 - protein, 10 aa, Artificial Sequence
  Description of Artificial Sequence: Synthetic peptide
  Seed: VVVGASGVGK (KRAS G12S)
VSVGASGVGH

SEQ ID NO: 10924 - protein, 10 aa, Artificial Sequence
  Description of Artificial Sequence: Synthetic peptide
  Seed: VVVGASGVGK (KRAS G12S)
VSVGASGVGI

SEQ ID NO: 10925 - protein, 10 aa, Artificial Sequence
  Description of Artificial Sequence: Synthetic peptide
  Seed: VVVGASGVGK (KRAS G12S)
VSVGASGVGL

SEQ ID NO: 10926 - protein, 10 aa, Artificial Sequence
  Description of Artificial Sequence: Synthetic peptide
  Seed: VVVGASGVGK (KRAS G12S)
VSVGASGVGM

SEQ ID NO: 10927 - protein, 10 aa, Artificial Sequence
  Description of Artificial Sequence: Synthetic peptide
  Seed: VVVGASGVGK (KRAS G12S)
VSVGASGVGQ

SEQ ID NO: 10928 - protein, 10 aa, Artificial Sequence
  Description of Artificial Sequence: Synthetic peptide
  Seed: VVVGASGVGK (KRAS G12S)
VSVGASGVGV

SEQ ID NO: 10929 - protein, 10 aa, Artificial Sequence
  Description of Artificial Sequence: Synthetic peptide
  Seed: VVVGASGVGK (KRAS G12S)
VSVGASGVGW

SEQ ID NO: 10930 - protein, 10 aa, Artificial Sequence
  Description of Artificial Sequence: Synthetic peptide
  Seed: VVVGASGVGK (KRAS G12S)
VSVGASGVGY

SEQ ID NO: 10931 - protein, 8 aa, Artificial Sequence
  Description of Artificial Sequence: Synthetic peptide
  Seed: VGASGVGK (KRAS G12S)
VTASGVGF

SEQ ID NO: 10932 - protein, 8 aa, Artificial Sequence
  Description of Artificial Sequence: Synthetic peptide
  Seed: VGASGVGK (KRAS G12S)
VTASGVGK

SEQ ID NO: 10933 - protein, 11 aa, Artificial Sequence
  Description of Artificial Sequence: Synthetic peptide
  Seed: VGASGVGKSAL (KRAS G12S)
VTASGVGKSAF

SEQ ID NO: 10934 - protein, 11 aa, Artificial Sequence
  Description of Artificial Sequence: Synthetic peptide
  Seed: VGASGVGKSAL (KRAS G12S)
VTASGVGKSAH

SEQ ID NO: 10935 - protein, 11 aa, Artificial Sequence
  Description of Artificial Sequence: Synthetic peptide
  Seed: VGASGVGKSAL (KRAS G12S)
VTASGVGKSAI

SEQ ID NO: 10936 - protein, 11 aa, Artificial Sequence
  Description of Artificial Sequence: Synthetic peptide
  Seed: VGASGVGKSAL (KRAS G12S)
VTASGVGKSAK

SEQ ID NO: 10937 - protein, 11 aa, Artificial Sequence
  Description of Artificial Sequence: Synthetic peptide
  Seed: VGASGVGKSAL (KRAS G12S)
VTASGVGKSAL

SEQ ID NO: 10938 - protein, 11 aa, Artificial Sequence
  Description of Artificial Sequence: Synthetic peptide
  Seed: VGASGVGKSAL (KRAS G12S)
VTASGVGKSAM

SEQ ID NO: 10939 - protein, 11 aa, Artificial Sequence
  Description of Artificial Sequence: Synthetic peptide
  Seed: VGASGVGKSAL (KRAS G12S)
VTASGVGKSAR

SEQ ID NO: 10940 - protein, 11 aa, Artificial Sequence
  Description of Artificial Sequence: Synthetic peptide
  Seed: VGASGVGKSAL (KRAS G12S)
VTASGVGKSAV

SEQ ID NO: 10941 - protein, 11 aa, Artificial Sequence
  Description of Artificial Sequence: Synthetic peptide
  Seed: VGASGVGKSAL (KRAS G12S)
VTASGVGKSAW

SEQ ID NO: 10942 - protein, 11 aa, Artificial Sequence
  Description of Artificial Sequence: Synthetic peptide
  Seed: VGASGVGKSAL (KRAS G12S)
VTASGVGKSAY

SEQ ID NO: 10943 - protein, 8 aa, Artificial Sequence
  Description of Artificial Sequence: Synthetic peptide
  Seed: VGASGVGK (KRAS G12S)
VTASGVGL

SEQ ID NO: 10944 - protein, 8 aa, Artificial Sequence
  Description of Artificial Sequence: Synthetic peptide
  Seed: VGASGVGK (KRAS G12S)
VTASGVGM

SEQ ID NO: 10945 - protein, 8 aa, Artificial Sequence
  Description of Artificial Sequence: Synthetic peptide
  Seed: VGASGVGK (KRAS G12S)
VTASGVGR

SEQ ID NO: 10946 - protein, 8 aa, Artificial Sequence
  Description of Artificial Sequence: Synthetic peptide
  Seed: VGASGVGK (KRAS G12S)
VTASGVGY

SEQ ID NO: 10947 - protein, 9 aa, Artificial Sequence
  Description of Artificial Sequence: Synthetic peptide
  Seed: VVGASGVGK (KRAS G12S)
VTGASGVGF

SEQ ID NO: 10948 - protein, 9 aa, Artificial Sequence
  Description of Artificial Sequence: Synthetic peptide
  Seed: VVGASGVGK (KRAS G12S)
VTGASGVGH

SEQ ID NO: 10949 - protein, 9 aa, Artificial Sequence
  Description of Artificial Sequence: Synthetic peptide
  Seed: VVGASGVGK (KRAS G12S)
VTGASGVGL

SEQ ID NO: 10950 - protein, 9 aa, Artificial Sequence
  Description of Artificial Sequence: Synthetic peptide
  Seed: VVGASGVGK (KRAS G12S)
VTGASGVGM

SEQ ID NO: 10951 - protein, 9 aa, Artificial Sequence
  Description of Artificial Sequence: Synthetic peptide
  Seed: VVGASGVGK (KRAS G12S)
VTGASGVGR

SEQ ID NO: 10952 - protein, 9 aa, Artificial Sequence
  Description of Artificial Sequence: Synthetic peptide
  Seed: VVGASGVGK (KRAS G12S)
VTGASGVGY

SEQ ID NO: 10953 - protein, 10 aa, Artificial Sequence
  Description of Artificial Sequence: Synthetic peptide
  Seed: VVVGASGVGK (KRAS G12S)
VTVGASGVGF

SEQ ID NO: 10954 - protein, 10 aa, Artificial Sequence
  Description of Artificial Sequence: Synthetic peptide
  Seed: VVVGASGVGK (KRAS G12S)
VTVGASGVGH

SEQ ID NO: 10955 - protein, 10 aa, Artificial Sequence
  Description of Artificial Sequence: Synthetic peptide
  Seed: VVVGASGVGK (KRAS G12S)
VTVGASGVGI

SEQ ID NO: 10956 - protein, 10 aa, Artificial Sequence
  Description of Artificial Sequence: Synthetic peptide
  Seed: VVVGASGVGK (KRAS G12S)
VTVGASGVGL

SEQ ID NO: 10957 - protein, 10 aa, Artificial Sequence
  Description of Artificial Sequence: Synthetic peptide
  Seed: VVVGASGVGK (KRAS G12S)
VTVGASGVGM

SEQ ID NO: 10958 - protein, 10 aa, Artificial Sequence
  Description of Artificial Sequence: Synthetic peptide
  Seed: VVVGASGVGK (KRAS G12S)
VTVGASGVGQ

SEQ ID NO: 10959 - protein, 10 aa, Artificial Sequence
  Description of Artificial Sequence: Synthetic peptide
  Seed: VVVGASGVGK (KRAS G12S)
VTVGASGVGV

SEQ ID NO: 10960 - protein, 10 aa, Artificial Sequence
  Description of Artificial Sequence: Synthetic peptide
  Seed: VVVGASGVGK (KRAS G12S)
VTVGASGVGW

SEQ ID NO: 10961 - protein, 8 aa, Artificial Sequence
  Description of Artificial Sequence: Synthetic peptide
  Seed: VGASGVGK (KRAS G12S)
VVASGVGF

SEQ ID NO: 10962 - protein, 8 aa, Artificial Sequence
  Description of Artificial Sequence: Synthetic peptide
  Seed: VGASGVGK (KRAS G12S)
VVASGVGK

SEQ ID NO: 10963 - protein, 11 aa, Artificial Sequence
  Description of Artificial Sequence: Synthetic peptide
  Seed: VGASGVGKSAL (KRAS G12S)
VVASGVGKSAF

SEQ ID NO: 10964 - protein, 11 aa, Artificial Sequence
  Description of Artificial Sequence: Synthetic peptide
  Seed: VGASGVGKSAL (KRAS G12S)
VVASGVGKSAH

SEQ ID NO: 10965 - protein, 11 aa, Artificial Sequence
  Description of Artificial Sequence: Synthetic peptide
  Seed: VGASGVGKSAL (KRAS G12S)
VVASGVGKSAI

SEQ ID NO: 10966 - protein, 11 aa, Artificial Sequence
  Description of Artificial Sequence: Synthetic peptide
  Seed: VGASGVGKSAL (KRAS G12S)
VVASGVGKSAK

SEQ ID NO: 10967 - protein, 11 aa, Artificial Sequence
  Description of Artificial Sequence: Synthetic peptide
  Seed: VGASGVGKSAL (KRAS G12S)
VVASGVGKSAL

SEQ ID NO: 10968 - protein, 11 aa, Artificial Sequence
  Description of Artificial Sequence: Synthetic peptide
  Seed: VGASGVGKSAL (KRAS G12S)
VVASGVGKSAM

SEQ ID NO: 10969 - protein, 11 aa, Artificial Sequence
  Description of Artificial Sequence: Synthetic peptide
  Seed: VGASGVGKSAL (KRAS G12S)
VVASGVGKSAR

SEQ ID NO: 10970 - protein, 11 aa, Artificial Sequence
  Description of Artificial Sequence: Synthetic peptide
  Seed: VGASGVGKSAL (KRAS G12S)
VVASGVGKSAW

SEQ ID NO: 10971 - protein, 11 aa, Artificial Sequence
  Description of Artificial Sequence: Synthetic peptide
  Seed: VGASGVGKSAL (KRAS G12S)
VVASGVGKSAY

SEQ ID NO: 10972 - protein, 8 aa, Artificial Sequence
  Description of Artificial Sequence: Synthetic peptide
  Seed: VGASGVGK (KRAS G12S)
VVASGVGL

SEQ ID NO: 10973 - protein, 8 aa, Artificial Sequence
  Description of Artificial Sequence: Synthetic peptide
  Seed: VGASGVGK (KRAS G12S)
VVASGVGR

SEQ ID NO: 10974 - protein, 8 aa, Artificial Sequence
  Description of Artificial Sequence: Synthetic peptide
  Seed: VGASGVGK (KRAS G12S)
VVASGVGY

SEQ ID NO: 10975 - protein, 9 aa, Artificial Sequence
  Description of Artificial Sequence: Synthetic peptide
  Seed: VVGASGVGK (KRAS G12S)
VVGASGVGF

SEQ ID NO: 10976 - protein, 9 aa, Artificial Sequence
  Description of Artificial Sequence: Synthetic peptide
  Seed: VVGASGVGK (KRAS G12S)
VVGASGVGH

SEQ ID NO: 10977 - protein, 9 aa, Artificial Sequence
  Description of Artificial Sequence: Synthetic peptide
  Seed: VVGASGVGK (KRAS G12S)
VVGASGVGL

SEQ ID NO: 10978 - protein, 9 aa, Artificial Sequence
  Description of Artificial Sequence: Synthetic peptide
  Seed: VVGASGVGK (KRAS G12S)
VVGASGVGM

SEQ ID NO: 10979 - protein, 9 aa, Artificial Sequence
  Description of Artificial Sequence: Synthetic peptide
  Seed: VVGASGVGK (KRAS G12S)
VVGASGVGY

SEQ ID NO: 10980 - protein, 10 aa, Artificial Sequence
  Description of Artificial Sequence: Synthetic peptide
  Seed: VVVGASGVGK (KRAS G12S)
VVVGASGVGF

SEQ ID NO: 10981 - protein, 10 aa, Artificial Sequence
  Description of Artificial Sequence: Synthetic peptide
  Seed: VVVGASGVGK (KRAS G12S)
VVVGASGVGH

SEQ ID NO: 10982 - protein, 10 aa, Artificial Sequence
  Description of Artificial Sequence: Synthetic peptide
  Seed: VVVGASGVGK (KRAS G12S)
VVVGASGVGL

SEQ ID NO: 10983 - protein, 10 aa, Artificial Sequence
  Description of Artificial Sequence: Synthetic peptide
  Seed: VVVGASGVGK (KRAS G12S)
VVVGASGVGM

SEQ ID NO: 10984 - protein, 10 aa, Artificial Sequence
  Description of Artificial Sequence: Synthetic peptide
  Seed: VVVGASGVGK (KRAS G12S)
VVVGASGVGQ

SEQ ID NO: 10985 - protein, 10 aa, Artificial Sequence
  Description of Artificial Sequence: Synthetic peptide
  Seed: VVVGASGVGK (KRAS G12S)
VVVGASGVGW

SEQ ID NO: 10986 - protein, 10 aa, Artificial Sequence
  Description of Artificial Sequence: Synthetic peptide
  Seed: VVVGASGVGK (KRAS G12S)
VVVGASGVGY

SEQ ID NO: 10987 - protein, 11 aa, Artificial Sequence
  Description of Artificial Sequence: Synthetic peptide
  Seed: VGASGVGKSAL (KRAS G12S)
VWASGVGKSAK

SEQ ID NO: 10988 - protein, 9 aa, Artificial Sequence
  Description of Artificial Sequence: Synthetic peptide
  Seed: VVGASGVGK (KRAS G12S)
VWGASGVGK

SEQ ID NO: 10989 - protein, 9 aa, Artificial Sequence
  Description of Artificial Sequence: Synthetic peptide
  Seed: VVGASGVGK (KRAS G12S)
VWGASGVGR

SEQ ID NO: 10990 - protein, 10 aa, Artificial Sequence
  Description of Artificial Sequence: Synthetic peptide
  Seed: VVVGASGVGK (KRAS G12S)
VWVGASGVGF

SEQ ID NO: 10991 - protein, 10 aa, Artificial Sequence
  Description of Artificial Sequence: Synthetic peptide
  Seed: VVVGASGVGK (KRAS G12S)
VWVGASGVGY

SEQ ID NO: 10992 - protein, 11 aa, Artificial Sequence
  Description of Artificial Sequence: Synthetic peptide
  Seed: VGASGVGKSAL (KRAS G12S)
VYASGVGKSAK

SEQ ID NO: 10993 - protein, 11 aa, Artificial Sequence
  Description of Artificial Sequence: Synthetic peptide
  Seed: VGASGVGKSAL (KRAS G12S)
VYASGVGKSAL

SEQ ID NO: 10994 - protein, 9 aa, Artificial Sequence
  Description of Artificial Sequence: Synthetic peptide
  Seed: VVGASGVGK (KRAS G12S)
VYGASGVGK

SEQ ID NO: 10995 - protein, 9 aa, Artificial Sequence
  Description of Artificial Sequence: Synthetic peptide
  Seed: VVGASGVGK (KRAS G12S)
VYGASGVGR

SEQ ID NO: 10996 - protein, 10 aa, Artificial Sequence
  Description of Artificial Sequence: Synthetic peptide
  Seed: VVVGASGVGK (KRAS G12S)
VYVGASGVGF

SEQ ID NO: 10997 - protein, 10 aa, Artificial Sequence
  Description of Artificial Sequence: Synthetic peptide
  Seed: VVVGASGVGK (KRAS G12S)
VYVGASGVGL

SEQ ID NO: 10998 - protein, 10 aa, Artificial Sequence
  Description of Artificial Sequence: Synthetic peptide
  Seed: VVVGASGVGK (KRAS G12S)
VYVGASGVGM

SEQ ID NO: 10999 - protein, 10 aa, Artificial Sequence
  Description of Artificial Sequence: Synthetic peptide
  Seed: VVVGASGVGK (KRAS G12S)
VYVGASGVGY

SEQ ID NO: 11000 - protein, 10 aa, Homo sapiens
  Native (KRAS G12S)
KLVVVGASGV

SEQ ID NO: 11001 - protein, 9 aa, Homo sapiens
  Native (KRAS G12S)
LVVVGASGV

SEQ ID NO: 11002 - protein, 9 aa, Homo sapiens
  Native (KRAS G12S)
VVGASGVGK

SEQ ID NO: 11003 - protein, 10 aa, Homo sapiens
  Native (KRAS G12S)
VVVGASGVGK

SEQ ID NO: 11004 - protein, 9 aa, Homo sapiens
  Native (KRAS G12S)
GASGVGKSA

SEQ ID NO: 11005 - protein, 10 aa, Homo sapiens
  Native (KRAS G12S)
GASGVGKSAL

SEQ ID NO: 11006 - protein, 11 aa, Homo sapiens
  Native (KRAS G12S)
LVVVGASGVGK

SEQ ID NO: 11007 - protein, 8 aa, Homo sapiens
  Native (KRAS G12S)
VGASGVGK

SEQ ID NO: 11008 - protein, 11 aa, Homo sapiens
  Native (KRAS G12S)
VGASGVGKSAL

SEQ ID NO: 11009 - protein, 10 aa, Artificial Sequence
  Description of Artificial Sequence: Synthetic peptide
  Seed: KLVVVGAVGV (KRAS G12V)
KAVVVGAVGV

SEQ ID NO: 11010 - protein, 10 aa, Artificial Sequence
  Description of Artificial Sequence: Synthetic peptide
  Seed: KLVVVGAVGV (KRAS G12V)
KFVVVGAVGV

SEQ ID NO: 11011 - protein, 10 aa, Artificial Sequence
  Description of Artificial Sequence: Synthetic peptide
  Seed: KLVVVGAVGV (KRAS G12V)
KIVVVGAVGV

SEQ ID NO: 11012 - protein, 10 aa, Artificial Sequence
  Description of Artificial Sequence: Synthetic peptide
  Seed: KLVVVGAVGV (KRAS G12V)
KLVVVGAVGA

SEQ ID NO: 11013 - protein, 10 aa, Artificial Sequence
  Description of Artificial Sequence: Synthetic peptide
  Seed: KLVVVGAVGV (KRAS G12V)
KLVVVGAVGI

SEQ ID NO: 11014 - protein, 10 aa, Artificial Sequence
  Description of Artificial Sequence: Synthetic peptide
  Seed: KLVVVGAVGV (KRAS G12V)
KLVVVGAVGL

SEQ ID NO: 11015 - protein, 10 aa, Artificial Sequence
  Description of Artificial Sequence: Synthetic peptide
  Seed: KLVVVGAVGV (KRAS G12V)
KMVVVGAVGA

SEQ ID NO: 11016 - protein, 10 aa, Artificial Sequence
  Description of Artificial Sequence: Synthetic peptide
  Seed: KLVVVGAVGV (KRAS G12V)
KMVVVGAVGI

SEQ ID NO: 11017 - protein, 10 aa, Artificial Sequence
  Description of Artificial Sequence: Synthetic peptide
  Seed: KLVVVGAVGV (KRAS G12V)
KMVVVGAVGL

SEQ ID NO: 11018 - protein, 10 aa, Artificial Sequence
  Description of Artificial Sequence: Synthetic peptide
  Seed: KLVVVGAVGV (KRAS G12V)
KMVVVGAVGV

SEQ ID NO: 11019 - protein, 10 aa, Artificial Sequence
  Description of Artificial Sequence: Synthetic peptide
  Seed: KLVVVGAVGV (KRAS G12V)
KQVVVGAVGI

SEQ ID NO: 11020 - protein, 10 aa, Artificial Sequence
  Description of Artificial Sequence: Synthetic peptide
  Seed: KLVVVGAVGV (KRAS G12V)
KQVVVGAVGL

SEQ ID NO: 11021 - protein, 10 aa, Artificial Sequence
  Description of Artificial Sequence: Synthetic peptide
  Seed: KLVVVGAVGV (KRAS G12V)
KQVVVGAVGV

SEQ ID NO: 11022 - protein, 10 aa, Artificial Sequence
  Description of Artificial Sequence: Synthetic peptide
  Seed: KLVVVGAVGV (KRAS G12V)
KSVVVGAVGV

SEQ ID NO: 11023 - protein, 10 aa, Artificial Sequence
  Description of Artificial Sequence: Synthetic peptide
  Seed: KLVVVGAVGV (KRAS G12V)
KTVVVGAVGV

SEQ ID NO: 11024 - protein, 10 aa, Artificial Sequence
  Description of Artificial Sequence: Synthetic peptide
  Seed: KLVVVGAVGV (KRAS G12V)
KVVVVGAVGV

SEQ ID NO: 11025 - protein, 10 aa, Artificial Sequence
  Description of Artificial Sequence: Synthetic peptide
  Seed: KLVVVGAVGV (KRAS G12V)
KYVVVGAVGV

SEQ ID NO: 11026 - protein, 9 aa, Artificial Sequence
  Description of Artificial Sequence: Synthetic peptide
  Seed: LVVVGAVGV (KRAS G12V)
LAVVGAVGV

SEQ ID NO: 11027 - protein, 9 aa, Artificial Sequence
  Description of Artificial Sequence: Synthetic peptide
  Seed: LVVVGAVGV (KRAS G12V)
LIVVGAVGI

SEQ ID NO: 11028 - protein, 9 aa, Artificial Sequence
  Description of Artificial Sequence: Synthetic peptide
  Seed: LVVVGAVGV (KRAS G12V)
LIVVGAVGL

SEQ ID NO: 11029 - protein, 9 aa, Artificial Sequence
  Description of Artificial Sequence: Synthetic peptide
  Seed: LVVVGAVGV (KRAS G12V)
LIVVGAVGV

SEQ ID NO: 11030 - protein, 9 aa, Artificial Sequence
  Description of Artificial Sequence: Synthetic peptide
  Seed: LVVVGAVGV (KRAS G12V)
LLVVGAVGA

SEQ ID NO: 11031 - protein, 9 aa, Artificial Sequence
  Description of Artificial Sequence: Synthetic peptide
  Seed: LVVVGAVGV (KRAS G12V)
LLVVGAVGI

SEQ ID NO: 11032 - protein, 9 aa, Artificial Sequence
  Description of Artificial Sequence: Synthetic peptide
  Seed: LVVVGAVGV (KRAS G12V)
LLVVGAVGL

SEQ ID NO: 11033 - protein, 9 aa, Artificial Sequence
  Description of Artificial Sequence: Synthetic peptide
  Seed: LVVVGAVGV (KRAS G12V)
LLVVGAVGM

SEQ ID NO: 11034 - protein, 9 aa, Artificial Sequence
  Description of Artificial Sequence: Synthetic peptide
  Seed: LVVVGAVGV (KRAS G12V)
LLVVGAVGV

SEQ ID NO: 11035 - protein, 9 aa, Artificial Sequence
  Description of Artificial Sequence: Synthetic peptide
  Seed: LVVVGAVGV (KRAS G12V)
LMVVGAVGA

SEQ ID NO: 11036 - protein, 9 aa, Artificial Sequence
  Description of Artificial Sequence: Synthetic peptide
  Seed: LVVVGAVGV (KRAS G12V)
LMVVGAVGI

SEQ ID NO: 11037 - protein, 9 aa, Artificial Sequence
  Description of Artificial Sequence: Synthetic peptide
  Seed: LVVVGAVGV (KRAS G12V)
LMVVGAVGL

SEQ ID NO: 11038 - protein, 9 aa, Artificial Sequence
  Description of Artificial Sequence: Synthetic peptide
  Seed: LVVVGAVGV (KRAS G12V)
LMVVGAVGM

SEQ ID NO: 11039 - protein, 9 aa, Artificial Sequence
  Description of Artificial Sequence: Synthetic peptide
  Seed: LVVVGAVGV (KRAS G12V)
LQVVGAVGA

SEQ ID NO: 11040 - protein, 9 aa, Artificial Sequence
  Description of Artificial Sequence: Synthetic peptide
  Seed: LVVVGAVGV (KRAS G12V)
LQVVGAVGI

SEQ ID NO: 11041 - protein, 9 aa, Artificial Sequence
  Description of Artificial Sequence: Synthetic peptide
  Seed: LVVVGAVGV (KRAS G12V)
LQVVGAVGL

SEQ ID NO: 11042 - protein, 9 aa, Artificial Sequence
  Description of Artificial Sequence: Synthetic peptide
  Seed: LVVVGAVGV (KRAS G12V)
LQVVGAVGM

SEQ ID NO: 11043 - protein, 9 aa, Artificial Sequence
  Description of Artificial Sequence: Synthetic peptide
  Seed: LVVVGAVGV (KRAS G12V)
LQVVGAVGV

SEQ ID NO: 11044 - protein, 9 aa, Artificial Sequence
  Description of Artificial Sequence: Synthetic peptide
  Seed: LVVVGAVGV (KRAS G12V)
LSVVGAVGV

SEQ ID NO: 11045 - protein, 9 aa, Artificial Sequence
  Description of Artificial Sequence: Synthetic peptide
  Seed: LVVVGAVGV (KRAS G12V)
LTVVGAVGA

SEQ ID NO: 11046 - protein, 9 aa, Artificial Sequence
  Description of Artificial Sequence: Synthetic peptide
  Seed: LVVVGAVGV (KRAS G12V)
LTVVGAVGI

SEQ ID NO: 11047 - protein, 9 aa, Artificial Sequence
  Description of Artificial Sequence: Synthetic peptide
  Seed: LVVVGAVGV (KRAS G12V)
LTVVGAVGL

SEQ ID NO: 11048 - protein, 9 aa, Artificial Sequence
  Description of Artificial Sequence: Synthetic peptide
  Seed: LVVVGAVGV (KRAS G12V)
LTVVGAVGM

SEQ ID NO: 11049 - protein, 9 aa, Artificial Sequence
  Description of Artificial Sequence: Synthetic peptide
  Seed: LVVVGAVGV (KRAS G12V)
LVVVGAVGI

SEQ ID NO: 11050 - protein, 9 aa, Artificial Sequence
  Description of Artificial Sequence: Synthetic peptide
  Seed: LVVVGAVGV (KRAS G12V)
LVVVGAVGL

SEQ ID NO: 11051 - protein, 9 aa, Artificial Sequence
  Description of Artificial Sequence: Synthetic peptide
  Seed: VVGAVGVGK (KRAS G12V)
VAGAVGVGK

SEQ ID NO: 11052 - protein, 9 aa, Artificial Sequence
  Description of Artificial Sequence: Synthetic peptide
  Seed: VVGAVGVGK (KRAS G12V)
VAGAVGVGR

SEQ ID NO: 11053 - protein, 10 aa, Artificial Sequence
  Description of Artificial Sequence: Synthetic peptide
  Seed: VVVGAVGVGK (KRAS G12V)
VAVGAVGVGK

SEQ ID NO: 11054 - protein, 10 aa, Artificial Sequence
  Description of Artificial Sequence: Synthetic peptide
  Seed: VVVGAVGVGK (KRAS G12V)
VAVGAVGVGR

SEQ ID NO: 11055 - protein, 10 aa, Artificial Sequence
  Description of Artificial Sequence: Synthetic peptide
  Seed: VVVGAVGVGK (KRAS G12V)
VCVGAVGVGK

SEQ ID NO: 11056 - protein, 10 aa, Artificial Sequence
  Description of Artificial Sequence: Synthetic peptide
  Seed: VVVGAVGVGK (KRAS G12V)
VCVGAVGVGR

SEQ ID NO: 11057 - protein, 10 aa, Artificial Sequence
  Description of Artificial Sequence: Synthetic peptide
  Seed: VVVGAVGVGK (KRAS G12V)
VDVGAVGVGK

SEQ ID NO: 11058 - protein, 10 aa, Artificial Sequence
  Description of Artificial Sequence: Synthetic peptide
  Seed: VVVGAVGVGK (KRAS G12V)
VDVGAVGVGR

SEQ ID NO: 11059 - protein, 10 aa, Artificial Sequence
  Description of Artificial Sequence: Synthetic peptide
  Seed: VVVGAVGVGK (KRAS G12V)
VEVGAVGVGK

SEQ ID NO: 11060 - protein, 10 aa, Artificial Sequence
  Description of Artificial Sequence: Synthetic peptide
  Seed: VVVGAVGVGK (KRAS G12V)
VEVGAVGVGR

SEQ ID NO: 11061 - protein, 9 aa, Artificial Sequence
  Description of Artificial Sequence: Synthetic peptide
  Seed: VVGAVGVGK (KRAS G12V)
VFGAVGVGK

SEQ ID NO: 11062 - protein, 9 aa, Artificial Sequence
  Description of Artificial Sequence: Synthetic peptide
  Seed: VVGAVGVGK (KRAS G12V)
VFGAVGVGR

SEQ ID NO: 11063 - protein, 10 aa, Artificial Sequence
  Description of Artificial Sequence: Synthetic peptide
  Seed: VVVGAVGVGK (KRAS G12V)
VFVGAVGVGK

SEQ ID NO: 11064 - protein, 10 aa, Artificial Sequence
  Description of Artificial Sequence: Synthetic peptide
  Seed: VVVGAVGVGK (KRAS G12V)
VFVGAVGVGR

SEQ ID NO: 11065 - protein, 9 aa, Artificial Sequence
  Description of Artificial Sequence: Synthetic peptide
  Seed: VVGAVGVGK (KRAS G12V)
VGGAVGVGR

SEQ ID NO: 11066 - protein, 10 aa, Artificial Sequence
  Description of Artificial Sequence: Synthetic peptide
  Seed: VVVGAVGVGK (KRAS G12V)
VGVGAVGVGK

SEQ ID NO: 11067 - protein, 10 aa, Artificial Sequence
  Description of Artificial Sequence: Synthetic peptide
  Seed: VVVGAVGVGK (KRAS G12V)
VGVGAVGVGR

SEQ ID NO: 11068 - protein, 10 aa, Artificial Sequence
  Description of Artificial Sequence: Synthetic peptide
  Seed: VVVGAVGVGK (KRAS G12V)
VHVGAVGVGK

SEQ ID NO: 11069 - protein, 10 aa, Artificial Sequence
  Description of Artificial Sequence: Synthetic peptide
  Seed: VVVGAVGVGK (KRAS G12V)
VHVGAVGVGR

SEQ ID NO: 11070 - protein, 9 aa, Artificial Sequence
  Description of Artificial Sequence: Synthetic peptide
  Seed: VVGAVGVGK (KRAS G12V)
VIGAVGVGK

SEQ ID NO: 11071 - protein, 9 aa, Artificial Sequence
  Description of Artificial Sequence: Synthetic peptide
  Seed: VVGAVGVGK (KRAS G12V)
VIGAVGVGR

SEQ ID NO: 11072 - protein, 10 aa, Artificial Sequence
  Description of Artificial Sequence: Synthetic peptide
  Seed: VVVGAVGVGK (KRAS G12V)
VIVGAVGVGK

SEQ ID NO: 11073 - protein, 10 aa, Artificial Sequence
  Description of Artificial Sequence: Synthetic peptide
  Seed: VVVGAVGVGK (KRAS G12V)
VIVGAVGVGR

SEQ ID NO: 11074 - protein, 10 aa, Artificial Sequence
  Description of Artificial Sequence: Synthetic peptide
  Seed: VVVGAVGVGK (KRAS G12V)
VKVGAVGVGK

SEQ ID NO: 11075 - protein, 10 aa, Artificial Sequence
  Description of Artificial Sequence: Synthetic peptide
  Seed: VVVGAVGVGK (KRAS G12V)
VKVGAVGVGR

SEQ ID NO: 11076 - protein, 9 aa, Artificial Sequence
  Description of Artificial Sequence: Synthetic peptide
  Seed: VVGAVGVGK (KRAS G12V)
VLGAVGVGK

SEQ ID NO: 11077 - protein, 9 aa, Artificial Sequence
  Description of Artificial Sequence: Synthetic peptide
  Seed: VVGAVGVGK (KRAS G12V)
VLGAVGVGR

SEQ ID NO: 11078 - protein, 10 aa, Artificial Sequence
  Description of Artificial Sequence: Synthetic peptide
  Seed: VVVGAVGVGK (KRAS G12V)
VLVGAVGVGK

SEQ ID NO: 11079 - protein, 10 aa, Artificial Sequence
  Description of Artificial Sequence: Synthetic peptide
  Seed: VVVGAVGVGK (KRAS G12V)
VLVGAVGVGR

SEQ ID NO: 11080 - protein, 10 aa, Artificial Sequence
  Description of Artificial Sequence: Synthetic peptide
  Seed: VVVGAVGVGK (KRAS G12V)
VMVGAVGVGK

SEQ ID NO: 11081 - protein, 10 aa, Artificial Sequence
  Description of Artificial Sequence: Synthetic peptide
  Seed: VVVGAVGVGK (KRAS G12V)
VNVGAVGVGK

SEQ ID NO: 11082 - protein, 10 aa, Artificial Sequence
  Description of Artificial Sequence: Synthetic peptide
  Seed: VVVGAVGVGK (KRAS G12V)
VNVGAVGVGR

SEQ ID NO: 11083 - protein, 10 aa, Artificial Sequence
  Description of Artificial Sequence: Synthetic peptide
  Seed: VVVGAVGVGK (KRAS G12V)
VPVGAVGVGK

SEQ ID NO: 11084 - protein, 10 aa, Artificial Sequence
  Description of Artificial Sequence: Synthetic peptide
  Seed: VVVGAVGVGK (KRAS G12V)
VPVGAVGVGR

SEQ ID NO: 11085 - protein, 9 aa, Artificial Sequence
  Description of Artificial Sequence: Synthetic peptide
  Seed: VVGAVGVGK (KRAS G12V)
VQGAVGVGK

SEQ ID NO: 11086 - protein, 9 aa, Artificial Sequence
  Description of Artificial Sequence: Synthetic peptide
  Seed: VVGAVGVGK (KRAS G12V)
VQGAVGVGR

SEQ ID NO: 11087 - protein, 10 aa, Artificial Sequence
  Description of Artificial Sequence: Synthetic peptide
  Seed: VVVGAVGVGK (KRAS G12V)
VQVGAVGVGK

SEQ ID NO: 11088 - protein, 10 aa, Artificial Sequence
  Description of Artificial Sequence: Synthetic peptide
  Seed: VVVGAVGVGK (KRAS G12V)
VQVGAVGVGR

SEQ ID NO: 11089 - protein, 10 aa, Artificial Sequence
  Description of Artificial Sequence: Synthetic peptide
  Seed: VVVGAVGVGK (KRAS G12V)
VRVGAVGVGK

SEQ ID NO: 11090 - protein, 10 aa, Artificial Sequence
  Description of Artificial Sequence: Synthetic peptide
  Seed: VVVGAVGVGK (KRAS G12V)
VRVGAVGVGR

SEQ ID NO: 11091 - protein, 9 aa, Artificial Sequence
  Description of Artificial Sequence: Synthetic peptide
  Seed: VVGAVGVGK (KRAS G12V)
VSGAVGVGK

SEQ ID NO: 11092 - protein, 9 aa, Artificial Sequence
  Description of Artificial Sequence: Synthetic peptide
  Seed: VVGAVGVGK (KRAS G12V)
VSGAVGVGR

SEQ ID NO: 11093 - protein, 10 aa, Artificial Sequence
  Description of Artificial Sequence: Synthetic peptide
  Seed: VVVGAVGVGK (KRAS G12V)
VSVGAVGVGK

SEQ ID NO: 11094 - protein, 10 aa, Artificial Sequence
  Description of Artificial Sequence: Synthetic peptide
  Seed: VVVGAVGVGK (KRAS G12V)
VSVGAVGVGR

SEQ ID NO: 11095 - protein, 9 aa, Artificial Sequence
  Description of Artificial Sequence: Synthetic peptide
  Seed: VVGAVGVGK (KRAS G12V)
VTGAVGVGK

SEQ ID NO: 11096 - protein, 9 aa, Artificial Sequence
  Description of Artificial Sequence: Synthetic peptide
  Seed: VVGAVGVGK (KRAS G12V)
VTGAVGVGR

SEQ ID NO: 11097 - protein, 10 aa, Artificial Sequence
  Description of Artificial Sequence: Synthetic peptide
  Seed: VVVGAVGVGK (KRAS G12V)
VTVGAVGVGR

SEQ ID NO: 11098 - protein, 9 aa, Artificial Sequence
  Description of Artificial Sequence: Synthetic peptide
  Seed: VVGAVGVGK (KRAS G12V)
VVGAVGVGR

SEQ ID NO: 11099 - protein, 9 aa, Artificial Sequence
  Description of Artificial Sequence: Synthetic peptide
  Seed: VVGAVGVGK (KRAS G12V)
VWGAVGVGK

SEQ ID NO: 11100 - protein, 9 aa, Artificial Sequence
  Description of Artificial Sequence: Synthetic peptide
  Seed: VVGAVGVGK (KRAS G12V)
VWGAVGVGR

SEQ ID NO: 11101 - protein, 10 aa, Artificial Sequence
  Description of Artificial Sequence: Synthetic peptide
  Seed: VVVGAVGVGK (KRAS G12V)
VWVGAVGVGK

SEQ ID NO: 11102 - protein, 10 aa, Artificial Sequence
  Description of Artificial Sequence: Synthetic peptide
  Seed: VVVGAVGVGK (KRAS G12V)
VWVGAVGVGR

SEQ ID NO: 11103 - protein, 9 aa, Artificial Sequence
  Description of Artificial Sequence: Synthetic peptide
  Seed: VVGAVGVGK (KRAS G12V)
VYGAVGVGK

SEQ ID NO: 11104 - protein, 9 aa, Artificial Sequence
  Description of Artificial Sequence: Synthetic peptide
  Seed: VVGAVGVGK (KRAS G12V)
VYGAVGVGR

SEQ ID NO: 11105 - protein, 10 aa, Artificial Sequence
  Description of Artificial Sequence: Synthetic peptide
  Seed: VVVGAVGVGK (KRAS G12V)
VYVGAVGVGK

SEQ ID NO: 11106 - protein, 10 aa, Artificial Sequence
  Description of Artificial Sequence: Synthetic peptide
  Seed: VVVGAVGVGK (KRAS G12V)
VYVGAVGVGR

SEQ ID NO: 11107 - protein, 10 aa, Artificial Sequence
  Description of Artificial Sequence: Synthetic peptide
  Seed: GAVGVGKSAL (KRAS G12V)
GAVGVGKSAA

SEQ ID NO: 11108 - protein, 10 aa, Artificial Sequence
  Description of Artificial Sequence: Synthetic peptide
  Seed: GAVGVGKSAL (KRAS G12V)
GAVGVGKSAF

SEQ ID NO: 11109 - protein, 10 aa, Artificial Sequence
  Description of Artificial Sequence: Synthetic peptide
  Seed: GAVGVGKSAL (KRAS G12V)
GAVGVGKSAH

SEQ ID NO: 11110 - protein, 10 aa, Artificial Sequence
  Description of Artificial Sequence: Synthetic peptide
  Seed: GAVGVGKSAL (KRAS G12V)
GAVGVGKSAI

SEQ ID NO: 11111 - protein, 10 aa, Artificial Sequence
  Description of Artificial Sequence: Synthetic peptide
  Seed: GAVGVGKSAL (KRAS G12V)
GAVGVGKSAK

SEQ ID NO: 11112 - protein, 10 aa, Artificial Sequence
  Description of Artificial Sequence: Synthetic peptide
  Seed: GAVGVGKSAL (KRAS G12V)
GAVGVGKSAM

SEQ ID NO: 11113 - protein, 10 aa, Artificial Sequence
  Description of Artificial Sequence: Synthetic peptide
  Seed: GAVGVGKSAL (KRAS G12V)
GAVGVGKSAR

SEQ ID NO: 11114 - protein, 10 aa, Artificial Sequence
  Description of Artificial Sequence: Synthetic peptide
  Seed: GAVGVGKSAL (KRAS G12V)
GAVGVGKSAV

SEQ ID NO: 11115 - protein, 10 aa, Artificial Sequence
  Description of Artificial Sequence: Synthetic peptide
  Seed: GAVGVGKSAL (KRAS G12V)
GAVGVGKSAW

SEQ ID NO: 11116 - protein, 10 aa, Artificial Sequence
  Description of Artificial Sequence: Synthetic peptide
  Seed: GAVGVGKSAL (KRAS G12V)
GAVGVGKSAY

SEQ ID NO: 11117 - protein, 9 aa, Artificial Sequence
  Description of Artificial Sequence: Synthetic peptide
  Seed: GAVGVGKSA (KRAS G12V)
GAVGVGKSC

SEQ ID NO: 11118 - protein, 9 aa, Artificial Sequence
  Description of Artificial Sequence: Synthetic peptide
  Seed: GAVGVGKSA (KRAS G12V)
GAVGVGKSF

SEQ ID NO: 11119 - protein, 9 aa, Artificial Sequence
  Description of Artificial Sequence: Synthetic peptide
  Seed: GAVGVGKSA (KRAS G12V)
GAVGVGKSH

SEQ ID NO: 11120 - protein, 9 aa, Artificial Sequence
  Description of Artificial Sequence: Synthetic peptide
  Seed: GAVGVGKSA (KRAS G12V)
GAVGVGKSI

SEQ ID NO: 11121 - protein, 9 aa, Artificial Sequence
  Description of Artificial Sequence: Synthetic peptide
  Seed: GAVGVGKSA (KRAS G12V)
GAVGVGKSK

SEQ ID NO: 11122 - protein, 9 aa, Artificial Sequence
  Description of Artificial Sequence: Synthetic peptide
  Seed: GAVGVGKSA (KRAS G12V)
GAVGVGKSM

SEQ ID NO: 11123 - protein, 9 aa, Artificial Sequence
  Description of Artificial Sequence: Synthetic peptide
  Seed: GAVGVGKSA (KRAS G12V)
GAVGVGKSP

SEQ ID NO: 11124 - protein, 9 aa, Artificial Sequence
  Description of Artificial Sequence: Synthetic peptide
  Seed: GAVGVGKSA (KRAS G12V)
GAVGVGKSQ

SEQ ID NO: 11125 - protein, 9 aa, Artificial Sequence
  Description of Artificial Sequence: Synthetic peptide
  Seed: GAVGVGKSA (KRAS G12V)
GAVGVGKSR

SEQ ID NO: 11126 - protein, 9 aa, Artificial Sequence
  Description of Artificial Sequence: Synthetic peptide
  Seed: GAVGVGKSA (KRAS G12V)
GAVGVGKSS

SEQ ID NO: 11127 - protein, 9 aa, Artificial Sequence
  Description of Artificial Sequence: Synthetic peptide
  Seed: GAVGVGKSA (KRAS G12V)
GAVGVGKST

SEQ ID NO: 11128 - protein, 9 aa, Artificial Sequence
  Description of Artificial Sequence: Synthetic peptide
  Seed: GAVGVGKSA (KRAS G12V)
GAVGVGKSV

SEQ ID NO: 11129 - protein, 9 aa, Artificial Sequence
  Description of Artificial Sequence: Synthetic peptide
  Seed: GAVGVGKSA (KRAS G12V)
GAVGVGKSW

SEQ ID NO: 11130 - protein, 9 aa, Artificial Sequence
  Description of Artificial Sequence: Synthetic peptide
  Seed: GAVGVGKSA (KRAS G12V)
GAVGVGKSY

SEQ ID NO: 11131 - protein, 10 aa, Artificial Sequence
  Description of Artificial Sequence: Synthetic peptide
  Seed: GAVGVGKSAL (KRAS G12V)
GCVGVGKSAF

SEQ ID NO: 11132 - protein, 10 aa, Artificial Sequence
  Description of Artificial Sequence: Synthetic peptide
  Seed: GAVGVGKSAL (KRAS G12V)
GCVGVGKSAK

SEQ ID NO: 11133 - protein, 10 aa, Artificial Sequence
  Description of Artificial Sequence: Synthetic peptide
  Seed: GAVGVGKSAL (KRAS G12V)
GCVGVGKSAR

SEQ ID NO: 11134 - protein, 10 aa, Artificial Sequence
  Description of Artificial Sequence: Synthetic peptide
  Seed: GAVGVGKSAL (KRAS G12V)
GCVGVGKSAY

SEQ ID NO: 11135 - protein, 9 aa, Artificial Sequence
  Description of Artificial Sequence: Synthetic peptide
  Seed: GAVGVGKSA (KRAS G12V)
GCVGVGKSF

SEQ ID NO: 11136 - protein, 9 aa, Artificial Sequence
  Description of Artificial Sequence: Synthetic peptide
  Seed: GAVGVGKSA (KRAS G12V)
GCVGVGKSK

SEQ ID NO: 11137 - protein, 9 aa, Artificial Sequence
  Description of Artificial Sequence: Synthetic peptide
  Seed: GAVGVGKSA (KRAS G12V)
GCVGVGKSL

SEQ ID NO: 11138 - protein, 9 aa, Artificial Sequence
  Description of Artificial Sequence: Synthetic peptide
  Seed: GAVGVGKSA (KRAS G12V)
GCVGVGKSM

SEQ ID NO: 11139 - protein, 9 aa, Artificial Sequence
  Description of Artificial Sequence: Synthetic peptide
  Seed: GAVGVGKSA (KRAS G12V)
GCVGVGKSR

SEQ ID NO: 11140 - protein, 9 aa, Artificial Sequence
  Description of Artificial Sequence: Synthetic peptide
  Seed: GAVGVGKSA (KRAS G12V)
GCVGVGKSY

SEQ ID NO: 11141 - protein, 10 aa, Artificial Sequence
  Description of Artificial Sequence: Synthetic peptide
  Seed: GAVGVGKSAL (KRAS G12V)
GDVGVGKSAK

SEQ ID NO: 11142 - protein, 10 aa, Artificial Sequence
  Description of Artificial Sequence: Synthetic peptide
  Seed: GAVGVGKSAL (KRAS G12V)
GDVGVGKSAR

SEQ ID NO: 11143 - protein, 10 aa, Artificial Sequence
  Description of Artificial Sequence: Synthetic peptide
  Seed: GAVGVGKSAL (KRAS G12V)
GDVGVGKSAY

SEQ ID NO: 11144 - protein, 9 aa, Artificial Sequence
  Description of Artificial Sequence: Synthetic peptide
  Seed: GAVGVGKSA (KRAS G12V)
GDVGVGKSF

SEQ ID NO: 11145 - protein, 9 aa, Artificial Sequence
  Description of Artificial Sequence: Synthetic peptide
  Seed: GAVGVGKSA (KRAS G12V)
GDVGVGKSK

SEQ ID NO: 11146 - protein, 9 aa, Artificial Sequence
  Description of Artificial Sequence: Synthetic peptide
  Seed: GAVGVGKSA (KRAS G12V)
GDVGVGKSR

SEQ ID NO: 11147 - protein, 9 aa, Artificial Sequence
  Description of Artificial Sequence: Synthetic peptide
  Seed: GAVGVGKSA (KRAS G12V)
GDVGVGKSY

SEQ ID NO: 11148 - protein, 10 aa, Artificial Sequence
  Description of Artificial Sequence: Synthetic peptide
  Seed: GAVGVGKSAL (KRAS G12V)
GEVGVGKSAF

SEQ ID NO: 11149 - protein, 10 aa, Artificial Sequence
  Description of Artificial Sequence: Synthetic peptide
  Seed: GAVGVGKSAL (KRAS G12V)
GEVGVGKSAK

SEQ ID NO: 11150 - protein, 10 aa, Artificial Sequence
  Description of Artificial Sequence: Synthetic peptide
  Seed: GAVGVGKSAL (KRAS G12V)
GEVGVGKSAL

SEQ ID NO: 11151 - protein, 10 aa, Artificial Sequence
  Description of Artificial Sequence: Synthetic peptide
  Seed: GAVGVGKSAL (KRAS G12V)
GEVGVGKSAM

SEQ ID NO: 11152 - protein, 10 aa, Artificial Sequence
  Description of Artificial Sequence: Synthetic peptide
  Seed: GAVGVGKSAL (KRAS G12V)
GEVGVGKSAR

SEQ ID NO: 11153 - protein, 10 aa, Artificial Sequence
  Description of Artificial Sequence: Synthetic peptide
  Seed: GAVGVGKSAL (KRAS G12V)
GEVGVGKSAY

SEQ ID NO: 11154 - protein, 9 aa, Artificial Sequence
  Description of Artificial Sequence: Synthetic peptide
  Seed: GAVGVGKSA (KRAS G12V)
GEVGVGKSF

SEQ ID NO: 11155 - protein, 9 aa, Artificial Sequence
  Description of Artificial Sequence: Synthetic peptide
  Seed: GAVGVGKSA (KRAS G12V)
GEVGVGKSK

SEQ ID NO: 11156 - protein, 9 aa, Artificial Sequence
  Description of Artificial Sequence: Synthetic peptide
  Seed: GAVGVGKSA (KRAS G12V)
GEVGVGKSM

SEQ ID NO: 11157 - protein, 9 aa, Artificial Sequence
  Description of Artificial Sequence: Synthetic peptide
  Seed: GAVGVGKSA (KRAS G12V)
GEVGVGKSR

SEQ ID NO: 11158 - protein, 9 aa, Artificial Sequence
  Description of Artificial Sequence: Synthetic peptide
  Seed: GAVGVGKSA (KRAS G12V)
GEVGVGKSY

SEQ ID NO: 11159 - protein, 10 aa, Artificial Sequence
  Description of Artificial Sequence: Synthetic peptide
  Seed: GAVGVGKSAL (KRAS G12V)
GFVGVGKSAF

SEQ ID NO: 11160 - protein, 10 aa, Artificial Sequence
  Description of Artificial Sequence: Synthetic peptide
  Seed: GAVGVGKSAL (KRAS G12V)
GFVGVGKSAK

SEQ ID NO: 11161 - protein, 10 aa, Artificial Sequence
  Description of Artificial Sequence: Synthetic peptide
  Seed: GAVGVGKSAL (KRAS G12V)
GFVGVGKSAY

SEQ ID NO: 11162 - protein, 9 aa, Artificial Sequence
  Description of Artificial Sequence: Synthetic peptide
  Seed: GAVGVGKSA (KRAS G12V)
GFVGVGKSF

SEQ ID NO: 11163 - protein, 9 aa, Artificial Sequence
  Description of Artificial Sequence: Synthetic peptide
  Seed: GAVGVGKSA (KRAS G12V)
GFVGVGKSK

SEQ ID NO: 11164 - protein, 9 aa, Artificial Sequence
  Description of Artificial Sequence: Synthetic peptide
  Seed: GAVGVGKSA (KRAS G12V)
GFVGVGKSM

SEQ ID NO: 11165 - protein, 9 aa, Artificial Sequence
  Description of Artificial Sequence: Synthetic peptide
  Seed: GAVGVGKSA (KRAS G12V)
GFVGVGKSR

SEQ ID NO: 11166 - protein, 9 aa, Artificial Sequence
  Description of Artificial Sequence: Synthetic peptide
  Seed: GAVGVGKSA (KRAS G12V)
GFVGVGKSY

SEQ ID NO: 11167 - protein, 10 aa, Artificial Sequence
  Description of Artificial Sequence: Synthetic peptide
  Seed: GAVGVGKSAL (KRAS G12V)
GGVGVGKSAF

SEQ ID NO: 11168 - protein, 10 aa, Artificial Sequence
  Description of Artificial Sequence: Synthetic peptide
  Seed: GAVGVGKSAL (KRAS G12V)
GGVGVGKSAK

SEQ ID NO: 11169 - protein, 10 aa, Artificial Sequence
  Description of Artificial Sequence: Synthetic peptide
  Seed: GAVGVGKSAL (KRAS G12V)
GGVGVGKSAL

SEQ ID NO: 11170 - protein, 10 aa, Artificial Sequence
  Description of Artificial Sequence: Synthetic peptide
  Seed: GAVGVGKSAL (KRAS G12V)
GGVGVGKSAM

SEQ ID NO: 11171 - protein, 10 aa, Artificial Sequence
  Description of Artificial Sequence: Synthetic peptide
  Seed: GAVGVGKSAL (KRAS G12V)
GGVGVGKSAR

SEQ ID NO: 11172 - protein, 10 aa, Artificial Sequence
  Description of Artificial Sequence: Synthetic peptide
  Seed: GAVGVGKSAL (KRAS G12V)
GGVGVGKSAY

SEQ ID NO: 11173 - protein, 9 aa, Artificial Sequence
  Description of Artificial Sequence: Synthetic peptide
  Seed: GAVGVGKSA (KRAS G12V)
GGVGVGKSF

SEQ ID NO: 11174 - protein, 9 aa, Artificial Sequence
  Description of Artificial Sequence: Synthetic peptide
  Seed: GAVGVGKSA (KRAS G12V)
GGVGVGKSH

SEQ ID NO: 11175 - protein, 9 aa, Artificial Sequence
  Description of Artificial Sequence: Synthetic peptide
  Seed: GAVGVGKSA (KRAS G12V)
GGVGVGKSI

SEQ ID NO: 11176 - protein, 9 aa, Artificial Sequence
  Description of Artificial Sequence: Synthetic peptide
  Seed: GAVGVGKSA (KRAS G12V)
GGVGVGKSK

SEQ ID NO: 11177 - protein, 9 aa, Artificial Sequence
  Description of Artificial Sequence: Synthetic peptide
  Seed: GAVGVGKSA (KRAS G12V)
GGVGVGKSL

SEQ ID NO: 11178 - protein, 9 aa, Artificial Sequence
  Description of Artificial Sequence: Synthetic peptide
  Seed: GAVGVGKSA (KRAS G12V)
GGVGVGKSM

SEQ ID NO: 11179 - protein, 9 aa, Artificial Sequence
  Description of Artificial Sequence: Synthetic peptide
  Seed: GAVGVGKSA (KRAS G12V)
GGVGVGKSR

SEQ ID NO: 11180 - protein, 9 aa, Artificial Sequence
  Description of Artificial Sequence: Synthetic peptide
  Seed: GAVGVGKSA (KRAS G12V)
GGVGVGKSV

SEQ ID NO: 11181 - protein, 9 aa, Artificial Sequence
  Description of Artificial Sequence: Synthetic peptide
  Seed: GAVGVGKSA (KRAS G12V)
GGVGVGKSY

SEQ ID NO: 11182 - protein, 10 aa, Artificial Sequence
  Description of Artificial Sequence: Synthetic peptide
  Seed: GAVGVGKSAL (KRAS G12V)
GHVGVGKSAL

SEQ ID NO: 11183 - protein, 10 aa, Artificial Sequence
  Description of Artificial Sequence: Synthetic peptide
  Seed: GAVGVGKSAL (KRAS G12V)
GHVGVGKSAM

SEQ ID NO: 11184 - protein, 10 aa, Artificial Sequence
  Description of Artificial Sequence: Synthetic peptide
  Seed: GAVGVGKSAL (KRAS G12V)
GHVGVGKSAY

SEQ ID NO: 11185 - protein, 9 aa, Artificial Sequence
  Description of Artificial Sequence: Synthetic peptide
  Seed: GAVGVGKSA (KRAS G12V)
GHVGVGKSK

SEQ ID NO: 11186 - protein, 9 aa, Artificial Sequence
  Description of Artificial Sequence: Synthetic peptide
  Seed: GAVGVGKSA (KRAS G12V)
GIVGVGKSA

SEQ ID NO: 11187 - protein, 10 aa, Artificial Sequence
  Description of Artificial Sequence: Synthetic peptide
  Seed: GAVGVGKSAL (KRAS G12V)
GIVGVGKSAF

SEQ ID NO: 11188 - protein, 10 aa, Artificial Sequence
  Description of Artificial Sequence: Synthetic peptide
  Seed: GAVGVGKSAL (KRAS G12V)
GIVGVGKSAK

SEQ ID NO: 11189 - protein, 10 aa, Artificial Sequence
  Description of Artificial Sequence: Synthetic peptide
  Seed: GAVGVGKSAL (KRAS G12V)
GIVGVGKSAL

SEQ ID NO: 11190 - protein, 10 aa, Artificial Sequence
  Description of Artificial Sequence: Synthetic peptide
  Seed: GAVGVGKSAL (KRAS G12V)
GIVGVGKSAM

SEQ ID NO: 11191 - protein, 10 aa, Artificial Sequence
  Description of Artificial Sequence: Synthetic peptide
  Seed: GAVGVGKSAL (KRAS G12V)
GIVGVGKSAR

SEQ ID NO: 11192 - protein, 10 aa, Artificial Sequence
  Description of Artificial Sequence: Synthetic peptide
  Seed: GAVGVGKSAL (KRAS G12V)
GIVGVGKSAW

SEQ ID NO: 11193 - protein, 10 aa, Artificial Sequence
  Description of Artificial Sequence: Synthetic peptide
  Seed: GAVGVGKSAL (KRAS G12V)
GIVGVGKSAY

SEQ ID NO: 11194 - protein, 9 aa, Artificial Sequence
  Description of Artificial Sequence: Synthetic peptide
  Seed: GAVGVGKSA (KRAS G12V)
GIVGVGKSF

SEQ ID NO: 11195 - protein, 9 aa, Artificial Sequence
  Description of Artificial Sequence: Synthetic peptide
  Seed: GAVGVGKSA (KRAS G12V)
GIVGVGKSH

SEQ ID NO: 11196 - protein, 9 aa, Artificial Sequence
  Description of Artificial Sequence: Synthetic peptide
  Seed: GAVGVGKSA (KRAS G12V)
GIVGVGKSI

SEQ ID NO: 11197 - protein, 9 aa, Artificial Sequence
  Description of Artificial Sequence: Synthetic peptide
  Seed: GAVGVGKSA (KRAS G12V)
GIVGVGKSK

SEQ ID NO: 11198 - protein, 9 aa, Artificial Sequence
  Description of Artificial Sequence: Synthetic peptide
  Seed: GAVGVGKSA (KRAS G12V)
GIVGVGKSL

SEQ ID NO: 11199 - protein, 9 aa, Artificial Sequence
  Description of Artificial Sequence: Synthetic peptide
  Seed: GAVGVGKSA (KRAS G12V)
GIVGVGKSM

SEQ ID NO: 11200 - protein, 9 aa, Artificial Sequence
  Description of Artificial Sequence: Synthetic peptide
  Seed: GAVGVGKSA (KRAS G12V)
GIVGVGKSR

SEQ ID NO: 11201 - protein, 9 aa, Artificial Sequence
  Description of Artificial Sequence: Synthetic peptide
  Seed: GAVGVGKSA (KRAS G12V)
GIVGVGKSV

SEQ ID NO: 11202 - protein, 9 aa, Artificial Sequence
  Description of Artificial Sequence: Synthetic peptide
  Seed: GAVGVGKSA (KRAS G12V)
GIVGVGKSW

SEQ ID NO: 11203 - protein, 9 aa, Artificial Sequence
  Description of Artificial Sequence: Synthetic peptide
  Seed: GAVGVGKSA (KRAS G12V)
GIVGVGKSY

SEQ ID NO: 11204 - protein, 10 aa, Artificial Sequence
  Description of Artificial Sequence: Synthetic peptide
  Seed: GAVGVGKSAL (KRAS G12V)
GKVGVGKSAF

SEQ ID NO: 11205 - protein, 10 aa, Artificial Sequence
  Description of Artificial Sequence: Synthetic peptide
  Seed: GAVGVGKSAL (KRAS G12V)
GKVGVGKSAY

SEQ ID NO: 11206 - protein, 10 aa, Artificial Sequence
  Description of Artificial Sequence: Synthetic peptide
  Seed: GAVGVGKSAL (KRAS G12V)
GLVGVGKSAF

SEQ ID NO: 11207 - protein, 10 aa, Artificial Sequence
  Description of Artificial Sequence: Synthetic peptide
  Seed: GAVGVGKSAL (KRAS G12V)
GLVGVGKSAK

SEQ ID NO: 11208 - protein, 10 aa, Artificial Sequence
  Description of Artificial Sequence: Synthetic peptide
  Seed: GAVGVGKSAL (KRAS G12V)
GLVGVGKSAL

SEQ ID NO: 11209 - protein, 10 aa, Artificial Sequence
  Description of Artificial Sequence: Synthetic peptide
  Seed: GAVGVGKSAL (KRAS G12V)
GLVGVGKSAM

SEQ ID NO: 11210 - protein, 10 aa, Artificial Sequence
  Description of Artificial Sequence: Synthetic peptide
  Seed: GAVGVGKSAL (KRAS G12V)
GLVGVGKSAR

SEQ ID NO: 11211 - protein, 10 aa, Artificial Sequence
  Description of Artificial Sequence: Synthetic peptide
  Seed: GAVGVGKSAL (KRAS G12V)
GLVGVGKSAW

SEQ ID NO: 11212 - protein, 10 aa, Artificial Sequence
  Description of Artificial Sequence: Synthetic peptide
  Seed: GAVGVGKSAL (KRAS G12V)
GLVGVGKSAY

SEQ ID NO: 11213 - protein, 9 aa, Artificial Sequence
  Description of Artificial Sequence: Synthetic peptide
  Seed: GAVGVGKSA (KRAS G12V)
GLVGVGKSF

SEQ ID NO: 11214 - protein, 9 aa, Artificial Sequence
  Description of Artificial Sequence: Synthetic peptide
  Seed: GAVGVGKSA (KRAS G12V)
GLVGVGKSH

SEQ ID NO: 11215 - protein, 9 aa, Artificial Sequence
  Description of Artificial Sequence: Synthetic peptide
  Seed: GAVGVGKSA (KRAS G12V)
GLVGVGKSK

SEQ ID NO: 11216 - protein, 9 aa, Artificial Sequence
  Description of Artificial Sequence: Synthetic peptide
  Seed: GAVGVGKSA (KRAS G12V)
GLVGVGKSL

SEQ ID NO: 11217 - protein, 9 aa, Artificial Sequence
  Description of Artificial Sequence: Synthetic peptide
  Seed: GAVGVGKSA (KRAS G12V)
GLVGVGKSM

SEQ ID NO: 11218 - protein, 9 aa, Artificial Sequence
  Description of Artificial Sequence: Synthetic peptide
  Seed: GAVGVGKSA (KRAS G12V)
GLVGVGKSR

SEQ ID NO: 11219 - protein, 9 aa, Artificial Sequence
  Description of Artificial Sequence: Synthetic peptide
  Seed: GAVGVGKSA (KRAS G12V)
GLVGVGKSY

SEQ ID NO: 11220 - protein, 10 aa, Artificial Sequence
  Description of Artificial Sequence: Synthetic peptide
  Seed: GAVGVGKSAL (KRAS G12V)
GMVGVGKSAF

SEQ ID NO: 11221 - protein, 10 aa, Artificial Sequence
  Description of Artificial Sequence: Synthetic peptide
  Seed: GAVGVGKSAL (KRAS G12V)
GMVGVGKSAH

SEQ ID NO: 11222 - protein, 10 aa, Artificial Sequence
  Description of Artificial Sequence: Synthetic peptide
  Seed: GAVGVGKSAL (KRAS G12V)
GMVGVGKSAK

SEQ ID NO: 11223 - protein, 10 aa, Artificial Sequence
  Description of Artificial Sequence: Synthetic peptide
  Seed: GAVGVGKSAL (KRAS G12V)
GMVGVGKSAL

SEQ ID NO: 11224 - protein, 10 aa, Artificial Sequence
  Description of Artificial Sequence: Synthetic peptide
  Seed: GAVGVGKSAL (KRAS G12V)
GMVGVGKSAM

SEQ ID NO: 11225 - protein, 10 aa, Artificial Sequence
  Description of Artificial Sequence: Synthetic peptide
  Seed: GAVGVGKSAL (KRAS G12V)
GMVGVGKSAR

SEQ ID NO: 11226 - protein, 10 aa, Artificial Sequence
  Description of Artificial Sequence: Synthetic peptide
  Seed: GAVGVGKSAL (KRAS G12V)
GMVGVGKSAW

SEQ ID NO: 11227 - protein, 10 aa, Artificial Sequence
  Description of Artificial Sequence: Synthetic peptide
  Seed: GAVGVGKSAL (KRAS G12V)
GMVGVGKSAY

SEQ ID NO: 11228 - protein, 9 aa, Artificial Sequence
  Description of Artificial Sequence: Synthetic peptide
  Seed: GAVGVGKSA (KRAS G12V)
GMVGVGKSF

SEQ ID NO: 11229 - protein, 9 aa, Artificial Sequence
  Description of Artificial Sequence: Synthetic peptide
  Seed: GAVGVGKSA (KRAS G12V)
GMVGVGKSH

SEQ ID NO: 11230 - protein, 9 aa, Artificial Sequence
  Description of Artificial Sequence: Synthetic peptide
  Seed: GAVGVGKSA (KRAS G12V)
GMVGVGKSK

SEQ ID NO: 11231 - protein, 9 aa, Artificial Sequence
  Description of Artificial Sequence: Synthetic peptide
  Seed: GAVGVGKSA (KRAS G12V)
GMVGVGKSL

SEQ ID NO: 11232 - protein, 9 aa, Artificial Sequence
  Description of Artificial Sequence: Synthetic peptide
  Seed: GAVGVGKSA (KRAS G12V)
GMVGVGKSM

SEQ ID NO: 11233 - protein, 9 aa, Artificial Sequence
  Description of Artificial Sequence: Synthetic peptide
  Seed: GAVGVGKSA (KRAS G12V)
GMVGVGKSR

SEQ ID NO: 11234 - protein, 9 aa, Artificial Sequence
  Description of Artificial Sequence: Synthetic peptide
  Seed: GAVGVGKSA (KRAS G12V)
GMVGVGKSY

SEQ ID NO: 11235 - protein, 10 aa, Artificial Sequence
  Description of Artificial Sequence: Synthetic peptide
  Seed: GAVGVGKSAL (KRAS G12V)
GNVGVGKSAF

SEQ ID NO: 11236 - protein, 10 aa, Artificial Sequence
  Description of Artificial Sequence: Synthetic peptide
  Seed: GAVGVGKSAL (KRAS G12V)
GNVGVGKSAK

SEQ ID NO: 11237 - protein, 10 aa, Artificial Sequence
  Description of Artificial Sequence: Synthetic peptide
  Seed: GAVGVGKSAL (KRAS G12V)
GNVGVGKSAR

SEQ ID NO: 11238 - protein, 10 aa, Artificial Sequence
  Description of Artificial Sequence: Synthetic peptide
  Seed: GAVGVGKSAL (KRAS G12V)
GNVGVGKSAY

SEQ ID NO: 11239 - protein, 9 aa, Artificial Sequence
  Description of Artificial Sequence: Synthetic peptide
  Seed: GAVGVGKSA (KRAS G12V)
GNVGVGKSF

SEQ ID NO: 11240 - protein, 9 aa, Artificial Sequence
  Description of Artificial Sequence: Synthetic peptide
  Seed: GAVGVGKSA (KRAS G12V)
GNVGVGKSH

SEQ ID NO: 11241 - protein, 9 aa, Artificial Sequence
  Description of Artificial Sequence: Synthetic peptide
  Seed: GAVGVGKSA (KRAS G12V)
GNVGVGKSK

SEQ ID NO: 11242 - protein, 9 aa, Artificial Sequence
  Description of Artificial Sequence: Synthetic peptide
  Seed: GAVGVGKSA (KRAS G12V)
GNVGVGKSL

SEQ ID NO: 11243 - protein, 9 aa, Artificial Sequence
  Description of Artificial Sequence: Synthetic peptide
  Seed: GAVGVGKSA (KRAS G12V)
GNVGVGKSM

SEQ ID NO: 11244 - protein, 9 aa, Artificial Sequence
  Description of Artificial Sequence: Synthetic peptide
  Seed: GAVGVGKSA (KRAS G12V)
GNVGVGKSR

SEQ ID NO: 11245 - protein, 9 aa, Artificial Sequence
  Description of Artificial Sequence: Synthetic peptide
  Seed: GAVGVGKSA (KRAS G12V)
GNVGVGKSY

SEQ ID NO: 11246 - protein, 10 aa, Artificial Sequence
  Description of Artificial Sequence: Synthetic peptide
  Seed: GAVGVGKSAL (KRAS G12V)
GPVGVGKSAA

SEQ ID NO: 11247 - protein, 10 aa, Artificial Sequence
  Description of Artificial Sequence: Synthetic peptide
  Seed: GAVGVGKSAL (KRAS G12V)
GPVGVGKSAC

SEQ ID NO: 11248 - protein, 10 aa, Artificial Sequence
  Description of Artificial Sequence: Synthetic peptide
  Seed: GAVGVGKSAL (KRAS G12V)
GPVGVGKSAF

SEQ ID NO: 11249 - protein, 10 aa, Artificial Sequence
  Description of Artificial Sequence: Synthetic peptide
  Seed: GAVGVGKSAL (KRAS G12V)
GPVGVGKSAG

SEQ ID NO: 11250 - protein, 10 aa, Artificial Sequence
  Description of Artificial Sequence: Synthetic peptide
  Seed: GAVGVGKSAL (KRAS G12V)
GPVGVGKSAI

SEQ ID NO: 11251 - protein, 10 aa, Artificial Sequence
  Description of Artificial Sequence: Synthetic peptide
  Seed: GAVGVGKSAL (KRAS G12V)
GPVGVGKSAK

SEQ ID NO: 11252 - protein, 10 aa, Artificial Sequence
  Description of Artificial Sequence: Synthetic peptide
  Seed: GAVGVGKSAL (KRAS G12V)
GPVGVGKSAM

SEQ ID NO: 11253 - protein, 10 aa, Artificial Sequence
  Description of Artificial Sequence: Synthetic peptide
  Seed: GAVGVGKSAL (KRAS G12V)
GPVGVGKSAP

SEQ ID NO: 11254 - protein, 10 aa, Artificial Sequence
  Description of Artificial Sequence: Synthetic peptide
  Seed: GAVGVGKSAL (KRAS G12V)
GPVGVGKSAS

SEQ ID NO: 11255 - protein, 10 aa, Artificial Sequence
  Description of Artificial Sequence: Synthetic peptide
  Seed: GAVGVGKSAL (KRAS G12V)
GPVGVGKSAT

SEQ ID NO: 11256 - protein, 10 aa, Artificial Sequence
  Description of Artificial Sequence: Synthetic peptide
  Seed: GAVGVGKSAL (KRAS G12V)
GPVGVGKSAV

SEQ ID NO: 11257 - protein, 10 aa, Artificial Sequence
  Description of Artificial Sequence: Synthetic peptide
  Seed: GAVGVGKSAL (KRAS G12V)
GPVGVGKSAW

SEQ ID NO: 11258 - protein, 10 aa, Artificial Sequence
  Description of Artificial Sequence: Synthetic peptide
  Seed: GAVGVGKSAL (KRAS G12V)
GPVGVGKSAY

SEQ ID NO: 11259 - protein, 9 aa, Artificial Sequence
  Description of Artificial Sequence: Synthetic peptide
  Seed: GAVGVGKSA (KRAS G12V)
GPVGVGKSC

SEQ ID NO: 11260 - protein, 9 aa, Artificial Sequence
  Description of Artificial Sequence: Synthetic peptide
  Seed: GAVGVGKSA (KRAS G12V)
GPVGVGKSE

SEQ ID NO: 11261 - protein, 9 aa, Artificial Sequence
  Description of Artificial Sequence: Synthetic peptide
  Seed: GAVGVGKSA (KRAS G12V)
GPVGVGKSF

SEQ ID NO: 11262 - protein, 9 aa, Artificial Sequence
  Description of Artificial Sequence: Synthetic peptide
  Seed: GAVGVGKSA (KRAS G12V)
GPVGVGKSG

SEQ ID NO: 11263 - protein, 9 aa, Artificial Sequence
  Description of Artificial Sequence: Synthetic peptide
  Seed: GAVGVGKSA (KRAS G12V)
GPVGVGKSI

SEQ ID NO: 11264 - protein, 9 aa, Artificial Sequence
  Description of Artificial Sequence: Synthetic peptide
  Seed: GAVGVGKSA (KRAS G12V)
GPVGVGKSK

SEQ ID NO: 11265 - protein, 9 aa, Artificial Sequence
  Description of Artificial Sequence: Synthetic peptide
  Seed: GAVGVGKSA (KRAS G12V)
GPVGVGKSL

SEQ ID NO: 11266 - protein, 9 aa, Artificial Sequence
  Description of Artificial Sequence: Synthetic peptide
  Seed: GAVGVGKSA (KRAS G12V)
GPVGVGKSM

SEQ ID NO: 11267 - protein, 9 aa, Artificial Sequence
  Description of Artificial Sequence: Synthetic peptide
  Seed: GAVGVGKSA (KRAS G12V)
GPVGVGKSP

SEQ ID NO: 11268 - protein, 9 aa, Artificial Sequence
  Description of Artificial Sequence: Synthetic peptide
  Seed: GAVGVGKSA (KRAS G12V)
GPVGVGKSQ

SEQ ID NO: 11269 - protein, 9 aa, Artificial Sequence
  Description of Artificial Sequence: Synthetic peptide
  Seed: GAVGVGKSA (KRAS G12V)
GPVGVGKSR

SEQ ID NO: 11270 - protein, 9 aa, Artificial Sequence
  Description of Artificial Sequence: Synthetic peptide
  Seed: GAVGVGKSA (KRAS G12V)
GPVGVGKSS

SEQ ID NO: 11271 - protein, 9 aa, Artificial Sequence
  Description of Artificial Sequence: Synthetic peptide
  Seed: GAVGVGKSA (KRAS G12V)
GPVGVGKST

SEQ ID NO: 11272 - protein, 9 aa, Artificial Sequence
  Description of Artificial Sequence: Synthetic peptide
  Seed: GAVGVGKSA (KRAS G12V)
GPVGVGKSW

SEQ ID NO: 11273 - protein, 9 aa, Artificial Sequence
  Description of Artificial Sequence: Synthetic peptide
  Seed: GAVGVGKSA (KRAS G12V)
GPVGVGKSY

SEQ ID NO: 11274 - protein, 10 aa, Artificial Sequence
  Description of Artificial Sequence: Synthetic peptide
  Seed: GAVGVGKSAL (KRAS G12V)
GQVGVGKSAF

SEQ ID NO: 11275 - protein, 10 aa, Artificial Sequence
  Description of Artificial Sequence: Synthetic peptide
  Seed: GAVGVGKSAL (KRAS G12V)
GQVGVGKSAH

SEQ ID NO: 11276 - protein, 10 aa, Artificial Sequence
  Description of Artificial Sequence: Synthetic peptide
  Seed: GAVGVGKSAL (KRAS G12V)
GQVGVGKSAI

SEQ ID NO: 11277 - protein, 10 aa, Artificial Sequence
  Description of Artificial Sequence: Synthetic peptide
  Seed: GAVGVGKSAL (KRAS G12V)
GQVGVGKSAK

SEQ ID NO: 11278 - protein, 10 aa, Artificial Sequence
  Description of Artificial Sequence: Synthetic peptide
  Seed: GAVGVGKSAL (KRAS G12V)
GQVGVGKSAL

SEQ ID NO: 11279 - protein, 10 aa, Artificial Sequence
  Description of Artificial Sequence: Synthetic peptide
  Seed: GAVGVGKSAL (KRAS G12V)
GQVGVGKSAM

SEQ ID NO: 11280 - protein, 10 aa, Artificial Sequence
  Description of Artificial Sequence: Synthetic peptide
  Seed: GAVGVGKSAL (KRAS G12V)
GQVGVGKSAR

SEQ ID NO: 11281 - protein, 10 aa, Artificial Sequence
  Description of Artificial Sequence: Synthetic peptide
  Seed: GAVGVGKSAL (KRAS G12V)
GQVGVGKSAV

SEQ ID NO: 11282 - protein, 10 aa, Artificial Sequence
  Description of Artificial Sequence: Synthetic peptide
  Seed: GAVGVGKSAL (KRAS G12V)
GQVGVGKSAW

SEQ ID NO: 11283 - protein, 10 aa, Artificial Sequence
  Description of Artificial Sequence: Synthetic peptide
  Seed: GAVGVGKSAL (KRAS G12V)
GQVGVGKSAY

SEQ ID NO: 11284 - protein, 9 aa, Artificial Sequence
  Description of Artificial Sequence: Synthetic peptide
  Seed: GAVGVGKSA (KRAS G12V)
GQVGVGKSF

SEQ ID NO: 11285 - protein, 9 aa, Artificial Sequence
  Description of Artificial Sequence: Synthetic peptide
  Seed: GAVGVGKSA (KRAS G12V)
GQVGVGKSH

SEQ ID NO: 11286 - protein, 9 aa, Artificial Sequence
  Description of Artificial Sequence: Synthetic peptide
  Seed: GAVGVGKSA (KRAS G12V)
GQVGVGKSK

SEQ ID NO: 11287 - protein, 9 aa, Artificial Sequence
  Description of Artificial Sequence: Synthetic peptide
  Seed: GAVGVGKSA (KRAS G12V)
GQVGVGKSL

SEQ ID NO: 11288 - protein, 9 aa, Artificial Sequence
  Description of Artificial Sequence: Synthetic peptide
  Seed: GAVGVGKSA (KRAS G12V)
GQVGVGKSM

SEQ ID NO: 11289 - protein, 9 aa, Artificial Sequence
  Description of Artificial Sequence: Synthetic peptide
  Seed: GAVGVGKSA (KRAS G12V)
GQVGVGKSR

SEQ ID NO: 11290 - protein, 9 aa, Artificial Sequence
  Description of Artificial Sequence: Synthetic peptide
  Seed: GAVGVGKSA (KRAS G12V)
GQVGVGKSW

SEQ ID NO: 11291 - protein, 9 aa, Artificial Sequence
  Description of Artificial Sequence: Synthetic peptide
  Seed: GAVGVGKSA (KRAS G12V)
GQVGVGKSY

SEQ ID NO: 11292 - protein, 10 aa, Artificial Sequence
  Description of Artificial Sequence: Synthetic peptide
  Seed: GAVGVGKSAL (KRAS G12V)
GRVGVGKSAF

SEQ ID NO: 11293 - protein, 10 aa, Artificial Sequence
  Description of Artificial Sequence: Synthetic peptide
  Seed: GAVGVGKSAL (KRAS G12V)
GRVGVGKSAI

SEQ ID NO: 11294 - protein, 10 aa, Artificial Sequence
  Description of Artificial Sequence: Synthetic peptide
  Seed: GAVGVGKSAL (KRAS G12V)
GRVGVGKSAL

SEQ ID NO: 11295 - protein, 10 aa, Artificial Sequence
  Description of Artificial Sequence: Synthetic peptide
  Seed: GAVGVGKSAL (KRAS G12V)
GRVGVGKSAM

SEQ ID NO: 11296 - protein, 10 aa, Artificial Sequence
  Description of Artificial Sequence: Synthetic peptide
  Seed: GAVGVGKSAL (KRAS G12V)
GRVGVGKSAV

SEQ ID NO: 11297 - protein, 10 aa, Artificial Sequence
  Description of Artificial Sequence: Synthetic peptide
  Seed: GAVGVGKSAL (KRAS G12V)
GRVGVGKSAY

SEQ ID NO: 11298 - protein, 9 aa, Artificial Sequence
  Description of Artificial Sequence: Synthetic peptide
  Seed: GAVGVGKSA (KRAS G12V)
GSVGVGKSA

SEQ ID NO: 11299 - protein, 10 aa, Artificial Sequence
  Description of Artificial Sequence: Synthetic peptide
  Seed: GAVGVGKSAL (KRAS G12V)
GSVGVGKSAF

SEQ ID NO: 11300 - protein, 10 aa, Artificial Sequence
  Description of Artificial Sequence: Synthetic peptide
  Seed: GAVGVGKSAL (KRAS G12V)
GSVGVGKSAH

SEQ ID NO: 11301 - protein, 10 aa, Artificial Sequence
  Description of Artificial Sequence: Synthetic peptide
  Seed: GAVGVGKSAL (KRAS G12V)
GSVGVGKSAK

SEQ ID NO: 11302 - protein, 10 aa, Artificial Sequence
  Description of Artificial Sequence: Synthetic peptide
  Seed: GAVGVGKSAL (KRAS G12V)
GSVGVGKSAL

SEQ ID NO: 11303 - protein, 10 aa, Artificial Sequence
  Description of Artificial Sequence: Synthetic peptide
  Seed: GAVGVGKSAL (KRAS G12V)
GSVGVGKSAM

SEQ ID NO: 11304 - protein, 10 aa, Artificial Sequence
  Description of Artificial Sequence: Synthetic peptide
  Seed: GAVGVGKSAL (KRAS G12V)
GSVGVGKSAR

SEQ ID NO: 11305 - protein, 10 aa, Artificial Sequence
  Description of Artificial Sequence: Synthetic peptide
  Seed: GAVGVGKSAL (KRAS G12V)
GSVGVGKSAY

SEQ ID NO: 11306 - protein, 9 aa, Artificial Sequence
  Description of Artificial Sequence: Synthetic peptide
  Seed: GAVGVGKSA (KRAS G12V)
GSVGVGKSF

SEQ ID NO: 11307 - protein, 9 aa, Artificial Sequence
  Description of Artificial Sequence: Synthetic peptide
  Seed: GAVGVGKSA (KRAS G12V)
GSVGVGKSH

SEQ ID NO: 11308 - protein, 9 aa, Artificial Sequence
  Description of Artificial Sequence: Synthetic peptide
  Seed: GAVGVGKSA (KRAS G12V)
GSVGVGKSI

SEQ ID NO: 11309 - protein, 9 aa, Artificial Sequence
  Description of Artificial Sequence: Synthetic peptide
  Seed: GAVGVGKSA (KRAS G12V)
GSVGVGKSK

SEQ ID NO: 11310 - protein, 9 aa, Artificial Sequence
  Description of Artificial Sequence: Synthetic peptide
  Seed: GAVGVGKSA (KRAS G12V)
GSVGVGKSL

SEQ ID NO: 11311 - protein, 9 aa, Artificial Sequence
  Description of Artificial Sequence: Synthetic peptide
  Seed: GAVGVGKSA (KRAS G12V)
GSVGVGKSM

SEQ ID NO: 11312 - protein, 9 aa, Artificial Sequence
  Description of Artificial Sequence: Synthetic peptide
  Seed: GAVGVGKSA (KRAS G12V)
GSVGVGKSR

SEQ ID NO: 11313 - protein, 9 aa, Artificial Sequence
  Description of Artificial Sequence: Synthetic peptide
  Seed: GAVGVGKSA (KRAS G12V)
GSVGVGKSV

SEQ ID NO: 11314 - protein, 9 aa, Artificial Sequence
  Description of Artificial Sequence: Synthetic peptide
  Seed: GAVGVGKSA (KRAS G12V)
GSVGVGKSW

SEQ ID NO: 11315 - protein, 9 aa, Artificial Sequence
  Description of Artificial Sequence: Synthetic peptide
  Seed: GAVGVGKSA (KRAS G12V)
GSVGVGKSY

SEQ ID NO: 11316 - protein, 9 aa, Artificial Sequence
  Description of Artificial Sequence: Synthetic peptide
  Seed: GAVGVGKSA (KRAS G12V)
GTVGVGKSA

SEQ ID NO: 11317 - protein, 10 aa, Artificial Sequence
  Description of Artificial Sequence: Synthetic peptide
  Seed: GAVGVGKSAL (KRAS G12V)
GTVGVGKSAF

SEQ ID NO: 11318 - protein, 10 aa, Artificial Sequence
  Description of Artificial Sequence: Synthetic peptide
  Seed: GAVGVGKSAL (KRAS G12V)
GTVGVGKSAH

SEQ ID NO: 11319 - protein, 10 aa, Artificial Sequence
  Description of Artificial Sequence: Synthetic peptide
  Seed: GAVGVGKSAL (KRAS G12V)
GTVGVGKSAK

SEQ ID NO: 11320 - protein, 10 aa, Artificial Sequence
  Description of Artificial Sequence: Synthetic peptide
  Seed: GAVGVGKSAL (KRAS G12V)
GTVGVGKSAL

SEQ ID NO: 11321 - protein, 10 aa, Artificial Sequence
  Description of Artificial Sequence: Synthetic peptide
  Seed: GAVGVGKSAL (KRAS G12V)
GTVGVGKSAM

SEQ ID NO: 11322 - protein, 10 aa, Artificial Sequence
  Description of Artificial Sequence: Synthetic peptide
  Seed: GAVGVGKSAL (KRAS G12V)
GTVGVGKSAR

SEQ ID NO: 11323 - protein, 10 aa, Artificial Sequence
  Description of Artificial Sequence: Synthetic peptide
  Seed: GAVGVGKSAL (KRAS G12V)
GTVGVGKSAY

SEQ ID NO: 11324 - protein, 9 aa, Artificial Sequence
  Description of Artificial Sequence: Synthetic peptide
  Seed: GAVGVGKSA (KRAS G12V)
GTVGVGKSF

SEQ ID NO: 11325 - protein, 9 aa, Artificial Sequence
  Description of Artificial Sequence: Synthetic peptide
  Seed: GAVGVGKSA (KRAS G12V)
GTVGVGKSH

SEQ ID NO: 11326 - protein, 9 aa, Artificial Sequence
  Description of Artificial Sequence: Synthetic peptide
  Seed: GAVGVGKSA (KRAS G12V)
GTVGVGKSI

SEQ ID NO: 11327 - protein, 9 aa, Artificial Sequence
  Description of Artificial Sequence: Synthetic peptide
  Seed: GAVGVGKSA (KRAS G12V)
GTVGVGKSK

SEQ ID NO: 11328 - protein, 9 aa, Artificial Sequence
  Description of Artificial Sequence: Synthetic peptide
  Seed: GAVGVGKSA (KRAS G12V)
GTVGVGKSL

SEQ ID NO: 11329 - protein, 9 aa, Artificial Sequence
  Description of Artificial Sequence: Synthetic peptide
  Seed: GAVGVGKSA (KRAS G12V)
GTVGVGKSM

SEQ ID NO: 11330 - protein, 9 aa, Artificial Sequence
  Description of Artificial Sequence: Synthetic peptide
  Seed: GAVGVGKSA (KRAS G12V)
GTVGVGKSR

SEQ ID NO: 11331 - protein, 9 aa, Artificial Sequence
  Description of Artificial Sequence: Synthetic peptide
  Seed: GAVGVGKSA (KRAS G12V)
GTVGVGKSV

SEQ ID NO: 11332 - protein, 9 aa, Artificial Sequence
  Description of Artificial Sequence: Synthetic peptide
  Seed: GAVGVGKSA (KRAS G12V)
GTVGVGKSW

SEQ ID NO: 11333 - protein, 9 aa, Artificial Sequence
  Description of Artificial Sequence: Synthetic peptide
  Seed: GAVGVGKSA (KRAS G12V)
GTVGVGKSY

SEQ ID NO: 11334 - protein, 9 aa, Artificial Sequence
  Description of Artificial Sequence: Synthetic peptide
  Seed: GAVGVGKSA (KRAS G12V)
GVVGVGKSA

SEQ ID NO: 11335 - protein, 10 aa, Artificial Sequence
  Description of Artificial Sequence: Synthetic peptide
  Seed: GAVGVGKSAL (KRAS G12V)
GVVGVGKSAF

SEQ ID NO: 11336 - protein, 10 aa, Artificial Sequence
  Description of Artificial Sequence: Synthetic peptide
  Seed: GAVGVGKSAL (KRAS G12V)
GVVGVGKSAH

SEQ ID NO: 11337 - protein, 10 aa, Artificial Sequence
  Description of Artificial Sequence: Synthetic peptide
  Seed: GAVGVGKSAL (KRAS G12V)
GVVGVGKSAK

SEQ ID NO: 11338 - protein, 10 aa, Artificial Sequence
  Description of Artificial Sequence: Synthetic peptide
  Seed: GAVGVGKSAL (KRAS G12V)
GVVGVGKSAL

SEQ ID NO: 11339 - protein, 10 aa, Artificial Sequence
  Description of Artificial Sequence: Synthetic peptide
  Seed: GAVGVGKSAL (KRAS G12V)
GVVGVGKSAM

SEQ ID NO: 11340 - protein, 10 aa, Artificial Sequence
  Description of Artificial Sequence: Synthetic peptide
  Seed: GAVGVGKSAL (KRAS G12V)
GVVGVGKSAR

SEQ ID NO: 11341 - protein, 10 aa, Artificial Sequence
  Description of Artificial Sequence: Synthetic peptide
  Seed: GAVGVGKSAL (KRAS G12V)
GVVGVGKSAW

SEQ ID NO: 11342 - protein, 10 aa, Artificial Sequence
  Description of Artificial Sequence: Synthetic peptide
  Seed: GAVGVGKSAL (KRAS G12V)
GVVGVGKSAY

SEQ ID NO: 11343 - protein, 9 aa, Artificial Sequence
  Description of Artificial Sequence: Synthetic peptide
  Seed: GAVGVGKSA (KRAS G12V)
GVVGVGKSF

SEQ ID NO: 11344 - protein, 9 aa, Artificial Sequence
  Description of Artificial Sequence: Synthetic peptide
  Seed: GAVGVGKSA (KRAS G12V)
GVVGVGKSH

SEQ ID NO: 11345 - protein, 9 aa, Artificial Sequence
  Description of Artificial Sequence: Synthetic peptide
  Seed: GAVGVGKSA (KRAS G12V)
GVVGVGKSI

SEQ ID NO: 11346 - protein, 9 aa, Artificial Sequence
  Description of Artificial Sequence: Synthetic peptide
  Seed: GAVGVGKSA (KRAS G12V)
GVVGVGKSK

SEQ ID NO: 11347 - protein, 9 aa, Artificial Sequence
  Description of Artificial Sequence: Synthetic peptide
  Seed: GAVGVGKSA (KRAS G12V)
GVVGVGKSL

SEQ ID NO: 11348 - protein, 9 aa, Artificial Sequence
  Description of Artificial Sequence: Synthetic peptide
  Seed: GAVGVGKSA (KRAS G12V)
GVVGVGKSM

SEQ ID NO: 11349 - protein, 9 aa, Artificial Sequence
  Description of Artificial Sequence: Synthetic peptide
  Seed: GAVGVGKSA (KRAS G12V)
GVVGVGKSR

SEQ ID NO: 11350 - protein, 9 aa, Artificial Sequence
  Description of Artificial Sequence: Synthetic peptide
  Seed: GAVGVGKSA (KRAS G12V)
GVVGVGKSV

SEQ ID NO: 11351 - protein, 9 aa, Artificial Sequence
  Description of Artificial Sequence: Synthetic peptide
  Seed: GAVGVGKSA (KRAS G12V)
GVVGVGKSW

SEQ ID NO: 11352 - protein, 9 aa, Artificial Sequence
  Description of Artificial Sequence: Synthetic peptide
  Seed: GAVGVGKSA (KRAS G12V)
GVVGVGKSY

SEQ ID NO: 11353 - protein, 10 aa, Artificial Sequence
  Description of Artificial Sequence: Synthetic peptide
  Seed: GAVGVGKSAL (KRAS G12V)
GWVGVGKSAF

SEQ ID NO: 11354 - protein, 10 aa, Artificial Sequence
  Description of Artificial Sequence: Synthetic peptide
  Seed: GAVGVGKSAL (KRAS G12V)
GWVGVGKSAY

SEQ ID NO: 11355 - protein, 9 aa, Artificial Sequence
  Description of Artificial Sequence: Synthetic peptide
  Seed: GAVGVGKSA (KRAS G12V)
GWVGVGKSK

SEQ ID NO: 11356 - protein, 10 aa, Artificial Sequence
  Description of Artificial Sequence: Synthetic peptide
  Seed: GAVGVGKSAL (KRAS G12V)
GYVGVGKSAF

SEQ ID NO: 11357 - protein, 10 aa, Artificial Sequence
  Description of Artificial Sequence: Synthetic peptide
  Seed: GAVGVGKSAL (KRAS G12V)
GYVGVGKSAL

SEQ ID NO: 11358 - protein, 10 aa, Artificial Sequence
  Description of Artificial Sequence: Synthetic peptide
  Seed: GAVGVGKSAL (KRAS G12V)
GYVGVGKSAY

SEQ ID NO: 11359 - protein, 9 aa, Artificial Sequence
  Description of Artificial Sequence: Synthetic peptide
  Seed: GAVGVGKSA (KRAS G12V)
GYVGVGKSK

SEQ ID NO: 11360 - protein, 9 aa, Artificial Sequence
  Description of Artificial Sequence: Synthetic peptide
  Seed: GAVGVGKSA (KRAS G12V)
GYVGVGKSY

SEQ ID NO: 11361 - protein, 10 aa, Artificial Sequence
  Description of Artificial Sequence: Synthetic peptide
  Seed: KLVVVGAVGV (KRAS G12V)
KEVVVGAVGL

SEQ ID NO: 11362 - protein, 10 aa, Artificial Sequence
  Description of Artificial Sequence: Synthetic peptide
  Seed: KLVVVGAVGV (KRAS G12V)
KEVVVGAVGV

SEQ ID NO: 11363 - protein, 10 aa, Artificial Sequence
  Description of Artificial Sequence: Synthetic peptide
  Seed: KLVVVGAVGV (KRAS G12V)
KIVVVGAVGA

SEQ ID NO: 11364 - protein, 10 aa, Artificial Sequence
  Description of Artificial Sequence: Synthetic peptide
  Seed: KLVVVGAVGV (KRAS G12V)
KIVVVGAVGI

SEQ ID NO: 11365 - protein, 10 aa, Artificial Sequence
  Description of Artificial Sequence: Synthetic peptide
  Seed: KLVVVGAVGV (KRAS G12V)
KIVVVGAVGL

SEQ ID NO: 11366 - protein, 10 aa, Artificial Sequence
  Description of Artificial Sequence: Synthetic peptide
  Seed: KLVVVGAVGV (KRAS G12V)
KLVVVGAVGM

SEQ ID NO: 11367 - protein, 10 aa, Artificial Sequence
  Description of Artificial Sequence: Synthetic peptide
  Seed: KLVVVGAVGV (KRAS G12V)
KMVVVGAVGM

SEQ ID NO: 11368 - protein, 10 aa, Artificial Sequence
  Description of Artificial Sequence: Synthetic peptide
  Seed: KLVVVGAVGV (KRAS G12V)
KQVVVGAVGA

SEQ ID NO: 11369 - protein, 10 aa, Artificial Sequence
  Description of Artificial Sequence: Synthetic peptide
  Seed: KLVVVGAVGV (KRAS G12V)
KQVVVGAVGC

SEQ ID NO: 11370 - protein, 10 aa, Artificial Sequence
  Description of Artificial Sequence: Synthetic peptide
  Seed: KLVVVGAVGV (KRAS G12V)
KQVVVGAVGF

SEQ ID NO: 11371 - protein, 10 aa, Artificial Sequence
  Description of Artificial Sequence: Synthetic peptide
  Seed: KLVVVGAVGV (KRAS G12V)
KQVVVGAVGM

SEQ ID NO: 11372 - protein, 10 aa, Artificial Sequence
  Description of Artificial Sequence: Synthetic peptide
  Seed: KLVVVGAVGV (KRAS G12V)
KQVVVGAVGW

SEQ ID NO: 11373 - protein, 10 aa, Artificial Sequence
  Description of Artificial Sequence: Synthetic peptide
  Seed: KLVVVGAVGV (KRAS G12V)
KTVVVGAVGI

SEQ ID NO: 11374 - protein, 10 aa, Artificial Sequence
  Description of Artificial Sequence: Synthetic peptide
  Seed: KLVVVGAVGV (KRAS G12V)
KTVVVGAVGL

SEQ ID NO: 11375 - protein, 10 aa, Artificial Sequence
  Description of Artificial Sequence: Synthetic peptide
  Seed: KLVVVGAVGV (KRAS G12V)
KVVVVGAVGA

SEQ ID NO: 11376 - protein, 10 aa, Artificial Sequence
  Description of Artificial Sequence: Synthetic peptide
  Seed: KLVVVGAVGV (KRAS G12V)
KVVVVGAVGI

SEQ ID NO: 11377 - protein, 10 aa, Artificial Sequence
  Description of Artificial Sequence: Synthetic peptide
  Seed: KLVVVGAVGV (KRAS G12V)
KVVVVGAVGL

SEQ ID NO: 11378 - protein, 9 aa, Artificial Sequence
  Description of Artificial Sequence: Synthetic peptide
  Seed: LVVVGAVGV (KRAS G12V)
LAVVGAVGI

SEQ ID NO: 11379 - protein, 9 aa, Artificial Sequence
  Description of Artificial Sequence: Synthetic peptide
  Seed: LVVVGAVGV (KRAS G12V)
LAVVGAVGL

SEQ ID NO: 11380 - protein, 11 aa, Artificial Sequence
  Description of Artificial Sequence: Synthetic peptide
  Seed: LVVVGAVGVGK (KRAS G12V)
LAVVGAVGVGF

SEQ ID NO: 11381 - protein, 11 aa, Artificial Sequence
  Description of Artificial Sequence: Synthetic peptide
  Seed: LVVVGAVGVGK (KRAS G12V)
LAVVGAVGVGH

SEQ ID NO: 11382 - protein, 11 aa, Artificial Sequence
  Description of Artificial Sequence: Synthetic peptide
  Seed: LVVVGAVGVGK (KRAS G12V)
LAVVGAVGVGI

SEQ ID NO: 11383 - protein, 11 aa, Artificial Sequence
  Description of Artificial Sequence: Synthetic peptide
  Seed: LVVVGAVGVGK (KRAS G12V)
LAVVGAVGVGK

SEQ ID NO: 11384 - protein, 11 aa, Artificial Sequence
  Description of Artificial Sequence: Synthetic peptide
  Seed: LVVVGAVGVGK (KRAS G12V)
LAVVGAVGVGL

SEQ ID NO: 11385 - protein, 11 aa, Artificial Sequence
  Description of Artificial Sequence: Synthetic peptide
  Seed: LVVVGAVGVGK (KRAS G12V)
LAVVGAVGVGM

SEQ ID NO: 11386 - protein, 11 aa, Artificial Sequence
  Description of Artificial Sequence: Synthetic peptide
  Seed: LVVVGAVGVGK (KRAS G12V)
LAVVGAVGVGR

SEQ ID NO: 11387 - protein, 11 aa, Artificial Sequence
  Description of Artificial Sequence: Synthetic peptide
  Seed: LVVVGAVGVGK (KRAS G12V)
LAVVGAVGVGY

SEQ ID NO: 11388 - protein, 11 aa, Artificial Sequence
  Description of Artificial Sequence: Synthetic peptide
  Seed: LVVVGAVGVGK (KRAS G12V)
LCVVGAVGVGK

SEQ ID NO: 11389 - protein, 11 aa, Artificial Sequence
  Description of Artificial Sequence: Synthetic peptide
  Seed: LVVVGAVGVGK (KRAS G12V)
LCVVGAVGVGR

SEQ ID NO: 11390 - protein, 11 aa, Artificial Sequence
  Description of Artificial Sequence: Synthetic peptide
  Seed: LVVVGAVGVGK (KRAS G12V)
LDVVGAVGVGK

SEQ ID NO: 11391 - protein, 11 aa, Artificial Sequence
  Description of Artificial Sequence: Synthetic peptide
  Seed: LVVVGAVGVGK (KRAS G12V)
LDVVGAVGVGR

SEQ ID NO: 11392 - protein, 11 aa, Artificial Sequence
  Description of Artificial Sequence: Synthetic peptide
  Seed: LVVVGAVGVGK (KRAS G12V)
LEVVGAVGVGK

SEQ ID NO: 11393 - protein, 11 aa, Artificial Sequence
  Description of Artificial Sequence: Synthetic peptide
  Seed: LVVVGAVGVGK (KRAS G12V)
LEVVGAVGVGR

SEQ ID NO: 11394 - protein, 11 aa, Artificial Sequence
  Description of Artificial Sequence: Synthetic peptide
  Seed: LVVVGAVGVGK (KRAS G12V)
LFVVGAVGVGK

SEQ ID NO: 11395 - protein, 11 aa, Artificial Sequence
  Description of Artificial Sequence: Synthetic peptide
  Seed: LVVVGAVGVGK (KRAS G12V)
LFVVGAVGVGR

SEQ ID NO: 11396 - protein, 11 aa, Artificial Sequence
  Description of Artificial Sequence: Synthetic peptide
  Seed: LVVVGAVGVGK (KRAS G12V)
LGVVGAVGVGK

SEQ ID NO: 11397 - protein, 11 aa, Artificial Sequence
  Description of Artificial Sequence: Synthetic peptide
  Seed: LVVVGAVGVGK (KRAS G12V)
LGVVGAVGVGR

SEQ ID NO: 11398 - protein, 11 aa, Artificial Sequence
  Description of Artificial Sequence: Synthetic peptide
  Seed: LVVVGAVGVGK (KRAS G12V)
LGVVGAVGVGY

SEQ ID NO: 11399 - protein, 11 aa, Artificial Sequence
  Description of Artificial Sequence: Synthetic peptide
  Seed: LVVVGAVGVGK (KRAS G12V)
LHVVGAVGVGK

SEQ ID NO: 11400 - protein, 9 aa, Artificial Sequence
  Description of Artificial Sequence: Synthetic peptide
  Seed: LVVVGAVGV (KRAS G12V)
LIVVGAVGA

SEQ ID NO: 11401 - protein, 9 aa, Artificial Sequence
  Description of Artificial Sequence: Synthetic peptide
  Seed: LVVVGAVGV (KRAS G12V)
LIVVGAVGM

SEQ ID NO: 11402 - protein, 11 aa, Artificial Sequence
  Description of Artificial Sequence: Synthetic peptide
  Seed: LVVVGAVGVGK (KRAS G12V)
LIVVGAVGVGK

SEQ ID NO: 11403 - protein, 11 aa, Artificial Sequence
  Description of Artificial Sequence: Synthetic peptide
  Seed: LVVVGAVGVGK (KRAS G12V)
LIVVGAVGVGR

SEQ ID NO: 11404 - protein, 11 aa, Artificial Sequence
  Description of Artificial Sequence: Synthetic peptide
  Seed: LVVVGAVGVGK (KRAS G12V)
LIVVGAVGVGY

SEQ ID NO: 11405 - protein, 9 aa, Artificial Sequence
  Description of Artificial Sequence: Synthetic peptide
  Seed: LVVVGAVGV (KRAS G12V)
LLVVGAVGT

SEQ ID NO: 11406 - protein, 11 aa, Artificial Sequence
  Description of Artificial Sequence: Synthetic peptide
  Seed: LVVVGAVGVGK (KRAS G12V)
LLVVGAVGVGK

SEQ ID NO: 11407 - protein, 11 aa, Artificial Sequence
  Description of Artificial Sequence: Synthetic peptide
  Seed: LVVVGAVGVGK (KRAS G12V)
LLVVGAVGVGR

SEQ ID NO: 11408 - protein, 9 aa, Artificial Sequence
  Description of Artificial Sequence: Synthetic peptide
  Seed: LVVVGAVGV (KRAS G12V)
LMVVGAVGT

SEQ ID NO: 11409 - protein, 11 aa, Artificial Sequence
  Description of Artificial Sequence: Synthetic peptide
  Seed: LVVVGAVGVGK (KRAS G12V)
LMVVGAVGVGK

SEQ ID NO: 11410 - protein, 11 aa, Artificial Sequence
  Description of Artificial Sequence: Synthetic peptide
  Seed: LVVVGAVGVGK (KRAS G12V)
LMVVGAVGVGR

SEQ ID NO: 11411 - protein, 11 aa, Artificial Sequence
  Description of Artificial Sequence: Synthetic peptide
  Seed: LVVVGAVGVGK (KRAS G12V)
LNVVGAVGVGK

SEQ ID NO: 11412 - protein, 11 aa, Artificial Sequence
  Description of Artificial Sequence: Synthetic peptide
  Seed: LVVVGAVGVGK (KRAS G12V)
LNVVGAVGVGR

SEQ ID NO: 11413 - protein, 11 aa, Artificial Sequence
  Description of Artificial Sequence: Synthetic peptide
  Seed: LVVVGAVGVGK (KRAS G12V)
LPVVGAVGVGK

SEQ ID NO: 11414 - protein, 11 aa, Artificial Sequence
  Description of Artificial Sequence: Synthetic peptide
  Seed: LVVVGAVGVGK (KRAS G12V)
LPVVGAVGVGR

SEQ ID NO: 11415 - protein, 11 aa, Artificial Sequence
  Description of Artificial Sequence: Synthetic peptide
  Seed: LVVVGAVGVGK (KRAS G12V)
LQVVGAVGVGK

SEQ ID NO: 11416 - protein, 11 aa, Artificial Sequence
  Description of Artificial Sequence: Synthetic peptide
  Seed: LVVVGAVGVGK (KRAS G12V)
LQVVGAVGVGR

SEQ ID NO: 11417 - protein, 9 aa, Artificial Sequence
  Description of Artificial Sequence: Synthetic peptide
  Seed: LVVVGAVGV (KRAS G12V)
LSVVGAVGI

SEQ ID NO: 11418 - protein, 9 aa, Artificial Sequence
  Description of Artificial Sequence: Synthetic peptide
  Seed: LVVVGAVGV (KRAS G12V)
LSVVGAVGL

SEQ ID NO: 11419 - protein, 11 aa, Artificial Sequence
  Description of Artificial Sequence: Synthetic peptide
  Seed: LVVVGAVGVGK (KRAS G12V)
LSVVGAVGVGF

SEQ ID NO: 11420 - protein, 11 aa, Artificial Sequence
  Description of Artificial Sequence: Synthetic peptide
  Seed: LVVVGAVGVGK (KRAS G12V)
LSVVGAVGVGH

SEQ ID NO: 11421 - protein, 11 aa, Artificial Sequence
  Description of Artificial Sequence: Synthetic peptide
  Seed: LVVVGAVGVGK (KRAS G12V)
LSVVGAVGVGK

SEQ ID NO: 11422 - protein, 11 aa, Artificial Sequence
  Description of Artificial Sequence: Synthetic peptide
  Seed: LVVVGAVGVGK (KRAS G12V)
LSVVGAVGVGL

SEQ ID NO: 11423 - protein, 11 aa, Artificial Sequence
  Description of Artificial Sequence: Synthetic peptide
  Seed: LVVVGAVGVGK (KRAS G12V)
LSVVGAVGVGR

SEQ ID NO: 11424 - protein, 11 aa, Artificial Sequence
  Description of Artificial Sequence: Synthetic peptide
  Seed: LVVVGAVGVGK (KRAS G12V)
LSVVGAVGVGY

SEQ ID NO: 11425 - protein, 11 aa, Artificial Sequence
  Description of Artificial Sequence: Synthetic peptide
  Seed: LVVVGAVGVGK (KRAS G12V)
LTVVGAVGVGF

SEQ ID NO: 11426 - protein, 11 aa, Artificial Sequence
  Description of Artificial Sequence: Synthetic peptide
  Seed: LVVVGAVGVGK (KRAS G12V)
LTVVGAVGVGK

SEQ ID NO: 11427 - protein, 11 aa, Artificial Sequence
  Description of Artificial Sequence: Synthetic peptide
  Seed: LVVVGAVGVGK (KRAS G12V)
LTVVGAVGVGL

SEQ ID NO: 11428 - protein, 11 aa, Artificial Sequence
  Description of Artificial Sequence: Synthetic peptide
  Seed: LVVVGAVGVGK (KRAS G12V)
LTVVGAVGVGR

SEQ ID NO: 11429 - protein, 11 aa, Artificial Sequence
  Description of Artificial Sequence: Synthetic peptide
  Seed: LVVVGAVGVGK (KRAS G12V)
LTVVGAVGVGY

SEQ ID NO: 11430 - protein, 9 aa, Artificial Sequence
  Description of Artificial Sequence: Synthetic peptide
  Seed: LVVVGAVGV (KRAS G12V)
LVVVGAVGA

SEQ ID NO: 11431 - protein, 11 aa, Artificial Sequence
  Description of Artificial Sequence: Synthetic peptide
  Seed: LVVVGAVGVGK (KRAS G12V)
LVVVGAVGVGR

SEQ ID NO: 11432 - protein, 11 aa, Artificial Sequence
  Description of Artificial Sequence: Synthetic peptide
  Seed: LVVVGAVGVGK (KRAS G12V)
LVVVGAVGVGY

SEQ ID NO: 11433 - protein, 11 aa, Artificial Sequence
  Description of Artificial Sequence: Synthetic peptide
  Seed: LVVVGAVGVGK (KRAS G12V)
LWVVGAVGVGK

SEQ ID NO: 11434 - protein, 11 aa, Artificial Sequence
  Description of Artificial Sequence: Synthetic peptide
  Seed: LVVVGAVGVGK (KRAS G12V)
LYVVGAVGVGK

SEQ ID NO: 11435 - protein, 8 aa, Artificial Sequence
  Description of Artificial Sequence: Synthetic peptide
  Seed: VGAVGVGK (KRAS G12V)
VAAVGVGF

SEQ ID NO: 11436 - protein, 8 aa, Artificial Sequence
  Description of Artificial Sequence: Synthetic peptide
  Seed: VGAVGVGK (KRAS G12V)
VAAVGVGH

SEQ ID NO: 11437 - protein, 8 aa, Artificial Sequence
  Description of Artificial Sequence: Synthetic peptide
  Seed: VGAVGVGK (KRAS G12V)
VAAVGVGI

SEQ ID NO: 11438 - protein, 8 aa, Artificial Sequence
  Description of Artificial Sequence: Synthetic peptide
  Seed: VGAVGVGK (KRAS G12V)
VAAVGVGK

SEQ ID NO: 11439 - protein, 11 aa, Artificial Sequence
  Description of Artificial Sequence: Synthetic peptide
  Seed: VGAVGVGKSAL (KRAS G12V)
VAAVGVGKSAF

SEQ ID NO: 11440 - protein, 11 aa, Artificial Sequence
  Description of Artificial Sequence: Synthetic peptide
  Seed: VGAVGVGKSAL (KRAS G12V)
VAAVGVGKSAI

SEQ ID NO: 11441 - protein, 11 aa, Artificial Sequence
  Description of Artificial Sequence: Synthetic peptide
  Seed: VGAVGVGKSAL (KRAS G12V)
VAAVGVGKSAK

SEQ ID NO: 11442 - protein, 11 aa, Artificial Sequence
  Description of Artificial Sequence: Synthetic peptide
  Seed: VGAVGVGKSAL (KRAS G12V)
VAAVGVGKSAL

SEQ ID NO: 11443 - protein, 11 aa, Artificial Sequence
  Description of Artificial Sequence: Synthetic peptide
  Seed: VGAVGVGKSAL (KRAS G12V)
VAAVGVGKSAM

SEQ ID NO: 11444 - protein, 11 aa, Artificial Sequence
  Description of Artificial Sequence: Synthetic peptide
  Seed: VGAVGVGKSAL (KRAS G12V)
VAAVGVGKSAR

SEQ ID NO: 11445 - protein, 11 aa, Artificial Sequence
  Description of Artificial Sequence: Synthetic peptide
  Seed: VGAVGVGKSAL (KRAS G12V)
VAAVGVGKSAW

SEQ ID NO: 11446 - protein, 11 aa, Artificial Sequence
  Description of Artificial Sequence: Synthetic peptide
  Seed: VGAVGVGKSAL (KRAS G12V)
VAAVGVGKSAY

SEQ ID NO: 11447 - protein, 8 aa, Artificial Sequence
  Description of Artificial Sequence: Synthetic peptide
  Seed: VGAVGVGK (KRAS G12V)
VAAVGVGL

SEQ ID NO: 11448 - protein, 8 aa, Artificial Sequence
  Description of Artificial Sequence: Synthetic peptide
  Seed: VGAVGVGK (KRAS G12V)
VAAVGVGM

SEQ ID NO: 11449 - protein, 8 aa, Artificial Sequence
  Description of Artificial Sequence: Synthetic peptide
  Seed: VGAVGVGK (KRAS G12V)
VAAVGVGR

SEQ ID NO: 11450 - protein, 8 aa, Artificial Sequence
  Description of Artificial Sequence: Synthetic peptide
  Seed: VGAVGVGK (KRAS G12V)
VAAVGVGV

SEQ ID NO: 11451 - protein, 8 aa, Artificial Sequence
  Description of Artificial Sequence: Synthetic peptide
  Seed: VGAVGVGK (KRAS G12V)
VAAVGVGY

SEQ ID NO: 11452 - protein, 9 aa, Artificial Sequence
  Description of Artificial Sequence: Synthetic peptide
  Seed: VVGAVGVGK (KRAS G12V)
VAGAVGVGA

SEQ ID NO: 11453 - protein, 9 aa, Artificial Sequence
  Description of Artificial Sequence: Synthetic peptide
  Seed: VVGAVGVGK (KRAS G12V)
VAGAVGVGF

SEQ ID NO: 11454 - protein, 9 aa, Artificial Sequence
  Description of Artificial Sequence: Synthetic peptide
  Seed: VVGAVGVGK (KRAS G12V)
VAGAVGVGH

SEQ ID NO: 11455 - protein, 9 aa, Artificial Sequence
  Description of Artificial Sequence: Synthetic peptide
  Seed: VVGAVGVGK (KRAS G12V)
VAGAVGVGI

SEQ ID NO: 11456 - protein, 9 aa, Artificial Sequence
  Description of Artificial Sequence: Synthetic peptide
  Seed: VVGAVGVGK (KRAS G12V)
VAGAVGVGL

SEQ ID NO: 11457 - protein, 9 aa, Artificial Sequence
  Description of Artificial Sequence: Synthetic peptide
  Seed: VVGAVGVGK (KRAS G12V)
VAGAVGVGM

SEQ ID NO: 11458 - protein, 9 aa, Artificial Sequence
  Description of Artificial Sequence: Synthetic peptide
  Seed: VVGAVGVGK (KRAS G12V)
VAGAVGVGQ

SEQ ID NO: 11459 - protein, 9 aa, Artificial Sequence
  Description of Artificial Sequence: Synthetic peptide
  Seed: VVGAVGVGK (KRAS G12V)
VAGAVGVGV

SEQ ID NO: 11460 - protein, 9 aa, Artificial Sequence
  Description of Artificial Sequence: Synthetic peptide
  Seed: VVGAVGVGK (KRAS G12V)
VAGAVGVGW

SEQ ID NO: 11461 - protein, 9 aa, Artificial Sequence
  Description of Artificial Sequence: Synthetic peptide
  Seed: VVGAVGVGK (KRAS G12V)
VAGAVGVGY

SEQ ID NO: 11462 - protein, 10 aa, Artificial Sequence
  Description of Artificial Sequence: Synthetic peptide
  Seed: VVVGAVGVGK (KRAS G12V)
VAVGAVGVGA

SEQ ID NO: 11463 - protein, 10 aa, Artificial Sequence
  Description of Artificial Sequence: Synthetic peptide
  Seed: VVVGAVGVGK (KRAS G12V)
VAVGAVGVGC

SEQ ID NO: 11464 - protein, 10 aa, Artificial Sequence
  Description of Artificial Sequence: Synthetic peptide
  Seed: VVVGAVGVGK (KRAS G12V)
VAVGAVGVGE

SEQ ID NO: 11465 - protein, 10 aa, Artificial Sequence
  Description of Artificial Sequence: Synthetic peptide
  Seed: VVVGAVGVGK (KRAS G12V)
VAVGAVGVGF

SEQ ID NO: 11466 - protein, 10 aa, Artificial Sequence
  Description of Artificial Sequence: Synthetic peptide
  Seed: VVVGAVGVGK (KRAS G12V)
VAVGAVGVGH

SEQ ID NO: 11467 - protein, 10 aa, Artificial Sequence
  Description of Artificial Sequence: Synthetic peptide
  Seed: VVVGAVGVGK (KRAS G12V)
VAVGAVGVGI

SEQ ID NO: 11468 - protein, 10 aa, Artificial Sequence
  Description of Artificial Sequence: Synthetic peptide
  Seed: VVVGAVGVGK (KRAS G12V)
VAVGAVGVGL

SEQ ID NO: 11469 - protein, 10 aa, Artificial Sequence
  Description of Artificial Sequence: Synthetic peptide
  Seed: VVVGAVGVGK (KRAS G12V)
VAVGAVGVGM

SEQ ID NO: 11470 - protein, 10 aa, Artificial Sequence
  Description of Artificial Sequence: Synthetic peptide
  Seed: VVVGAVGVGK (KRAS G12V)
VAVGAVGVGN

SEQ ID NO: 11471 - protein, 10 aa, Artificial Sequence
  Description of Artificial Sequence: Synthetic peptide
  Seed: VVVGAVGVGK (KRAS G12V)
VAVGAVGVGQ

SEQ ID NO: 11472 - protein, 10 aa, Artificial Sequence
  Description of Artificial Sequence: Synthetic peptide
  Seed: VVVGAVGVGK (KRAS G12V)
VAVGAVGVGV

SEQ ID NO: 11473 - protein, 10 aa, Artificial Sequence
  Description of Artificial Sequence: Synthetic peptide
  Seed: VVVGAVGVGK (KRAS G12V)
VAVGAVGVGW

SEQ ID NO: 11474 - protein, 10 aa, Artificial Sequence
  Description of Artificial Sequence: Synthetic peptide
  Seed: VVVGAVGVGK (KRAS G12V)
VAVGAVGVGY

SEQ ID NO: 11475 - protein, 10 aa, Artificial Sequence
  Description of Artificial Sequence: Synthetic peptide
  Seed: VGVGKSALTI (KRAS G12V)
VAVGKSALTL

SEQ ID NO: 11476 - protein, 8 aa, Artificial Sequence
  Description of Artificial Sequence: Synthetic peptide
  Seed: VGAVGVGK (KRAS G12V)
VCAVGVGK

SEQ ID NO: 11477 - protein, 11 aa, Artificial Sequence
  Description of Artificial Sequence: Synthetic peptide
  Seed: VGAVGVGKSAL (KRAS G12V)
VCAVGVGKSAK

SEQ ID NO: 11478 - protein, 11 aa, Artificial Sequence
  Description of Artificial Sequence: Synthetic peptide
  Seed: VGAVGVGKSAL (KRAS G12V)
VCAVGVGKSAR

SEQ ID NO: 11479 - protein, 9 aa, Artificial Sequence
  Description of Artificial Sequence: Synthetic peptide
  Seed: VVGAVGVGK (KRAS G12V)
VCGAVGVGF

SEQ ID NO: 11480 - protein, 9 aa, Artificial Sequence
  Description of Artificial Sequence: Synthetic peptide
  Seed: VVGAVGVGK (KRAS G12V)
VCGAVGVGK

SEQ ID NO: 11481 - protein, 9 aa, Artificial Sequence
  Description of Artificial Sequence: Synthetic peptide
  Seed: VVGAVGVGK (KRAS G12V)
VCGAVGVGR

SEQ ID NO: 11482 - protein, 9 aa, Artificial Sequence
  Description of Artificial Sequence: Synthetic peptide
  Seed: VVGAVGVGK (KRAS G12V)
VCGAVGVGY

SEQ ID NO: 11483 - protein, 10 aa, Artificial Sequence
  Description of Artificial Sequence: Synthetic peptide
  Seed: VVVGAVGVGK (KRAS G12V)
VCVGAVGVGF

SEQ ID NO: 11484 - protein, 10 aa, Artificial Sequence
  Description of Artificial Sequence: Synthetic peptide
  Seed: VVVGAVGVGK (KRAS G12V)
VCVGAVGVGL

SEQ ID NO: 11485 - protein, 10 aa, Artificial Sequence
  Description of Artificial Sequence: Synthetic peptide
  Seed: VVVGAVGVGK (KRAS G12V)
VCVGAVGVGY

SEQ ID NO: 11486 - protein, 10 aa, Artificial Sequence
  Description of Artificial Sequence: Synthetic peptide
  Seed: VGVGKSALTI (KRAS G12V)
VCVGKSALTL

SEQ ID NO: 11487 - protein, 8 aa, Artificial Sequence
  Description of Artificial Sequence: Synthetic peptide
  Seed: VGAVGVGK (KRAS G12V)
VDAVGVGK

SEQ ID NO: 11488 - protein, 11 aa, Artificial Sequence
  Description of Artificial Sequence: Synthetic peptide
  Seed: VGAVGVGKSAL (KRAS G12V)
VDAVGVGKSAK

SEQ ID NO: 11489 - protein, 11 aa, Artificial Sequence
  Description of Artificial Sequence: Synthetic peptide
  Seed: VGAVGVGKSAL (KRAS G12V)
VDAVGVGKSAR

SEQ ID NO: 11490 - protein, 8 aa, Artificial Sequence
  Description of Artificial Sequence: Synthetic peptide
  Seed: VGAVGVGK (KRAS G12V)
VDAVGVGR

SEQ ID NO: 11491 - protein, 9 aa, Artificial Sequence
  Description of Artificial Sequence: Synthetic peptide
  Seed: VVGAVGVGK (KRAS G12V)
VDGAVGVGK

SEQ ID NO: 11492 - protein, 9 aa, Artificial Sequence
  Description of Artificial Sequence: Synthetic peptide
  Seed: VVGAVGVGK (KRAS G12V)
VDGAVGVGR

SEQ ID NO: 11493 - protein, 9 aa, Artificial Sequence
  Description of Artificial Sequence: Synthetic peptide
  Seed: VVGAVGVGK (KRAS G12V)
VDGAVGVGY

SEQ ID NO: 11494 - protein, 10 aa, Artificial Sequence
  Description of Artificial Sequence: Synthetic peptide
  Seed: VVVGAVGVGK (KRAS G12V)
VDVGAVGVGY

SEQ ID NO: 11495 - protein, 8 aa, Artificial Sequence
  Description of Artificial Sequence: Synthetic peptide
  Seed: VGAVGVGK (KRAS G12V)
VEAVGVGK

SEQ ID NO: 11496 - protein, 11 aa, Artificial Sequence
  Description of Artificial Sequence: Synthetic peptide
  Seed: VGAVGVGKSAL (KRAS G12V)
VEAVGVGKSAK

SEQ ID NO: 11497 - protein, 11 aa, Artificial Sequence
  Description of Artificial Sequence: Synthetic peptide
  Seed: VGAVGVGKSAL (KRAS G12V)
VEAVGVGKSAR

SEQ ID NO: 11498 - protein, 8 aa, Artificial Sequence
  Description of Artificial Sequence: Synthetic peptide
  Seed: VGAVGVGK (KRAS G12V)
VEAVGVGR

SEQ ID NO: 11499 - protein, 9 aa, Artificial Sequence
  Description of Artificial Sequence: Synthetic peptide
  Seed: VVGAVGVGK (KRAS G12V)
VEGAVGVGK

SEQ ID NO: 11500 - protein, 9 aa, Artificial Sequence
  Description of Artificial Sequence: Synthetic peptide
  Seed: VVGAVGVGK (KRAS G12V)
VEGAVGVGR

SEQ ID NO: 11501 - protein, 9 aa, Artificial Sequence
  Description of Artificial Sequence: Synthetic peptide
  Seed: VVGAVGVGK (KRAS G12V)
VEGAVGVGY

SEQ ID NO: 11502 - protein, 10 aa, Artificial Sequence
  Description of Artificial Sequence: Synthetic peptide
  Seed: VVVGAVGVGK (KRAS G12V)
VEVGAVGVGF

SEQ ID NO: 11503 - protein, 10 aa, Artificial Sequence
  Description of Artificial Sequence: Synthetic peptide
  Seed: VVVGAVGVGK (KRAS G12V)
VEVGAVGVGY

SEQ ID NO: 11504 - protein, 8 aa, Artificial Sequence
  Description of Artificial Sequence: Synthetic peptide
  Seed: VGAVGVGK (KRAS G12V)
VFAVGVGK

SEQ ID NO: 11505 - protein, 11 aa, Artificial Sequence
  Description of Artificial Sequence: Synthetic peptide
  Seed: VGAVGVGKSAL (KRAS G12V)
VFAVGVGKSAK

SEQ ID NO: 11506 - protein, 8 aa, Artificial Sequence
  Description of Artificial Sequence: Synthetic peptide
  Seed: VGAVGVGK (KRAS G12V)
VFAVGVGR

SEQ ID NO: 11507 - protein, 9 aa, Artificial Sequence
  Description of Artificial Sequence: Synthetic peptide
  Seed: VVGAVGVGK (KRAS G12V)
VFGAVGVGF

SEQ ID NO: 11508 - protein, 9 aa, Artificial Sequence
  Description of Artificial Sequence: Synthetic peptide
  Seed: VVGAVGVGK (KRAS G12V)
VFGAVGVGL

SEQ ID NO: 11509 - protein, 9 aa, Artificial Sequence
  Description of Artificial Sequence: Synthetic peptide
  Seed: VVGAVGVGK (KRAS G12V)
VFGAVGVGM

SEQ ID NO: 11510 - protein, 9 aa, Artificial Sequence
  Description of Artificial Sequence: Synthetic peptide
  Seed: VVGAVGVGK (KRAS G12V)
VFGAVGVGY

SEQ ID NO: 11511 - protein, 10 aa, Artificial Sequence
  Description of Artificial Sequence: Synthetic peptide
  Seed: VVVGAVGVGK (KRAS G12V)
VFVGAVGVGF

SEQ ID NO: 11512 - protein, 10 aa, Artificial Sequence
  Description of Artificial Sequence: Synthetic peptide
  Seed: VVVGAVGVGK (KRAS G12V)
VFVGAVGVGY

SEQ ID NO: 11513 - protein, 8 aa, Artificial Sequence
  Description of Artificial Sequence: Synthetic peptide
  Seed: VGAVGVGK (KRAS G12V)
VGAVGVGF

SEQ ID NO: 11514 - protein, 11 aa, Artificial Sequence
  Description of Artificial Sequence: Synthetic peptide
  Seed: VGAVGVGKSAL (KRAS G12V)
VGAVGVGKSAF

SEQ ID NO: 11515 - protein, 11 aa, Artificial Sequence
  Description of Artificial Sequence: Synthetic peptide
  Seed: VGAVGVGKSAL (KRAS G12V)
VGAVGVGKSAK

SEQ ID NO: 11516 - protein, 11 aa, Artificial Sequence
  Description of Artificial Sequence: Synthetic peptide
  Seed: VGAVGVGKSAL (KRAS G12V)
VGAVGVGKSAR

SEQ ID NO: 11517 - protein, 8 aa, Artificial Sequence
  Description of Artificial Sequence: Synthetic peptide
  Seed: VGAVGVGK (KRAS G12V)
VGAVGVGL

SEQ ID NO: 11518 - protein, 8 aa, Artificial Sequence
  Description of Artificial Sequence: Synthetic peptide
  Seed: VGAVGVGK (KRAS G12V)
VGAVGVGR

SEQ ID NO: 11519 - protein, 8 aa, Artificial Sequence
  Description of Artificial Sequence: Synthetic peptide
  Seed: VGAVGVGK (KRAS G12V)
VGAVGVGY

SEQ ID NO: 11520 - protein, 9 aa, Artificial Sequence
  Description of Artificial Sequence: Synthetic peptide
  Seed: VVGAVGVGK (KRAS G12V)
VGGAVGVGF

SEQ ID NO: 11521 - protein, 9 aa, Artificial Sequence
  Description of Artificial Sequence: Synthetic peptide
  Seed: VVGAVGVGK (KRAS G12V)
VGGAVGVGH

SEQ ID NO: 11522 - protein, 9 aa, Artificial Sequence
  Description of Artificial Sequence: Synthetic peptide
  Seed: VVGAVGVGK (KRAS G12V)
VGGAVGVGK

SEQ ID NO: 11523 - protein, 9 aa, Artificial Sequence
  Description of Artificial Sequence: Synthetic peptide
  Seed: VVGAVGVGK (KRAS G12V)
VGGAVGVGL

SEQ ID NO: 11524 - protein, 9 aa, Artificial Sequence
  Description of Artificial Sequence: Synthetic peptide
  Seed: VVGAVGVGK (KRAS G12V)
VGGAVGVGM

SEQ ID NO: 11525 - protein, 9 aa, Artificial Sequence
  Description of Artificial Sequence: Synthetic peptide
  Seed: VVGAVGVGK (KRAS G12V)
VGGAVGVGY

SEQ ID NO: 11526 - protein, 10 aa, Artificial Sequence
  Description of Artificial Sequence: Synthetic peptide
  Seed: VVVGAVGVGK (KRAS G12V)
VGVGAVGVGE

SEQ ID NO: 11527 - protein, 10 aa, Artificial Sequence
  Description of Artificial Sequence: Synthetic peptide
  Seed: VVVGAVGVGK (KRAS G12V)
VGVGAVGVGF

SEQ ID NO: 11528 - protein, 10 aa, Artificial Sequence
  Description of Artificial Sequence: Synthetic peptide
  Seed: VVVGAVGVGK (KRAS G12V)
VGVGAVGVGH

SEQ ID NO: 11529 - protein, 10 aa, Artificial Sequence
  Description of Artificial Sequence: Synthetic peptide
  Seed: VVVGAVGVGK (KRAS G12V)
VGVGAVGVGL

SEQ ID NO: 11530 - protein, 10 aa, Artificial Sequence
  Description of Artificial Sequence: Synthetic peptide
  Seed: VVVGAVGVGK (KRAS G12V)
VGVGAVGVGM

SEQ ID NO: 11531 - protein, 10 aa, Artificial Sequence
  Description of Artificial Sequence: Synthetic peptide
  Seed: VVVGAVGVGK (KRAS G12V)
VGVGAVGVGQ

SEQ ID NO: 11532 - protein, 10 aa, Artificial Sequence
  Description of Artificial Sequence: Synthetic peptide
  Seed: VVVGAVGVGK (KRAS G12V)
VGVGAVGVGY

SEQ ID NO: 11533 - protein, 10 aa, Artificial Sequence
  Description of Artificial Sequence: Synthetic peptide
  Seed: VGVGKSALTI (KRAS G12V)
VGVGKSALTF

SEQ ID NO: 11534 - protein, 10 aa, Artificial Sequence
  Description of Artificial Sequence: Synthetic peptide
  Seed: VGVGKSALTI (KRAS G12V)
VGVGKSALTL

SEQ ID NO: 11535 - protein, 9 aa, Artificial Sequence
  Description of Artificial Sequence: Synthetic peptide
  Seed: VVGAVGVGK (KRAS G12V)
VHGAVGVGK

SEQ ID NO: 11536 - protein, 9 aa, Artificial Sequence
  Description of Artificial Sequence: Synthetic peptide
  Seed: VVGAVGVGK (KRAS G12V)
VHGAVGVGR

SEQ ID NO: 11537 - protein, 10 aa, Artificial Sequence
  Description of Artificial Sequence: Synthetic peptide
  Seed: VVVGAVGVGK (KRAS G12V)
VHVGAVGVGY

SEQ ID NO: 11538 - protein, 8 aa, Artificial Sequence
  Description of Artificial Sequence: Synthetic peptide
  Seed: VGAVGVGK (KRAS G12V)
VIAVGVGK

SEQ ID NO: 11539 - protein, 11 aa, Artificial Sequence
  Description of Artificial Sequence: Synthetic peptide
  Seed: VGAVGVGKSAL (KRAS G12V)
VIAVGVGKSAK

SEQ ID NO: 11540 - protein, 11 aa, Artificial Sequence
  Description of Artificial Sequence: Synthetic peptide
  Seed: VGAVGVGKSAL (KRAS G12V)
VIAVGVGKSAR

SEQ ID NO: 11541 - protein, 8 aa, Artificial Sequence
  Description of Artificial Sequence: Synthetic peptide
  Seed: VGAVGVGK (KRAS G12V)
VIAVGVGR

SEQ ID NO: 11542 - protein, 8 aa, Artificial Sequence
  Description of Artificial Sequence: Synthetic peptide
  Seed: VGAVGVGK (KRAS G12V)
VIAVGVGY

SEQ ID NO: 11543 - protein, 9 aa, Artificial Sequence
  Description of Artificial Sequence: Synthetic peptide
  Seed: VVGAVGVGK (KRAS G12V)
VIGAVGVGF

SEQ ID NO: 11544 - protein, 9 aa, Artificial Sequence
  Description of Artificial Sequence: Synthetic peptide
  Seed: VVGAVGVGK (KRAS G12V)
VIGAVGVGH

SEQ ID NO: 11545 - protein, 9 aa, Artificial Sequence
  Description of Artificial Sequence: Synthetic peptide
  Seed: VVGAVGVGK (KRAS G12V)
VIGAVGVGL

SEQ ID NO: 11546 - protein, 9 aa, Artificial Sequence
  Description of Artificial Sequence: Synthetic peptide
  Seed: VVGAVGVGK (KRAS G12V)
VIGAVGVGM

SEQ ID NO: 11547 - protein, 9 aa, Artificial Sequence
  Description of Artificial Sequence: Synthetic peptide
  Seed: VVGAVGVGK (KRAS G12V)
VIGAVGVGY

SEQ ID NO: 11548 - protein, 10 aa, Artificial Sequence
  Description of Artificial Sequence: Synthetic peptide
  Seed: VVVGAVGVGK (KRAS G12V)
VIVGAVGVGF

SEQ ID NO: 11549 - protein, 10 aa, Artificial Sequence
  Description of Artificial Sequence: Synthetic peptide
  Seed: VVVGAVGVGK (KRAS G12V)
VIVGAVGVGH

SEQ ID NO: 11550 - protein, 10 aa, Artificial Sequence
  Description of Artificial Sequence: Synthetic peptide
  Seed: VVVGAVGVGK (KRAS G12V)
VIVGAVGVGL

SEQ ID NO: 11551 - protein, 10 aa, Artificial Sequence
  Description of Artificial Sequence: Synthetic peptide
  Seed: VVVGAVGVGK (KRAS G12V)
VIVGAVGVGM

SEQ ID NO: 11552 - protein, 10 aa, Artificial Sequence
  Description of Artificial Sequence: Synthetic peptide
  Seed: VVVGAVGVGK (KRAS G12V)
VIVGAVGVGQ

SEQ ID NO: 11553 - protein, 10 aa, Artificial Sequence
  Description of Artificial Sequence: Synthetic peptide
  Seed: VVVGAVGVGK (KRAS G12V)
VIVGAVGVGY

SEQ ID NO: 11554 - protein, 10 aa, Artificial Sequence
  Description of Artificial Sequence: Synthetic peptide
  Seed: VGVGKSALTI (KRAS G12V)
VIVGKSALTL

SEQ ID NO: 11555 - protein, 10 aa, Artificial Sequence
  Description of Artificial Sequence: Synthetic peptide
  Seed: VVVGAVGVGK (KRAS G12V)
VKVGAVGVGY

SEQ ID NO: 11556 - protein, 8 aa, Artificial Sequence
  Description of Artificial Sequence: Synthetic peptide
  Seed: VGAVGVGK (KRAS G12V)
VLAVGVGK

SEQ ID NO: 11557 - protein, 11 aa, Artificial Sequence
  Description of Artificial Sequence: Synthetic peptide
  Seed: VGAVGVGKSAL (KRAS G12V)
VLAVGVGKSAK

SEQ ID NO: 11558 - protein, 11 aa, Artificial Sequence
  Description of Artificial Sequence: Synthetic peptide
  Seed: VGAVGVGKSAL (KRAS G12V)
VLAVGVGKSAR

SEQ ID NO: 11559 - protein, 8 aa, Artificial Sequence
  Description of Artificial Sequence: Synthetic peptide
  Seed: VGAVGVGK (KRAS G12V)
VLAVGVGR

SEQ ID NO: 11560 - protein, 9 aa, Artificial Sequence
  Description of Artificial Sequence: Synthetic peptide
  Seed: VVGAVGVGK (KRAS G12V)
VLGAVGVGF

SEQ ID NO: 11561 - protein, 9 aa, Artificial Sequence
  Description of Artificial Sequence: Synthetic peptide
  Seed: VVGAVGVGK (KRAS G12V)
VLGAVGVGL

SEQ ID NO: 11562 - protein, 9 aa, Artificial Sequence
  Description of Artificial Sequence: Synthetic peptide
  Seed: VVGAVGVGK (KRAS G12V)
VLGAVGVGM

SEQ ID NO: 11563 - protein, 9 aa, Artificial Sequence
  Description of Artificial Sequence: Synthetic peptide
  Seed: VVGAVGVGK (KRAS G12V)
VLGAVGVGY

SEQ ID NO: 11564 - protein, 10 aa, Artificial Sequence
  Description of Artificial Sequence: Synthetic peptide
  Seed: VVVGAVGVGK (KRAS G12V)
VLVGAVGVGF

SEQ ID NO: 11565 - protein, 10 aa, Artificial Sequence
  Description of Artificial Sequence: Synthetic peptide
  Seed: VVVGAVGVGK (KRAS G12V)
VLVGAVGVGH

SEQ ID NO: 11566 - protein, 10 aa, Artificial Sequence
  Description of Artificial Sequence: Synthetic peptide
  Seed: VVVGAVGVGK (KRAS G12V)
VLVGAVGVGL

SEQ ID NO: 11567 - protein, 10 aa, Artificial Sequence
  Description of Artificial Sequence: Synthetic peptide
  Seed: VVVGAVGVGK (KRAS G12V)
VLVGAVGVGM

SEQ ID NO: 11568 - protein, 10 aa, Artificial Sequence
  Description of Artificial Sequence: Synthetic peptide
  Seed: VVVGAVGVGK (KRAS G12V)
VLVGAVGVGV

SEQ ID NO: 11569 - protein, 10 aa, Artificial Sequence
  Description of Artificial Sequence: Synthetic peptide
  Seed: VVVGAVGVGK (KRAS G12V)
VLVGAVGVGY

SEQ ID NO: 11570 - protein, 10 aa, Artificial Sequence
  Description of Artificial Sequence: Synthetic peptide
  Seed: VGVGKSALTI (KRAS G12V)
VLVGKSALTL

SEQ ID NO: 11571 - protein, 8 aa, Artificial Sequence
  Description of Artificial Sequence: Synthetic peptide
  Seed: VGAVGVGK (KRAS G12V)
VMAVGVGK

SEQ ID NO: 11572 - protein, 11 aa, Artificial Sequence
  Description of Artificial Sequence: Synthetic peptide
  Seed: VGAVGVGKSAL (KRAS G12V)
VMAVGVGKSAK

SEQ ID NO: 11573 - protein, 11 aa, Artificial Sequence
  Description of Artificial Sequence: Synthetic peptide
  Seed: VGAVGVGKSAL (KRAS G12V)
VMAVGVGKSAR

SEQ ID NO: 11574 - protein, 8 aa, Artificial Sequence
  Description of Artificial Sequence: Synthetic peptide
  Seed: VGAVGVGK (KRAS G12V)
VMAVGVGR

SEQ ID NO: 11575 - protein, 9 aa, Artificial Sequence
  Description of Artificial Sequence: Synthetic peptide
  Seed: VVGAVGVGK (KRAS G12V)
VMGAVGVGF

SEQ ID NO: 11576 - protein, 9 aa, Artificial Sequence
  Description of Artificial Sequence: Synthetic peptide
  Seed: VVGAVGVGK (KRAS G12V)
VMGAVGVGL

SEQ ID NO: 11577 - protein, 9 aa, Artificial Sequence
  Description of Artificial Sequence: Synthetic peptide
  Seed: VVGAVGVGK (KRAS G12V)
VMGAVGVGM

SEQ ID NO: 11578 - protein, 9 aa, Artificial Sequence
  Description of Artificial Sequence: Synthetic peptide
  Seed: VVGAVGVGK (KRAS G12V)
VMGAVGVGY

SEQ ID NO: 11579 - protein, 10 aa, Artificial Sequence
  Description of Artificial Sequence: Synthetic peptide
  Seed: VVVGAVGVGK (KRAS G12V)
VMVGAVGVGF

SEQ ID NO: 11580 - protein, 10 aa, Artificial Sequence
  Description of Artificial Sequence: Synthetic peptide
  Seed: VVVGAVGVGK (KRAS G12V)
VMVGAVGVGH

SEQ ID NO: 11581 - protein, 10 aa, Artificial Sequence
  Description of Artificial Sequence: Synthetic peptide
  Seed: VVVGAVGVGK (KRAS G12V)
VMVGAVGVGL

SEQ ID NO: 11582 - protein, 10 aa, Artificial Sequence
  Description of Artificial Sequence: Synthetic peptide
  Seed: VVVGAVGVGK (KRAS G12V)
VMVGAVGVGM

SEQ ID NO: 11583 - protein, 10 aa, Artificial Sequence
  Description of Artificial Sequence: Synthetic peptide
  Seed: VVVGAVGVGK (KRAS G12V)
VMVGAVGVGV

SEQ ID NO: 11584 - protein, 10 aa, Artificial Sequence
  Description of Artificial Sequence: Synthetic peptide
  Seed: VVVGAVGVGK (KRAS G12V)
VMVGAVGVGW

SEQ ID NO: 11585 - protein, 10 aa, Artificial Sequence
  Description of Artificial Sequence: Synthetic peptide
  Seed: VVVGAVGVGK (KRAS G12V)
VMVGAVGVGY

SEQ ID NO: 11586 - protein, 10 aa, Artificial Sequence
  Description of Artificial Sequence: Synthetic peptide
  Seed: VGVGKSALTI (KRAS G12V)
VMVGKSALTL

SEQ ID NO: 11587 - protein, 8 aa, Artificial Sequence
  Description of Artificial Sequence: Synthetic peptide
  Seed: VGAVGVGK (KRAS G12V)
VNAVGVGK

SEQ ID NO: 11588 - protein, 11 aa, Artificial Sequence
  Description of Artificial Sequence: Synthetic peptide
  Seed: VGAVGVGKSAL (KRAS G12V)
VNAVGVGKSAK

SEQ ID NO: 11589 - protein, 11 aa, Artificial Sequence
  Description of Artificial Sequence: Synthetic peptide
  Seed: VGAVGVGKSAL (KRAS G12V)
VNAVGVGKSAR

SEQ ID NO: 11590 - protein, 8 aa, Artificial Sequence
  Description of Artificial Sequence: Synthetic peptide
  Seed: VGAVGVGK (KRAS G12V)
VNAVGVGR

SEQ ID NO: 11591 - protein, 9 aa, Artificial Sequence
  Description of Artificial Sequence: Synthetic peptide
  Seed: VVGAVGVGK (KRAS G12V)
VNGAVGVGK

SEQ ID NO: 11592 - protein, 9 aa, Artificial Sequence
  Description of Artificial Sequence: Synthetic peptide
  Seed: VVGAVGVGK (KRAS G12V)
VNGAVGVGR

SEQ ID NO: 11593 - protein, 9 aa, Artificial Sequence
  Description of Artificial Sequence: Synthetic peptide
  Seed: VVGAVGVGK (KRAS G12V)
VNGAVGVGY

SEQ ID NO: 11594 - protein, 10 aa, Artificial Sequence
  Description of Artificial Sequence: Synthetic peptide
  Seed: VVVGAVGVGK (KRAS G12V)
VNVGAVGVGF

SEQ ID NO: 11595 - protein, 10 aa, Artificial Sequence
  Description of Artificial Sequence: Synthetic peptide
  Seed: VVVGAVGVGK (KRAS G12V)
VNVGAVGVGQ

SEQ ID NO: 11596 - protein, 10 aa, Artificial Sequence
  Description of Artificial Sequence: Synthetic peptide
  Seed: VVVGAVGVGK (KRAS G12V)
VNVGAVGVGY

SEQ ID NO: 11597 - protein, 10 aa, Artificial Sequence
  Description of Artificial Sequence: Synthetic peptide
  Seed: VGVGKSALTI (KRAS G12V)
VNVGKSALTL

SEQ ID NO: 11598 - protein, 8 aa, Artificial Sequence
  Description of Artificial Sequence: Synthetic peptide
  Seed: VGAVGVGK (KRAS G12V)
VPAVGVGK

SEQ ID NO: 11599 - protein, 9 aa, Artificial Sequence
  Description of Artificial Sequence: Synthetic peptide
  Seed: VVGAVGVGK (KRAS G12V)
VPGAVGVGK

SEQ ID NO: 11600 - protein, 9 aa, Artificial Sequence
  Description of Artificial Sequence: Synthetic peptide
  Seed: VVGAVGVGK (KRAS G12V)
VPGAVGVGR

SEQ ID NO: 11601 - protein, 9 aa, Artificial Sequence
  Description of Artificial Sequence: Synthetic peptide
  Seed: VVGAVGVGK (KRAS G12V)
VPGAVGVGY

SEQ ID NO: 11602 - protein, 10 aa, Artificial Sequence
  Description of Artificial Sequence: Synthetic peptide
  Seed: VVVGAVGVGK (KRAS G12V)
VPVGAVGVGL

SEQ ID NO: 11603 - protein, 10 aa, Artificial Sequence
  Description of Artificial Sequence: Synthetic peptide
  Seed: VVVGAVGVGK (KRAS G12V)
VPVGAVGVGM

SEQ ID NO: 11604 - protein, 10 aa, Artificial Sequence
  Description of Artificial Sequence: Synthetic peptide
  Seed: VVVGAVGVGK (KRAS G12V)
VPVGAVGVGY

SEQ ID NO: 11605 - protein, 8 aa, Artificial Sequence
  Description of Artificial Sequence: Synthetic peptide
  Seed: VGAVGVGK (KRAS G12V)
VQAVGVGK

SEQ ID NO: 11606 - protein, 11 aa, Artificial Sequence
  Description of Artificial Sequence: Synthetic peptide
  Seed: VGAVGVGKSAL (KRAS G12V)
VQAVGVGKSAK

SEQ ID NO: 11607 - protein, 11 aa, Artificial Sequence
  Description of Artificial Sequence: Synthetic peptide
  Seed: VGAVGVGKSAL (KRAS G12V)
VQAVGVGKSAR

SEQ ID NO: 11608 - protein, 8 aa, Artificial Sequence
  Description of Artificial Sequence: Synthetic peptide
  Seed: VGAVGVGK (KRAS G12V)
VQAVGVGR

SEQ ID NO: 11609 - protein, 8 aa, Artificial Sequence
  Description of Artificial Sequence: Synthetic peptide
  Seed: VGAVGVGK (KRAS G12V)
VQAVGVGY

SEQ ID NO: 11610 - protein, 9 aa, Artificial Sequence
  Description of Artificial Sequence: Synthetic peptide
  Seed: VVGAVGVGK (KRAS G12V)
VQGAVGVGF

SEQ ID NO: 11611 - protein, 9 aa, Artificial Sequence
  Description of Artificial Sequence: Synthetic peptide
  Seed: VVGAVGVGK (KRAS G12V)
VQGAVGVGM

SEQ ID NO: 11612 - protein, 9 aa, Artificial Sequence
  Description of Artificial Sequence: Synthetic peptide
  Seed: VVGAVGVGK (KRAS G12V)
VQGAVGVGY

SEQ ID NO: 11613 - protein, 10 aa, Artificial Sequence
  Description of Artificial Sequence: Synthetic peptide
  Seed: VVVGAVGVGK (KRAS G12V)
VQVGAVGVGF

SEQ ID NO: 11614 - protein, 10 aa, Artificial Sequence
  Description of Artificial Sequence: Synthetic peptide
  Seed: VVVGAVGVGK (KRAS G12V)
VQVGAVGVGH

SEQ ID NO: 11615 - protein, 10 aa, Artificial Sequence
  Description of Artificial Sequence: Synthetic peptide
  Seed: VVVGAVGVGK (KRAS G12V)
VQVGAVGVGL

SEQ ID NO: 11616 - protein, 10 aa, Artificial Sequence
  Description of Artificial Sequence: Synthetic peptide
  Seed: VVVGAVGVGK (KRAS G12V)
VQVGAVGVGM

SEQ ID NO: 11617 - protein, 10 aa, Artificial Sequence
  Description of Artificial Sequence: Synthetic peptide
  Seed: VVVGAVGVGK (KRAS G12V)
VQVGAVGVGY

SEQ ID NO: 11618 - protein, 10 aa, Artificial Sequence
  Description of Artificial Sequence: Synthetic peptide
  Seed: VGVGKSALTI (KRAS G12V)
VQVGKSALTL

SEQ ID NO: 11619 - protein, 9 aa, Artificial Sequence
  Description of Artificial Sequence: Synthetic peptide
  Seed: VVGAVGVGK (KRAS G12V)
VRGAVGVGF

SEQ ID NO: 11620 - protein, 9 aa, Artificial Sequence
  Description of Artificial Sequence: Synthetic peptide
  Seed: VVGAVGVGK (KRAS G12V)
VRGAVGVGI

SEQ ID NO: 11621 - protein, 9 aa, Artificial Sequence
  Description of Artificial Sequence: Synthetic peptide
  Seed: VVGAVGVGK (KRAS G12V)
VRGAVGVGL

SEQ ID NO: 11622 - protein, 9 aa, Artificial Sequence
  Description of Artificial Sequence: Synthetic peptide
  Seed: VVGAVGVGK (KRAS G12V)
VRGAVGVGM

SEQ ID NO: 11623 - protein, 9 aa, Artificial Sequence
  Description of Artificial Sequence: Synthetic peptide
  Seed: VVGAVGVGK (KRAS G12V)
VRGAVGVGV

SEQ ID NO: 11624 - protein, 9 aa, Artificial Sequence
  Description of Artificial Sequence: Synthetic peptide
  Seed: VVGAVGVGK (KRAS G12V)
VRGAVGVGY

SEQ ID NO: 11625 - protein, 10 aa, Artificial Sequence
  Description of Artificial Sequence: Synthetic peptide
  Seed: VVVGAVGVGK (KRAS G12V)
VRVGAVGVGF

SEQ ID NO: 11626 - protein, 10 aa, Artificial Sequence
  Description of Artificial Sequence: Synthetic peptide
  Seed: VVVGAVGVGK (KRAS G12V)
VRVGAVGVGI

SEQ ID NO: 11627 - protein, 10 aa, Artificial Sequence
  Description of Artificial Sequence: Synthetic peptide
  Seed: VVVGAVGVGK (KRAS G12V)
VRVGAVGVGL

SEQ ID NO: 11628 - protein, 10 aa, Artificial Sequence
  Description of Artificial Sequence: Synthetic peptide
  Seed: VVVGAVGVGK (KRAS G12V)
VRVGAVGVGM

SEQ ID NO: 11629 - protein, 10 aa, Artificial Sequence
  Description of Artificial Sequence: Synthetic peptide
  Seed: VVVGAVGVGK (KRAS G12V)
VRVGAVGVGV

SEQ ID NO: 11630 - protein, 10 aa, Artificial Sequence
  Description of Artificial Sequence: Synthetic peptide
  Seed: VVVGAVGVGK (KRAS G12V)
VRVGAVGVGY

SEQ ID NO: 11631 - protein, 10 aa, Artificial Sequence
  Description of Artificial Sequence: Synthetic peptide
  Seed: VGVGKSALTI (KRAS G12V)
VRVGKSALTF

SEQ ID NO: 11632 - protein, 10 aa, Artificial Sequence
  Description of Artificial Sequence: Synthetic peptide
  Seed: VGVGKSALTI (KRAS G12V)
VRVGKSALTH

SEQ ID NO: 11633 - protein, 10 aa, Artificial Sequence
  Description of Artificial Sequence: Synthetic peptide
  Seed: VGVGKSALTI (KRAS G12V)
VRVGKSALTI

SEQ ID NO: 11634 - protein, 10 aa, Artificial Sequence
  Description of Artificial Sequence: Synthetic peptide
  Seed: VGVGKSALTI (KRAS G12V)
VRVGKSALTK

SEQ ID NO: 11635 - protein, 10 aa, Artificial Sequence
  Description of Artificial Sequence: Synthetic peptide
  Seed: VGVGKSALTI (KRAS G12V)
VRVGKSALTL

SEQ ID NO: 11636 - protein, 10 aa, Artificial Sequence
  Description of Artificial Sequence: Synthetic peptide
  Seed: VGVGKSALTI (KRAS G12V)
VRVGKSALTM

SEQ ID NO: 11637 - protein, 10 aa, Artificial Sequence
  Description of Artificial Sequence: Synthetic peptide
  Seed: VGVGKSALTI (KRAS G12V)
VRVGKSALTR

SEQ ID NO: 11638 - protein, 10 aa, Artificial Sequence
  Description of Artificial Sequence: Synthetic peptide
  Seed: VGVGKSALTI (KRAS G12V)
VRVGKSALTV

SEQ ID NO: 11639 - protein, 10 aa, Artificial Sequence
  Description of Artificial Sequence: Synthetic peptide
  Seed: VGVGKSALTI (KRAS G12V)
VRVGKSALTW

SEQ ID NO: 11640 - protein, 10 aa, Artificial Sequence
  Description of Artificial Sequence: Synthetic peptide
  Seed: VGVGKSALTI (KRAS G12V)
VRVGKSALTY

SEQ ID NO: 11641 - protein, 8 aa, Artificial Sequence
  Description of Artificial Sequence: Synthetic peptide
  Seed: VGAVGVGK (KRAS G12V)
VSAVGVGF

SEQ ID NO: 11642 - protein, 8 aa, Artificial Sequence
  Description of Artificial Sequence: Synthetic peptide
  Seed: VGAVGVGK (KRAS G12V)
VSAVGVGH

SEQ ID NO: 11643 - protein, 8 aa, Artificial Sequence
  Description of Artificial Sequence: Synthetic peptide
  Seed: VGAVGVGK (KRAS G12V)
VSAVGVGI

SEQ ID NO: 11644 - protein, 8 aa, Artificial Sequence
  Description of Artificial Sequence: Synthetic peptide
  Seed: VGAVGVGK (KRAS G12V)
VSAVGVGK

SEQ ID NO: 11645 - protein, 11 aa, Artificial Sequence
  Description of Artificial Sequence: Synthetic peptide
  Seed: VGAVGVGKSAL (KRAS G12V)
VSAVGVGKSAF

SEQ ID NO: 11646 - protein, 11 aa, Artificial Sequence
  Description of Artificial Sequence: Synthetic peptide
  Seed: VGAVGVGKSAL (KRAS G12V)
VSAVGVGKSAK

SEQ ID NO: 11647 - protein, 11 aa, Artificial Sequence
  Description of Artificial Sequence: Synthetic peptide
  Seed: VGAVGVGKSAL (KRAS G12V)
VSAVGVGKSAL

SEQ ID NO: 11648 - protein, 11 aa, Artificial Sequence
  Description of Artificial Sequence: Synthetic peptide
  Seed: VGAVGVGKSAL (KRAS G12V)
VSAVGVGKSAM

SEQ ID NO: 11649 - protein, 11 aa, Artificial Sequence
  Description of Artificial Sequence: Synthetic peptide
  Seed: VGAVGVGKSAL (KRAS G12V)
VSAVGVGKSAR

SEQ ID NO: 11650 - protein, 11 aa, Artificial Sequence
  Description of Artificial Sequence: Synthetic peptide
  Seed: VGAVGVGKSAL (KRAS G12V)
VSAVGVGKSAY

SEQ ID NO: 11651 - protein, 8 aa, Artificial Sequence
  Description of Artificial Sequence: Synthetic peptide
  Seed: VGAVGVGK (KRAS G12V)
VSAVGVGL

SEQ ID NO: 11652 - protein, 8 aa, Artificial Sequence
  Description of Artificial Sequence: Synthetic peptide
  Seed: VGAVGVGK (KRAS G12V)
VSAVGVGM

SEQ ID NO: 11653 - protein, 8 aa, Artificial Sequence
  Description of Artificial Sequence: Synthetic peptide
  Seed: VGAVGVGK (KRAS G12V)
VSAVGVGR

SEQ ID NO: 11654 - protein, 8 aa, Artificial Sequence
  Description of Artificial Sequence: Synthetic peptide
  Seed: VGAVGVGK (KRAS G12V)
VSAVGVGV

SEQ ID NO: 11655 - protein, 8 aa, Artificial Sequence
  Description of Artificial Sequence: Synthetic peptide
  Seed: VGAVGVGK (KRAS G12V)
VSAVGVGY

SEQ ID NO: 11656 - protein, 9 aa, Artificial Sequence
  Description of Artificial Sequence: Synthetic peptide
  Seed: VVGAVGVGK (KRAS G12V)
VSGAVGVGF

SEQ ID NO: 11657 - protein, 9 aa, Artificial Sequence
  Description of Artificial Sequence: Synthetic peptide
  Seed: VVGAVGVGK (KRAS G12V)
VSGAVGVGH

SEQ ID NO: 11658 - protein, 9 aa, Artificial Sequence
  Description of Artificial Sequence: Synthetic peptide
  Seed: VVGAVGVGK (KRAS G12V)
VSGAVGVGI

SEQ ID NO: 11659 - protein, 9 aa, Artificial Sequence
  Description of Artificial Sequence: Synthetic peptide
  Seed: VVGAVGVGK (KRAS G12V)
VSGAVGVGL

SEQ ID NO: 11660 - protein, 9 aa, Artificial Sequence
  Description of Artificial Sequence: Synthetic peptide
  Seed: VVGAVGVGK (KRAS G12V)
VSGAVGVGM

SEQ ID NO: 11661 - protein, 9 aa, Artificial Sequence
  Description of Artificial Sequence: Synthetic peptide
  Seed: VVGAVGVGK (KRAS G12V)
VSGAVGVGV

SEQ ID NO: 11662 - protein, 9 aa, Artificial Sequence
  Description of Artificial Sequence: Synthetic peptide
  Seed: VVGAVGVGK (KRAS G12V)
VSGAVGVGW

SEQ ID NO: 11663 - protein, 9 aa, Artificial Sequence
  Description of Artificial Sequence: Synthetic peptide
  Seed: VVGAVGVGK (KRAS G12V)
VSGAVGVGY

SEQ ID NO: 11664 - protein, 10 aa, Artificial Sequence
  Description of Artificial Sequence: Synthetic peptide
  Seed: VVVGAVGVGK (KRAS G12V)
VSVGAVGVGF

SEQ ID NO: 11665 - protein, 10 aa, Artificial Sequence
  Description of Artificial Sequence: Synthetic peptide
  Seed: VVVGAVGVGK (KRAS G12V)
VSVGAVGVGH

SEQ ID NO: 11666 - protein, 10 aa, Artificial Sequence
  Description of Artificial Sequence: Synthetic peptide
  Seed: VVVGAVGVGK (KRAS G12V)
VSVGAVGVGI

SEQ ID NO: 11667 - protein, 10 aa, Artificial Sequence
  Description of Artificial Sequence: Synthetic peptide
  Seed: VVVGAVGVGK (KRAS G12V)
VSVGAVGVGL

SEQ ID NO: 11668 - protein, 10 aa, Artificial Sequence
  Description of Artificial Sequence: Synthetic peptide
  Seed: VVVGAVGVGK (KRAS G12V)
VSVGAVGVGM

SEQ ID NO: 11669 - protein, 10 aa, Artificial Sequence
  Description of Artificial Sequence: Synthetic peptide
  Seed: VVVGAVGVGK (KRAS G12V)
VSVGAVGVGQ

SEQ ID NO: 11670 - protein, 10 aa, Artificial Sequence
  Description of Artificial Sequence: Synthetic peptide
  Seed: VVVGAVGVGK (KRAS G12V)
VSVGAVGVGV

SEQ ID NO: 11671 - protein, 10 aa, Artificial Sequence
  Description of Artificial Sequence: Synthetic peptide
  Seed: VVVGAVGVGK (KRAS G12V)
VSVGAVGVGW

SEQ ID NO: 11672 - protein, 10 aa, Artificial Sequence
  Description of Artificial Sequence: Synthetic peptide
  Seed: VVVGAVGVGK (KRAS G12V)
VSVGAVGVGY

SEQ ID NO: 11673 - protein, 10 aa, Artificial Sequence
  Description of Artificial Sequence: Synthetic peptide
  Seed: VGVGKSALTI (KRAS G12V)
VSVGKSALTL

SEQ ID NO: 11674 - protein, 8 aa, Artificial Sequence
  Description of Artificial Sequence: Synthetic peptide
  Seed: VGAVGVGK (KRAS G12V)
VTAVGVGF

SEQ ID NO: 11675 - protein, 8 aa, Artificial Sequence
  Description of Artificial Sequence: Synthetic peptide
  Seed: VGAVGVGK (KRAS G12V)
VTAVGVGI

SEQ ID NO: 11676 - protein, 8 aa, Artificial Sequence
  Description of Artificial Sequence: Synthetic peptide
  Seed: VGAVGVGK (KRAS G12V)
VTAVGVGK

SEQ ID NO: 11677 - protein, 11 aa, Artificial Sequence
  Description of Artificial Sequence: Synthetic peptide
  Seed: VGAVGVGKSAL (KRAS G12V)
VTAVGVGKSAF

SEQ ID NO: 11678 - protein, 11 aa, Artificial Sequence
  Description of Artificial Sequence: Synthetic peptide
  Seed: VGAVGVGKSAL (KRAS G12V)
VTAVGVGKSAK

SEQ ID NO: 11679 - protein, 11 aa, Artificial Sequence
  Description of Artificial Sequence: Synthetic peptide
  Seed: VGAVGVGKSAL (KRAS G12V)
VTAVGVGKSAL

SEQ ID NO: 11680 - protein, 11 aa, Artificial Sequence
  Description of Artificial Sequence: Synthetic peptide
  Seed: VGAVGVGKSAL (KRAS G12V)
VTAVGVGKSAM

SEQ ID NO: 11681 - protein, 11 aa, Artificial Sequence
  Description of Artificial Sequence: Synthetic peptide
  Seed: VGAVGVGKSAL (KRAS G12V)
VTAVGVGKSAR

SEQ ID NO: 11682 - protein, 11 aa, Artificial Sequence
  Description of Artificial Sequence: Synthetic peptide
  Seed: VGAVGVGKSAL (KRAS G12V)
VTAVGVGKSAY

SEQ ID NO: 11683 - protein, 8 aa, Artificial Sequence
  Description of Artificial Sequence: Synthetic peptide
  Seed: VGAVGVGK (KRAS G12V)
VTAVGVGL

SEQ ID NO: 11684 - protein, 8 aa, Artificial Sequence
  Description of Artificial Sequence: Synthetic peptide
  Seed: VGAVGVGK (KRAS G12V)
VTAVGVGM

SEQ ID NO: 11685 - protein, 8 aa, Artificial Sequence
  Description of Artificial Sequence: Synthetic peptide
  Seed: VGAVGVGK (KRAS G12V)
VTAVGVGR

SEQ ID NO: 11686 - protein, 8 aa, Artificial Sequence
  Description of Artificial Sequence: Synthetic peptide
  Seed: VGAVGVGK (KRAS G12V)
VTAVGVGY

SEQ ID NO: 11687 - protein, 9 aa, Artificial Sequence
  Description of Artificial Sequence: Synthetic peptide
  Seed: VVGAVGVGK (KRAS G12V)
VTGAVGVGF

SEQ ID NO: 11688 - protein, 9 aa, Artificial Sequence
  Description of Artificial Sequence: Synthetic peptide
  Seed: VVGAVGVGK (KRAS G12V)
VTGAVGVGH

SEQ ID NO: 11689 - protein, 9 aa, Artificial Sequence
  Description of Artificial Sequence: Synthetic peptide
  Seed: VVGAVGVGK (KRAS G12V)
VTGAVGVGI

SEQ ID NO: 11690 - protein, 9 aa, Artificial Sequence
  Description of Artificial Sequence: Synthetic peptide
  Seed: VVGAVGVGK (KRAS G12V)
VTGAVGVGL

SEQ ID NO: 11691 - protein, 9 aa, Artificial Sequence
  Description of Artificial Sequence: Synthetic peptide
  Seed: VVGAVGVGK (KRAS G12V)
VTGAVGVGM

SEQ ID NO: 11692 - protein, 9 aa, Artificial Sequence
  Description of Artificial Sequence: Synthetic peptide
  Seed: VVGAVGVGK (KRAS G12V)
VTGAVGVGV

SEQ ID NO: 11693 - protein, 9 aa, Artificial Sequence
  Description of Artificial Sequence: Synthetic peptide
  Seed: VVGAVGVGK (KRAS G12V)
VTGAVGVGY

SEQ ID NO: 11694 - protein, 10 aa, Artificial Sequence
  Description of Artificial Sequence: Synthetic peptide
  Seed: VVVGAVGVGK (KRAS G12V)
VTVGAVGVGF

SEQ ID NO: 11695 - protein, 10 aa, Artificial Sequence
  Description of Artificial Sequence: Synthetic peptide
  Seed: VVVGAVGVGK (KRAS G12V)
VTVGAVGVGH

SEQ ID NO: 11696 - protein, 10 aa, Artificial Sequence
  Description of Artificial Sequence: Synthetic peptide
  Seed: VVVGAVGVGK (KRAS G12V)
VTVGAVGVGI

SEQ ID NO: 11697 - protein, 10 aa, Artificial Sequence
  Description of Artificial Sequence: Synthetic peptide
  Seed: VVVGAVGVGK (KRAS G12V)
VTVGAVGVGL

SEQ ID NO: 11698 - protein, 10 aa, Artificial Sequence
  Description of Artificial Sequence: Synthetic peptide
  Seed: VVVGAVGVGK (KRAS G12V)
VTVGAVGVGM

SEQ ID NO: 11699 - protein, 10 aa, Artificial Sequence
  Description of Artificial Sequence: Synthetic peptide
  Seed: VVVGAVGVGK (KRAS G12V)
VTVGAVGVGQ

SEQ ID NO: 11700 - protein, 10 aa, Artificial Sequence
  Description of Artificial Sequence: Synthetic peptide
  Seed: VVVGAVGVGK (KRAS G12V)
VTVGAVGVGW

SEQ ID NO: 11701 - protein, 10 aa, Artificial Sequence
  Description of Artificial Sequence: Synthetic peptide
  Seed: VVVGAVGVGK (KRAS G12V)
VTVGAVGVGY

SEQ ID NO: 11702 - protein, 10 aa, Artificial Sequence
  Description of Artificial Sequence: Synthetic peptide
  Seed: VGVGKSALTI (KRAS G12V)
VTVGKSALTL

SEQ ID NO: 11703 - protein, 8 aa, Artificial Sequence
  Description of Artificial Sequence: Synthetic peptide
  Seed: VGAVGVGK (KRAS G12V)
VVAVGVGF

SEQ ID NO: 11704 - protein, 8 aa, Artificial Sequence
  Description of Artificial Sequence: Synthetic peptide
  Seed: VGAVGVGK (KRAS G12V)
VVAVGVGK

SEQ ID NO: 11705 - protein, 11 aa, Artificial Sequence
  Description of Artificial Sequence: Synthetic peptide
  Seed: VGAVGVGKSAL (KRAS G12V)
VVAVGVGKSAF

SEQ ID NO: 11706 - protein, 11 aa, Artificial Sequence
  Description of Artificial Sequence: Synthetic peptide
  Seed: VGAVGVGKSAL (KRAS G12V)
VVAVGVGKSAK

SEQ ID NO: 11707 - protein, 11 aa, Artificial Sequence
  Description of Artificial Sequence: Synthetic peptide
  Seed: VGAVGVGKSAL (KRAS G12V)
VVAVGVGKSAL

SEQ ID NO: 11708 - protein, 11 aa, Artificial Sequence
  Description of Artificial Sequence: Synthetic peptide
  Seed: VGAVGVGKSAL (KRAS G12V)
VVAVGVGKSAR

SEQ ID NO: 11709 - protein, 11 aa, Artificial Sequence
  Description of Artificial Sequence: Synthetic peptide
  Seed: VGAVGVGKSAL (KRAS G12V)
VVAVGVGKSAY

SEQ ID NO: 11710 - protein, 8 aa, Artificial Sequence
  Description of Artificial Sequence: Synthetic peptide
  Seed: VGAVGVGK (KRAS G12V)
VVAVGVGL

SEQ ID NO: 11711 - protein, 8 aa, Artificial Sequence
  Description of Artificial Sequence: Synthetic peptide
  Seed: VGAVGVGK (KRAS G12V)
VVAVGVGR

SEQ ID NO: 11712 - protein, 8 aa, Artificial Sequence
  Description of Artificial Sequence: Synthetic peptide
  Seed: VGAVGVGK (KRAS G12V)
VVAVGVGY

SEQ ID NO: 11713 - protein, 9 aa, Artificial Sequence
  Description of Artificial Sequence: Synthetic peptide
  Seed: VVGAVGVGK (KRAS G12V)
VVGAVGVGF

SEQ ID NO: 11714 - protein, 9 aa, Artificial Sequence
  Description of Artificial Sequence: Synthetic peptide
  Seed: VVGAVGVGK (KRAS G12V)
VVGAVGVGH

SEQ ID NO: 11715 - protein, 9 aa, Artificial Sequence
  Description of Artificial Sequence: Synthetic peptide
  Seed: VVGAVGVGK (KRAS G12V)
VVGAVGVGL

SEQ ID NO: 11716 - protein, 9 aa, Artificial Sequence
  Description of Artificial Sequence: Synthetic peptide
  Seed: VVGAVGVGK (KRAS G12V)
VVGAVGVGM

SEQ ID NO: 11717 - protein, 9 aa, Artificial Sequence
  Description of Artificial Sequence: Synthetic peptide
  Seed: VVGAVGVGK (KRAS G12V)
VVGAVGVGY

SEQ ID NO: 11718 - protein, 10 aa, Artificial Sequence
  Description of Artificial Sequence: Synthetic peptide
  Seed: VVVGAVGVGK (KRAS G12V)
VVVGAVGVGF

SEQ ID NO: 11719 - protein, 10 aa, Artificial Sequence
  Description of Artificial Sequence: Synthetic peptide
  Seed: VVVGAVGVGK (KRAS G12V)
VVVGAVGVGH

SEQ ID NO: 11720 - protein, 10 aa, Artificial Sequence
  Description of Artificial Sequence: Synthetic peptide
  Seed: VVVGAVGVGK (KRAS G12V)
VVVGAVGVGL

SEQ ID NO: 11721 - protein, 10 aa, Artificial Sequence
  Description of Artificial Sequence: Synthetic peptide
  Seed: VVVGAVGVGK (KRAS G12V)
VVVGAVGVGM

SEQ ID NO: 11722 - protein, 10 aa, Artificial Sequence
  Description of Artificial Sequence: Synthetic peptide
  Seed: VVVGAVGVGK (KRAS G12V)
VVVGAVGVGQ

SEQ ID NO: 11723 - protein, 10 aa, Artificial Sequence
  Description of Artificial Sequence: Synthetic peptide
  Seed: VVVGAVGVGK (KRAS G12V)
VVVGAVGVGY

SEQ ID NO: 11724 - protein, 10 aa, Artificial Sequence
  Description of Artificial Sequence: Synthetic peptide
  Seed: VGVGKSALTI (KRAS G12V)
VVVGKSALTL

SEQ ID NO: 11725 - protein, 10 aa, Artificial Sequence
  Description of Artificial Sequence: Synthetic peptide
  Seed: VVVGAVGVGK (KRAS G12V)
VWVGAVGVGF

SEQ ID NO: 11726 - protein, 10 aa, Artificial Sequence
  Description of Artificial Sequence: Synthetic peptide
  Seed: VVVGAVGVGK (KRAS G12V)
VWVGAVGVGY

SEQ ID NO: 11727 - protein, 9 aa, Artificial Sequence
  Description of Artificial Sequence: Synthetic peptide
  Seed: VVGAVGVGK (KRAS G12V)
VYGAVGVGF

SEQ ID NO: 11728 - protein, 9 aa, Artificial Sequence
  Description of Artificial Sequence: Synthetic peptide
  Seed: VVGAVGVGK (KRAS G12V)
VYGAVGVGL

SEQ ID NO: 11729 - protein, 9 aa, Artificial Sequence
  Description of Artificial Sequence: Synthetic peptide
  Seed: VVGAVGVGK (KRAS G12V)
VYGAVGVGM

SEQ ID NO: 11730 - protein, 9 aa, Artificial Sequence
  Description of Artificial Sequence: Synthetic peptide
  Seed: VVGAVGVGK (KRAS G12V)
VYGAVGVGY

SEQ ID NO: 11731 - protein, 10 aa, Artificial Sequence
  Description of Artificial Sequence: Synthetic peptide
  Seed: VVVGAVGVGK (KRAS G12V)
VYVGAVGVGF

SEQ ID NO: 11732 - protein, 10 aa, Artificial Sequence
  Description of Artificial Sequence: Synthetic peptide
  Seed: VVVGAVGVGK (KRAS G12V)
VYVGAVGVGL

SEQ ID NO: 11733 - protein, 10 aa, Artificial Sequence
  Description of Artificial Sequence: Synthetic peptide
  Seed: VVVGAVGVGK (KRAS G12V)
VYVGAVGVGM

SEQ ID NO: 11734 - protein, 10 aa, Artificial Sequence
  Description of Artificial Sequence: Synthetic peptide
  Seed: VVVGAVGVGK (KRAS G12V)
VYVGAVGVGY

SEQ ID NO: 11735 - protein, 10 aa, Homo sapiens
  Native (KRAS G12V)
KLVVVGAVGV

SEQ ID NO: 11736 - protein, 9 aa, Homo sapiens
  Native (KRAS G12V)
LVVVGAVGV

SEQ ID NO: 11737 - protein, 9 aa, Homo sapiens
  Native (KRAS G12V)
VVGAVGVGK

SEQ ID NO: 11738 - protein, 10 aa, Homo sapiens
  Native (KRAS G12V)
VVVGAVGVGK

SEQ ID NO: 11739 - protein, 9 aa, Homo sapiens
  Native (KRAS G12V)
GAVGVGKSA

SEQ ID NO: 11740 - protein, 10 aa, Homo sapiens
  Native (KRAS G12V)
GAVGVGKSAL

SEQ ID NO: 11741 - protein, 11 aa, Homo sapiens
  Native (KRAS G12V)
LVVVGAVGVGK

SEQ ID NO: 11742 - protein, 8 aa, Homo sapiens
  Native (KRAS G12V)
VGAVGVGK

SEQ ID NO: 11743 - protein, 11 aa, Homo sapiens
  Native (KRAS G12V)
VGAVGVGKSAL

SEQ ID NO: 11744 - protein, 10 aa, Homo sapiens
  Native (KRAS G12V)
VGVGKSALTI

SEQ ID NO: 11745 - protein, 9 aa, Artificial Sequence
  Description of Artificial Sequence: Synthetic peptide
  Seed: AGDVGKSAL (KRAS G13D)
AADVGKSAF

SEQ ID NO: 11746 - protein, 9 aa, Artificial Sequence
  Description of Artificial Sequence: Synthetic peptide
  Seed: AGDVGKSAL (KRAS G13D)
AADVGKSAI

SEQ ID NO: 11747 - protein, 9 aa, Artificial Sequence
  Description of Artificial Sequence: Synthetic peptide
  Seed: AGDVGKSAL (KRAS G13D)
AADVGKSAV

SEQ ID NO: 11748 - protein, 9 aa, Artificial Sequence
  Description of Artificial Sequence: Synthetic peptide
  Seed: AGDVGKSAL (KRAS G13D)
ACDVGKSAL

SEQ ID NO: 11749 - protein, 9 aa, Artificial Sequence
  Description of Artificial Sequence: Synthetic peptide
  Seed: AGDVGKSAL (KRAS G13D)
ACDVGKSAM

SEQ ID NO: 11750 - protein, 9 aa, Artificial Sequence
  Description of Artificial Sequence: Synthetic peptide
  Seed: AGDVGKSAL (KRAS G13D)
AGDVGKSAF

SEQ ID NO: 11751 - protein, 9 aa, Artificial Sequence
  Description of Artificial Sequence: Synthetic peptide
  Seed: AGDVGKSAL (KRAS G13D)
AGDVGKSAM

SEQ ID NO: 11752 - protein, 9 aa, Artificial Sequence
  Description of Artificial Sequence: Synthetic peptide
  Seed: AGDVGKSAL (KRAS G13D)
AIDVGKSAF

SEQ ID NO: 11753 - protein, 9 aa, Artificial Sequence
  Description of Artificial Sequence: Synthetic peptide
  Seed: AGDVGKSAL (KRAS G13D)
AIDVGKSAL

SEQ ID NO: 11754 - protein, 9 aa, Artificial Sequence
  Description of Artificial Sequence: Synthetic peptide
  Seed: AGDVGKSAL (KRAS G13D)
AIDVGKSAM

SEQ ID NO: 11755 - protein, 9 aa, Artificial Sequence
  Description of Artificial Sequence: Synthetic peptide
  Seed: AGDVGKSAL (KRAS G13D)
ALDVGKSAF

SEQ ID NO: 11756 - protein, 9 aa, Artificial Sequence
  Description of Artificial Sequence: Synthetic peptide
  Seed: AGDVGKSAL (KRAS G13D)
ALDVGKSAL

SEQ ID NO: 11757 - protein, 9 aa, Artificial Sequence
  Description of Artificial Sequence: Synthetic peptide
  Seed: AGDVGKSAL (KRAS G13D)
ALDVGKSAM

SEQ ID NO: 11758 - protein, 9 aa, Artificial Sequence
  Description of Artificial Sequence: Synthetic peptide
  Seed: AGDVGKSAL (KRAS G13D)
AMDVGKSAF

SEQ ID NO: 11759 - protein, 9 aa, Artificial Sequence
  Description of Artificial Sequence: Synthetic peptide
  Seed: AGDVGKSAL (KRAS G13D)
AMDVGKSAL

SEQ ID NO: 11760 - protein, 9 aa, Artificial Sequence
  Description of Artificial Sequence: Synthetic peptide
  Seed: AGDVGKSAL (KRAS G13D)
AMDVGKSAM

SEQ ID NO: 11761 - protein, 9 aa, Artificial Sequence
  Description of Artificial Sequence: Synthetic peptide
  Seed: AGDVGKSAL (KRAS G13D)
AQDVGKSAF

SEQ ID NO: 11762 - protein, 9 aa, Artificial Sequence
  Description of Artificial Sequence: Synthetic peptide
  Seed: AGDVGKSAL (KRAS G13D)
AQDVGKSAL

SEQ ID NO: 11763 - protein, 9 aa, Artificial Sequence
  Description of Artificial Sequence: Synthetic peptide
  Seed: AGDVGKSAL (KRAS G13D)
AQDVGKSAM

SEQ ID NO: 11764 - protein, 9 aa, Artificial Sequence
  Description of Artificial Sequence: Synthetic peptide
  Seed: AGDVGKSAL (KRAS G13D)
ASDVGKSAF

SEQ ID NO: 11765 - protein, 9 aa, Artificial Sequence
  Description of Artificial Sequence: Synthetic peptide
  Seed: AGDVGKSAL (KRAS G13D)
ASDVGKSAI

SEQ ID NO: 11766 - protein, 9 aa, Artificial Sequence
  Description of Artificial Sequence: Synthetic peptide
  Seed: AGDVGKSAL (KRAS G13D)
ASDVGKSAV

SEQ ID NO: 11767 - protein, 9 aa, Artificial Sequence
  Description of Artificial Sequence: Synthetic peptide
  Seed: AGDVGKSAL (KRAS G13D)
ATDVGKSAF

SEQ ID NO: 11768 - protein, 9 aa, Artificial Sequence
  Description of Artificial Sequence: Synthetic peptide
  Seed: AGDVGKSAL (KRAS G13D)
ATDVGKSAI

SEQ ID NO: 11769 - protein, 9 aa, Artificial Sequence
  Description of Artificial Sequence: Synthetic peptide
  Seed: AGDVGKSAL (KRAS G13D)
ATDVGKSAL

SEQ ID NO: 11770 - protein, 9 aa, Artificial Sequence
  Description of Artificial Sequence: Synthetic peptide
  Seed: AGDVGKSAL (KRAS G13D)
ATDVGKSAM

SEQ ID NO: 11771 - protein, 9 aa, Artificial Sequence
  Description of Artificial Sequence: Synthetic peptide
  Seed: AGDVGKSAL (KRAS G13D)
ATDVGKSAV

SEQ ID NO: 11772 - protein, 9 aa, Artificial Sequence
  Description of Artificial Sequence: Synthetic peptide
  Seed: AGDVGKSAL (KRAS G13D)
AVDVGKSAF

SEQ ID NO: 11773 - protein, 9 aa, Artificial Sequence
  Description of Artificial Sequence: Synthetic peptide
  Seed: AGDVGKSAL (KRAS G13D)
AVDVGKSAI

SEQ ID NO: 11774 - protein, 9 aa, Artificial Sequence
  Description of Artificial Sequence: Synthetic peptide
  Seed: AGDVGKSAL (KRAS G13D)
AVDVGKSAL

SEQ ID NO: 11775 - protein, 9 aa, Artificial Sequence
  Description of Artificial Sequence: Synthetic peptide
  Seed: AGDVGKSAL (KRAS G13D)
AVDVGKSAM

SEQ ID NO: 11776 - protein, 9 aa, Artificial Sequence
  Description of Artificial Sequence: Synthetic peptide
  Seed: AGDVGKSAL (KRAS G13D)
AVDVGKSAV

SEQ ID NO: 11777 - protein, 10 aa, Artificial Sequence
  Description of Artificial Sequence: Synthetic peptide
  Seed: KLVVVGAGDV (KRAS G13D)
KIVVVGAGDV

SEQ ID NO: 11778 - protein, 10 aa, Artificial Sequence
  Description of Artificial Sequence: Synthetic peptide
  Seed: KLVVVGAGDV (KRAS G13D)
KLVVVGAGDA

SEQ ID NO: 11779 - protein, 10 aa, Artificial Sequence
  Description of Artificial Sequence: Synthetic peptide
  Seed: KLVVVGAGDV (KRAS G13D)
KLVVVGAGDI

SEQ ID NO: 11780 - protein, 10 aa, Artificial Sequence
  Description of Artificial Sequence: Synthetic peptide
  Seed: KLVVVGAGDV (KRAS G13D)
KLVVVGAGDL

SEQ ID NO: 11781 - protein, 10 aa, Artificial Sequence
  Description of Artificial Sequence: Synthetic peptide
  Seed: KLVVVGAGDV (KRAS G13D)
KMVVVGAGDA

SEQ ID NO: 11782 - protein, 10 aa, Artificial Sequence
  Description of Artificial Sequence: Synthetic peptide
  Seed: KLVVVGAGDV (KRAS G13D)
KMVVVGAGDI

SEQ ID NO: 11783 - protein, 10 aa, Artificial Sequence
  Description of Artificial Sequence: Synthetic peptide
  Seed: KLVVVGAGDV (KRAS G13D)
KMVVVGAGDL

SEQ ID NO: 11784 - protein, 10 aa, Artificial Sequence
  Description of Artificial Sequence: Synthetic peptide
  Seed: KLVVVGAGDV (KRAS G13D)
KQVVVGAGDV

SEQ ID NO: 11785 - protein, 10 aa, Artificial Sequence
  Description of Artificial Sequence: Synthetic peptide
  Seed: KLVVVGAGDV (KRAS G13D)
KVVVVGAGDV

SEQ ID NO: 11786 - protein, 10 aa, Artificial Sequence
  Description of Artificial Sequence: Synthetic peptide
  Seed: VVVGAGDVGK (KRAS G13D)
VAVGAGDVGK

SEQ ID NO: 11787 - protein, 10 aa, Artificial Sequence
  Description of Artificial Sequence: Synthetic peptide
  Seed: VVVGAGDVGK (KRAS G13D)
VAVGAGDVGR

SEQ ID NO: 11788 - protein, 10 aa, Artificial Sequence
  Description of Artificial Sequence: Synthetic peptide
  Seed: VVVGAGDVGK (KRAS G13D)
VFVGAGDVGR

SEQ ID NO: 11789 - protein, 9 aa, Artificial Sequence
  Description of Artificial Sequence: Synthetic peptide
  Seed: VVGAGDVGK (KRAS G13D)
VIGAGDVGK

SEQ ID NO: 11790 - protein, 10 aa, Artificial Sequence
  Description of Artificial Sequence: Synthetic peptide
  Seed: VVVGAGDVGK (KRAS G13D)
VIVGAGDVGK

SEQ ID NO: 11791 - protein, 10 aa, Artificial Sequence
  Description of Artificial Sequence: Synthetic peptide
  Seed: VVVGAGDVGK (KRAS G13D)
VIVGAGDVGR

SEQ ID NO: 11792 - protein, 9 aa, Artificial Sequence
  Description of Artificial Sequence: Synthetic peptide
  Seed: VVGAGDVGK (KRAS G13D)
VLGAGDVGK

SEQ ID NO: 11793 - protein, 9 aa, Artificial Sequence
  Description of Artificial Sequence: Synthetic peptide
  Seed: VVGAGDVGK (KRAS G13D)
VMGAGDVGK

SEQ ID NO: 11794 - protein, 10 aa, Artificial Sequence
  Description of Artificial Sequence: Synthetic peptide
  Seed: VVVGAGDVGK (KRAS G13D)
VMVGAGDVGK

SEQ ID NO: 11795 - protein, 10 aa, Artificial Sequence
  Description of Artificial Sequence: Synthetic peptide
  Seed: VVVGAGDVGK (KRAS G13D)
VMVGAGDVGR

SEQ ID NO: 11796 - protein, 10 aa, Artificial Sequence
  Description of Artificial Sequence: Synthetic peptide
  Seed: VVVGAGDVGK (KRAS G13D)
VSVGAGDVGK

SEQ ID NO: 11797 - protein, 10 aa, Artificial Sequence
  Description of Artificial Sequence: Synthetic peptide
  Seed: VVVGAGDVGK (KRAS G13D)
VSVGAGDVGR

SEQ ID NO: 11798 - protein, 9 aa, Artificial Sequence
  Description of Artificial Sequence: Synthetic peptide
  Seed: VVGAGDVGK (KRAS G13D)
VTGAGDVGK

SEQ ID NO: 11799 - protein, 9 aa, Artificial Sequence
  Description of Artificial Sequence: Synthetic peptide
  Seed: AGDVGKSAL (KRAS G13D)
AADVGKSAA

SEQ ID NO: 11800 - protein, 9 aa, Artificial Sequence
  Description of Artificial Sequence: Synthetic peptide
  Seed: AGDVGKSAL (KRAS G13D)
AADVGKSAC

SEQ ID NO: 11801 - protein, 9 aa, Artificial Sequence
  Description of Artificial Sequence: Synthetic peptide
  Seed: AGDVGKSAL (KRAS G13D)
AADVGKSAH

SEQ ID NO: 11802 - protein, 9 aa, Artificial Sequence
  Description of Artificial Sequence: Synthetic peptide
  Seed: AGDVGKSAL (KRAS G13D)
AADVGKSAK

SEQ ID NO: 11803 - protein, 11 aa, Artificial Sequence
  Description of Artificial Sequence: Synthetic peptide
  Seed: AGDVGKSALTI (KRAS G13D)
AADVGKSALTA

SEQ ID NO: 11804 - protein, 11 aa, Artificial Sequence
  Description of Artificial Sequence: Synthetic peptide
  Seed: AGDVGKSALTI (KRAS G13D)
AADVGKSALTC

SEQ ID NO: 11805 - protein, 11 aa, Artificial Sequence
  Description of Artificial Sequence: Synthetic peptide
  Seed: AGDVGKSALTI (KRAS G13D)
AADVGKSALTF

SEQ ID NO: 11806 - protein, 11 aa, Artificial Sequence
  Description of Artificial Sequence: Synthetic peptide
  Seed: AGDVGKSALTI (KRAS G13D)
AADVGKSALTH

SEQ ID NO: 11807 - protein, 11 aa, Artificial Sequence
  Description of Artificial Sequence: Synthetic peptide
  Seed: AGDVGKSALTI (KRAS G13D)
AADVGKSALTI

SEQ ID NO: 11808 - protein, 11 aa, Artificial Sequence
  Description of Artificial Sequence: Synthetic peptide
  Seed: AGDVGKSALTI (KRAS G13D)
AADVGKSALTK

SEQ ID NO: 11809 - protein, 11 aa, Artificial Sequence
  Description of Artificial Sequence: Synthetic peptide
  Seed: AGDVGKSALTI (KRAS G13D)
AADVGKSALTL

SEQ ID NO: 11810 - protein, 11 aa, Artificial Sequence
  Description of Artificial Sequence: Synthetic peptide
  Seed: AGDVGKSALTI (KRAS G13D)
AADVGKSALTM

SEQ ID NO: 11811 - protein, 11 aa, Artificial Sequence
  Description of Artificial Sequence: Synthetic peptide
  Seed: AGDVGKSALTI (KRAS G13D)
AADVGKSALTT

SEQ ID NO: 11812 - protein, 11 aa, Artificial Sequence
  Description of Artificial Sequence: Synthetic peptide
  Seed: AGDVGKSALTI (KRAS G13D)
AADVGKSALTV

SEQ ID NO: 11813 - protein, 11 aa, Artificial Sequence
  Description of Artificial Sequence: Synthetic peptide
  Seed: AGDVGKSALTI (KRAS G13D)
AADVGKSALTW

SEQ ID NO: 11814 - protein, 11 aa, Artificial Sequence
  Description of Artificial Sequence: Synthetic peptide
  Seed: AGDVGKSALTI (KRAS G13D)
AADVGKSALTY

SEQ ID NO: 11815 - protein, 9 aa, Artificial Sequence
  Description of Artificial Sequence: Synthetic peptide
  Seed: AGDVGKSAL (KRAS G13D)
AADVGKSAP

SEQ ID NO: 11816 - protein, 9 aa, Artificial Sequence
  Description of Artificial Sequence: Synthetic peptide
  Seed: AGDVGKSAL (KRAS G13D)
AADVGKSAR

SEQ ID NO: 11817 - protein, 9 aa, Artificial Sequence
  Description of Artificial Sequence: Synthetic peptide
  Seed: AGDVGKSAL (KRAS G13D)
AADVGKSAS

SEQ ID NO: 11818 - protein, 9 aa, Artificial Sequence
  Description of Artificial Sequence: Synthetic peptide
  Seed: AGDVGKSAL (KRAS G13D)
AADVGKSAT

SEQ ID NO: 11819 - protein, 9 aa, Artificial Sequence
  Description of Artificial Sequence: Synthetic peptide
  Seed: AGDVGKSAL (KRAS G13D)
AADVGKSAW

SEQ ID NO: 11820 - protein, 9 aa, Artificial Sequence
  Description of Artificial Sequence: Synthetic peptide
  Seed: AGDVGKSAL (KRAS G13D)
AADVGKSAY

SEQ ID NO: 11821 - protein, 9 aa, Artificial Sequence
  Description of Artificial Sequence: Synthetic peptide
  Seed: AGDVGKSAL (KRAS G13D)
ACDVGKSAA

SEQ ID NO: 11822 - protein, 9 aa, Artificial Sequence
  Description of Artificial Sequence: Synthetic peptide
  Seed: AGDVGKSAL (KRAS G13D)
ACDVGKSAC

SEQ ID NO: 11823 - protein, 9 aa, Artificial Sequence
  Description of Artificial Sequence: Synthetic peptide
  Seed: AGDVGKSAL (KRAS G13D)
ACDVGKSAF

SEQ ID NO: 11824 - protein, 9 aa, Artificial Sequence
  Description of Artificial Sequence: Synthetic peptide
  Seed: AGDVGKSAL (KRAS G13D)
ACDVGKSAI

SEQ ID NO: 11825 - protein, 9 aa, Artificial Sequence
  Description of Artificial Sequence: Synthetic peptide
  Seed: AGDVGKSAL (KRAS G13D)
ACDVGKSAK

SEQ ID NO: 11826 - protein, 11 aa, Artificial Sequence
  Description of Artificial Sequence: Synthetic peptide
  Seed: AGDVGKSALTI (KRAS G13D)
ACDVGKSALTC

SEQ ID NO: 11827 - protein, 11 aa, Artificial Sequence
  Description of Artificial Sequence: Synthetic peptide
  Seed: AGDVGKSALTI (KRAS G13D)
ACDVGKSALTF

SEQ ID NO: 11828 - protein, 11 aa, Artificial Sequence
  Description of Artificial Sequence: Synthetic peptide
  Seed: AGDVGKSALTI (KRAS G13D)
ACDVGKSALTI

SEQ ID NO: 11829 - protein, 11 aa, Artificial Sequence
  Description of Artificial Sequence: Synthetic peptide
  Seed: AGDVGKSALTI (KRAS G13D)
ACDVGKSALTL

SEQ ID NO: 11830 - protein, 11 aa, Artificial Sequence
  Description of Artificial Sequence: Synthetic peptide
  Seed: AGDVGKSALTI (KRAS G13D)
ACDVGKSALTM

SEQ ID NO: 11831 - protein, 11 aa, Artificial Sequence
  Description of Artificial Sequence: Synthetic peptide
  Seed: AGDVGKSALTI (KRAS G13D)
ACDVGKSALTV

SEQ ID NO: 11832 - protein, 11 aa, Artificial Sequence
  Description of Artificial Sequence: Synthetic peptide
  Seed: AGDVGKSALTI (KRAS G13D)
ACDVGKSALTW

SEQ ID NO: 11833 - protein, 11 aa, Artificial Sequence
  Description of Artificial Sequence: Synthetic peptide
  Seed: AGDVGKSALTI (KRAS G13D)
ACDVGKSALTY

SEQ ID NO: 11834 - protein, 9 aa, Artificial Sequence
  Description of Artificial Sequence: Synthetic peptide
  Seed: AGDVGKSAL (KRAS G13D)
ACDVGKSAV

SEQ ID NO: 11835 - protein, 9 aa, Artificial Sequence
  Description of Artificial Sequence: Synthetic peptide
  Seed: AGDVGKSAL (KRAS G13D)
ACDVGKSAW

SEQ ID NO: 11836 - protein, 9 aa, Artificial Sequence
  Description of Artificial Sequence: Synthetic peptide
  Seed: AGDVGKSAL (KRAS G13D)
ACDVGKSAY

SEQ ID NO: 11837 - protein, 9 aa, Artificial Sequence
  Description of Artificial Sequence: Synthetic peptide
  Seed: AGDVGKSAL (KRAS G13D)
ADDVGKSAA

SEQ ID NO: 11838 - protein, 9 aa, Artificial Sequence
  Description of Artificial Sequence: Synthetic peptide
  Seed: AGDVGKSAL (KRAS G13D)
ADDVGKSAC

SEQ ID NO: 11839 - protein, 9 aa, Artificial Sequence
  Description of Artificial Sequence: Synthetic peptide
  Seed: AGDVGKSAL (KRAS G13D)
ADDVGKSAF

SEQ ID NO: 11840 - protein, 9 aa, Artificial Sequence
  Description of Artificial Sequence: Synthetic peptide
  Seed: AGDVGKSAL (KRAS G13D)
ADDVGKSAI

SEQ ID NO: 11841 - protein, 9 aa, Artificial Sequence
  Description of Artificial Sequence: Synthetic peptide
  Seed: AGDVGKSAL (KRAS G13D)
ADDVGKSAK

SEQ ID NO: 11842 - protein, 9 aa, Artificial Sequence
  Description of Artificial Sequence: Synthetic peptide
  Seed: AGDVGKSAL (KRAS G13D)
ADDVGKSAL

SEQ ID NO: 11843 - protein, 11 aa, Artificial Sequence
  Description of Artificial Sequence: Synthetic peptide
  Seed: AGDVGKSALTI (KRAS G13D)
ADDVGKSALTF

SEQ ID NO: 11844 - protein, 11 aa, Artificial Sequence
  Description of Artificial Sequence: Synthetic peptide
  Seed: AGDVGKSALTI (KRAS G13D)
ADDVGKSALTL

SEQ ID NO: 11845 - protein, 11 aa, Artificial Sequence
  Description of Artificial Sequence: Synthetic peptide
  Seed: AGDVGKSALTI (KRAS G13D)
ADDVGKSALTM

SEQ ID NO: 11846 - protein, 9 aa, Artificial Sequence
  Description of Artificial Sequence: Synthetic peptide
  Seed: AGDVGKSAL (KRAS G13D)
ADDVGKSAM

SEQ ID NO: 11847 - protein, 9 aa, Artificial Sequence
  Description of Artificial Sequence: Synthetic peptide
  Seed: AGDVGKSAL (KRAS G13D)
ADDVGKSAR

SEQ ID NO: 11848 - protein, 9 aa, Artificial Sequence
  Description of Artificial Sequence: Synthetic peptide
  Seed: AGDVGKSAL (KRAS G13D)
ADDVGKSAV

SEQ ID NO: 11849 - protein, 9 aa, Artificial Sequence
  Description of Artificial Sequence: Synthetic peptide
  Seed: AGDVGKSAL (KRAS G13D)
ADDVGKSAW

SEQ ID NO: 11850 - protein, 9 aa, Artificial Sequence
  Description of Artificial Sequence: Synthetic peptide
  Seed: AGDVGKSAL (KRAS G13D)
ADDVGKSAY

SEQ ID NO: 11851 - protein, 9 aa, Artificial Sequence
  Description of Artificial Sequence: Synthetic peptide
  Seed: AGDVGKSAL (KRAS G13D)
AEDVGKSAA

SEQ ID NO: 11852 - protein, 9 aa, Artificial Sequence
  Description of Artificial Sequence: Synthetic peptide
  Seed: AGDVGKSAL (KRAS G13D)
AEDVGKSAC

SEQ ID NO: 11853 - protein, 9 aa, Artificial Sequence
  Description of Artificial Sequence: Synthetic peptide
  Seed: AGDVGKSAL (KRAS G13D)
AEDVGKSAF

SEQ ID NO: 11854 - protein, 9 aa, Artificial Sequence
  Description of Artificial Sequence: Synthetic peptide
  Seed: AGDVGKSAL (KRAS G13D)
AEDVGKSAI

SEQ ID NO: 11855 - protein, 9 aa, Artificial Sequence
  Description of Artificial Sequence: Synthetic peptide
  Seed: AGDVGKSAL (KRAS G13D)
AEDVGKSAK

SEQ ID NO: 11856 - protein, 9 aa, Artificial Sequence
  Description of Artificial Sequence: Synthetic peptide
  Seed: AGDVGKSAL (KRAS G13D)
AEDVGKSAL

SEQ ID NO: 11857 - protein, 11 aa, Artificial Sequence
  Description of Artificial Sequence: Synthetic peptide
  Seed: AGDVGKSALTI (KRAS G13D)
AEDVGKSALTF

SEQ ID NO: 11858 - protein, 11 aa, Artificial Sequence
  Description of Artificial Sequence: Synthetic peptide
  Seed: AGDVGKSALTI (KRAS G13D)
AEDVGKSALTL

SEQ ID NO: 11859 - protein, 11 aa, Artificial Sequence
  Description of Artificial Sequence: Synthetic peptide
  Seed: AGDVGKSALTI (KRAS G13D)
AEDVGKSALTM

SEQ ID NO: 11860 - protein, 9 aa, Artificial Sequence
  Description of Artificial Sequence: Synthetic peptide
  Seed: AGDVGKSAL (KRAS G13D)
AEDVGKSAM

SEQ ID NO: 11861 - protein, 9 aa, Artificial Sequence
  Description of Artificial Sequence: Synthetic peptide
  Seed: AGDVGKSAL (KRAS G13D)
AEDVGKSAR

SEQ ID NO: 11862 - protein, 9 aa, Artificial Sequence
  Description of Artificial Sequence: Synthetic peptide
  Seed: AGDVGKSAL (KRAS G13D)
AEDVGKSAT

SEQ ID NO: 11863 - protein, 9 aa, Artificial Sequence
  Description of Artificial Sequence: Synthetic peptide
  Seed: AGDVGKSAL (KRAS G13D)
AEDVGKSAV

SEQ ID NO: 11864 - protein, 9 aa, Artificial Sequence
  Description of Artificial Sequence: Synthetic peptide
  Seed: AGDVGKSAL (KRAS G13D)
AEDVGKSAW

SEQ ID NO: 11865 - protein, 9 aa, Artificial Sequence
  Description of Artificial Sequence: Synthetic peptide
  Seed: AGDVGKSAL (KRAS G13D)
AEDVGKSAY

SEQ ID NO: 11866 - protein, 9 aa, Artificial Sequence
  Description of Artificial Sequence: Synthetic peptide
  Seed: AGDVGKSAL (KRAS G13D)
AFDVGKSAA

SEQ ID NO: 11867 - protein, 9 aa, Artificial Sequence
  Description of Artificial Sequence: Synthetic peptide
  Seed: AGDVGKSAL (KRAS G13D)
AFDVGKSAC

SEQ ID NO: 11868 - protein, 9 aa, Artificial Sequence
  Description of Artificial Sequence: Synthetic peptide
  Seed: AGDVGKSAL (KRAS G13D)
AFDVGKSAF

SEQ ID NO: 11869 - protein, 9 aa, Artificial Sequence
  Description of Artificial Sequence: Synthetic peptide
  Seed: AGDVGKSAL (KRAS G13D)
AFDVGKSAI

SEQ ID NO: 11870 - protein, 9 aa, Artificial Sequence
  Description of Artificial Sequence: Synthetic peptide
  Seed: AGDVGKSAL (KRAS G13D)
AFDVGKSAK

SEQ ID NO: 11871 - protein, 9 aa, Artificial Sequence
  Description of Artificial Sequence: Synthetic peptide
  Seed: AGDVGKSAL (KRAS G13D)
AFDVGKSAL

SEQ ID NO: 11872 - protein, 11 aa, Artificial Sequence
  Description of Artificial Sequence: Synthetic peptide
  Seed: AGDVGKSALTI (KRAS G13D)
AFDVGKSALTA

SEQ ID NO: 11873 - protein, 11 aa, Artificial Sequence
  Description of Artificial Sequence: Synthetic peptide
  Seed: AGDVGKSALTI (KRAS G13D)
AFDVGKSALTC

SEQ ID NO: 11874 - protein, 11 aa, Artificial Sequence
  Description of Artificial Sequence: Synthetic peptide
  Seed: AGDVGKSALTI (KRAS G13D)
AFDVGKSALTF

SEQ ID NO: 11875 - protein, 11 aa, Artificial Sequence
  Description of Artificial Sequence: Synthetic peptide
  Seed: AGDVGKSALTI (KRAS G13D)
AFDVGKSALTI

SEQ ID NO: 11876 - protein, 11 aa, Artificial Sequence
  Description of Artificial Sequence: Synthetic peptide
  Seed: AGDVGKSALTI (KRAS G13D)
AFDVGKSALTL

SEQ ID NO: 11877 - protein, 11 aa, Artificial Sequence
  Description of Artificial Sequence: Synthetic peptide
  Seed: AGDVGKSALTI (KRAS G13D)
AFDVGKSALTM

SEQ ID NO: 11878 - protein, 11 aa, Artificial Sequence
  Description of Artificial Sequence: Synthetic peptide
  Seed: AGDVGKSALTI (KRAS G13D)
AFDVGKSALTV

SEQ ID NO: 11879 - protein, 11 aa, Artificial Sequence
  Description of Artificial Sequence: Synthetic peptide
  Seed: AGDVGKSALTI (KRAS G13D)
AFDVGKSALTW

SEQ ID NO: 11880 - protein, 11 aa, Artificial Sequence
  Description of Artificial Sequence: Synthetic peptide
  Seed: AGDVGKSALTI (KRAS G13D)
AFDVGKSALTY

SEQ ID NO: 11881 - protein, 9 aa, Artificial Sequence
  Description of Artificial Sequence: Synthetic peptide
  Seed: AGDVGKSAL (KRAS G13D)
AFDVGKSAM

SEQ ID NO: 11882 - protein, 9 aa, Artificial Sequence
  Description of Artificial Sequence: Synthetic peptide
  Seed: AGDVGKSAL (KRAS G13D)
AFDVGKSAR

SEQ ID NO: 11883 - protein, 9 aa, Artificial Sequence
  Description of Artificial Sequence: Synthetic peptide
  Seed: AGDVGKSAL (KRAS G13D)
AFDVGKSAT

SEQ ID NO: 11884 - protein, 9 aa, Artificial Sequence
  Description of Artificial Sequence: Synthetic peptide
  Seed: AGDVGKSAL (KRAS G13D)
AFDVGKSAV

SEQ ID NO: 11885 - protein, 9 aa, Artificial Sequence
  Description of Artificial Sequence: Synthetic peptide
  Seed: AGDVGKSAL (KRAS G13D)
AFDVGKSAW

SEQ ID NO: 11886 - protein, 9 aa, Artificial Sequence
  Description of Artificial Sequence: Synthetic peptide
  Seed: AGDVGKSAL (KRAS G13D)
AFDVGKSAY

SEQ ID NO: 11887 - protein, 9 aa, Artificial Sequence
  Description of Artificial Sequence: Synthetic peptide
  Seed: AGDVGKSAL (KRAS G13D)
AGDVGKSAA

SEQ ID NO: 11888 - protein, 9 aa, Artificial Sequence
  Description of Artificial Sequence: Synthetic peptide
  Seed: AGDVGKSAL (KRAS G13D)
AGDVGKSAC

SEQ ID NO: 11889 - protein, 9 aa, Artificial Sequence
  Description of Artificial Sequence: Synthetic peptide
  Seed: AGDVGKSAL (KRAS G13D)
AGDVGKSAI

SEQ ID NO: 11890 - protein, 9 aa, Artificial Sequence
  Description of Artificial Sequence: Synthetic peptide
  Seed: AGDVGKSAL (KRAS G13D)
AGDVGKSAK

SEQ ID NO: 11891 - protein, 11 aa, Artificial Sequence
  Description of Artificial Sequence: Synthetic peptide
  Seed: AGDVGKSALTI (KRAS G13D)
AGDVGKSALTC

SEQ ID NO: 11892 - protein, 11 aa, Artificial Sequence
  Description of Artificial Sequence: Synthetic peptide
  Seed: AGDVGKSALTI (KRAS G13D)
AGDVGKSALTF

SEQ ID NO: 11893 - protein, 11 aa, Artificial Sequence
  Description of Artificial Sequence: Synthetic peptide
  Seed: AGDVGKSALTI (KRAS G13D)
AGDVGKSALTL

SEQ ID NO: 11894 - protein, 11 aa, Artificial Sequence
  Description of Artificial Sequence: Synthetic peptide
  Seed: AGDVGKSALTI (KRAS G13D)
AGDVGKSALTM

SEQ ID NO: 11895 - protein, 11 aa, Artificial Sequence
  Description of Artificial Sequence: Synthetic peptide
  Seed: AGDVGKSALTI (KRAS G13D)
AGDVGKSALTV

SEQ ID NO: 11896 - protein, 11 aa, Artificial Sequence
  Description of Artificial Sequence: Synthetic peptide
  Seed: AGDVGKSALTI (KRAS G13D)
AGDVGKSALTW

SEQ ID NO: 11897 - protein, 11 aa, Artificial Sequence
  Description of Artificial Sequence: Synthetic peptide
  Seed: AGDVGKSALTI (KRAS G13D)
AGDVGKSALTY

SEQ ID NO: 11898 - protein, 9 aa, Artificial Sequence
  Description of Artificial Sequence: Synthetic peptide
  Seed: AGDVGKSAL (KRAS G13D)
AGDVGKSAR

SEQ ID NO: 11899 - protein, 9 aa, Artificial Sequence
  Description of Artificial Sequence: Synthetic peptide
  Seed: AGDVGKSAL (KRAS G13D)
AGDVGKSAV

SEQ ID NO: 11900 - protein, 9 aa, Artificial Sequence
  Description of Artificial Sequence: Synthetic peptide
  Seed: AGDVGKSAL (KRAS G13D)
AGDVGKSAW

SEQ ID NO: 11901 - protein, 9 aa, Artificial Sequence
  Description of Artificial Sequence: Synthetic peptide
  Seed: AGDVGKSAL (KRAS G13D)
AGDVGKSAY

SEQ ID NO: 11902 - protein, 9 aa, Artificial Sequence
  Description of Artificial Sequence: Synthetic peptide
  Seed: AGDVGKSAL (KRAS G13D)
AHDVGKSAF

SEQ ID NO: 11903 - protein, 9 aa, Artificial Sequence
  Description of Artificial Sequence: Synthetic peptide
  Seed: AGDVGKSAL (KRAS G13D)
AHDVGKSAI

SEQ ID NO: 11904 - protein, 9 aa, Artificial Sequence
  Description of Artificial Sequence: Synthetic peptide
  Seed: AGDVGKSAL (KRAS G13D)
AHDVGKSAL

SEQ ID NO: 11905 - protein, 11 aa, Artificial Sequence
  Description of Artificial Sequence: Synthetic peptide
  Seed: AGDVGKSALTI (KRAS G13D)
AHDVGKSALTF

SEQ ID NO: 11906 - protein, 11 aa, Artificial Sequence
  Description of Artificial Sequence: Synthetic peptide
  Seed: AGDVGKSALTI (KRAS G13D)
AHDVGKSALTI

SEQ ID NO: 11907 - protein, 11 aa, Artificial Sequence
  Description of Artificial Sequence: Synthetic peptide
  Seed: AGDVGKSALTI (KRAS G13D)
AHDVGKSALTL

SEQ ID NO: 11908 - protein, 11 aa, Artificial Sequence
  Description of Artificial Sequence: Synthetic peptide
  Seed: AGDVGKSALTI (KRAS G13D)
AHDVGKSALTM

SEQ ID NO: 11909 - protein, 9 aa, Artificial Sequence
  Description of Artificial Sequence: Synthetic peptide
  Seed: AGDVGKSAL (KRAS G13D)
AHDVGKSAM

SEQ ID NO: 11910 - protein, 9 aa, Artificial Sequence
  Description of Artificial Sequence: Synthetic peptide
  Seed: AGDVGKSAL (KRAS G13D)
AHDVGKSAV

SEQ ID NO: 11911 - protein, 9 aa, Artificial Sequence
  Description of Artificial Sequence: Synthetic peptide
  Seed: AGDVGKSAL (KRAS G13D)
AHDVGKSAY

SEQ ID NO: 11912 - protein, 9 aa, Artificial Sequence
  Description of Artificial Sequence: Synthetic peptide
  Seed: AGDVGKSAL (KRAS G13D)
AIDVGKSAA

SEQ ID NO: 11913 - protein, 9 aa, Artificial Sequence
  Description of Artificial Sequence: Synthetic peptide
  Seed: AGDVGKSAL (KRAS G13D)
AIDVGKSAC

SEQ ID NO: 11914 - protein, 9 aa, Artificial Sequence
  Description of Artificial Sequence: Synthetic peptide
  Seed: AGDVGKSAL (KRAS G13D)
AIDVGKSAH

SEQ ID NO: 11915 - protein, 9 aa, Artificial Sequence
  Description of Artificial Sequence: Synthetic peptide
  Seed: AGDVGKSAL (KRAS G13D)
AIDVGKSAI

SEQ ID NO: 11916 - protein, 9 aa, Artificial Sequence
  Description of Artificial Sequence: Synthetic peptide
  Seed: AGDVGKSAL (KRAS G13D)
AIDVGKSAK

SEQ ID NO: 11917 - protein, 11 aa, Artificial Sequence
  Description of Artificial Sequence: Synthetic peptide
  Seed: AGDVGKSALTI (KRAS G13D)
AIDVGKSALTC

SEQ ID NO: 11918 - protein, 11 aa, Artificial Sequence
  Description of Artificial Sequence: Synthetic peptide
  Seed: AGDVGKSALTI (KRAS G13D)
AIDVGKSALTF

SEQ ID NO: 11919 - protein, 11 aa, Artificial Sequence
  Description of Artificial Sequence: Synthetic peptide
  Seed: AGDVGKSALTI (KRAS G13D)
AIDVGKSALTI

SEQ ID NO: 11920 - protein, 11 aa, Artificial Sequence
  Description of Artificial Sequence: Synthetic peptide
  Seed: AGDVGKSALTI (KRAS G13D)
AIDVGKSALTL

SEQ ID NO: 11921 - protein, 11 aa, Artificial Sequence
  Description of Artificial Sequence: Synthetic peptide
  Seed: AGDVGKSALTI (KRAS G13D)
AIDVGKSALTM

SEQ ID NO: 11922 - protein, 11 aa, Artificial Sequence
  Description of Artificial Sequence: Synthetic peptide
  Seed: AGDVGKSALTI (KRAS G13D)
AIDVGKSALTV

SEQ ID NO: 11923 - protein, 11 aa, Artificial Sequence
  Description of Artificial Sequence: Synthetic peptide
  Seed: AGDVGKSALTI (KRAS G13D)
AIDVGKSALTW

SEQ ID NO: 11924 - protein, 11 aa, Artificial Sequence
  Description of Artificial Sequence: Synthetic peptide
  Seed: AGDVGKSALTI (KRAS G13D)
AIDVGKSALTY

SEQ ID NO: 11925 - protein, 9 aa, Artificial Sequence
  Description of Artificial Sequence: Synthetic peptide
  Seed: AGDVGKSAL (KRAS G13D)
AIDVGKSAR

SEQ ID NO: 11926 - protein, 9 aa, Artificial Sequence
  Description of Artificial Sequence: Synthetic peptide
  Seed: AGDVGKSAL (KRAS G13D)
AIDVGKSAT

SEQ ID NO: 11927 - protein, 9 aa, Artificial Sequence
  Description of Artificial Sequence: Synthetic peptide
  Seed: AGDVGKSAL (KRAS G13D)
AIDVGKSAV

SEQ ID NO: 11928 - protein, 9 aa, Artificial Sequence
  Description of Artificial Sequence: Synthetic peptide
  Seed: AGDVGKSAL (KRAS G13D)
AIDVGKSAW

SEQ ID NO: 11929 - protein, 9 aa, Artificial Sequence
  Description of Artificial Sequence: Synthetic peptide
  Seed: AGDVGKSAL (KRAS G13D)
AIDVGKSAY

SEQ ID NO: 11930 - protein, 9 aa, Artificial Sequence
  Description of Artificial Sequence: Synthetic peptide
  Seed: AGDVGKSAL (KRAS G13D)
AKDVGKSAF

SEQ ID NO: 11931 - protein, 9 aa, Artificial Sequence
  Description of Artificial Sequence: Synthetic peptide
  Seed: AGDVGKSAL (KRAS G13D)
AKDVGKSAI

SEQ ID NO: 11932 - protein, 9 aa, Artificial Sequence
  Description of Artificial Sequence: Synthetic peptide
  Seed: AGDVGKSAL (KRAS G13D)
AKDVGKSAL

SEQ ID NO: 11933 - protein, 11 aa, Artificial Sequence
  Description of Artificial Sequence: Synthetic peptide
  Seed: AGDVGKSALTI (KRAS G13D)
AKDVGKSALTL

SEQ ID NO: 11934 - protein, 9 aa, Artificial Sequence
  Description of Artificial Sequence: Synthetic peptide
  Seed: AGDVGKSAL (KRAS G13D)
AKDVGKSAM

SEQ ID NO: 11935 - protein, 9 aa, Artificial Sequence
  Description of Artificial Sequence: Synthetic peptide
  Seed: AGDVGKSAL (KRAS G13D)
AKDVGKSAV

SEQ ID NO: 11936 - protein, 9 aa, Artificial Sequence
  Description of Artificial Sequence: Synthetic peptide
  Seed: AGDVGKSAL (KRAS G13D)
AKDVGKSAY

SEQ ID NO: 11937 - protein, 9 aa, Artificial Sequence
  Description of Artificial Sequence: Synthetic peptide
  Seed: AGDVGKSAL (KRAS G13D)
ALDVGKSAA

SEQ ID NO: 11938 - protein, 9 aa, Artificial Sequence
  Description of Artificial Sequence: Synthetic peptide
  Seed: AGDVGKSAL (KRAS G13D)
ALDVGKSAC

SEQ ID NO: 11939 - protein, 9 aa, Artificial Sequence
  Description of Artificial Sequence: Synthetic peptide
  Seed: AGDVGKSAL (KRAS G13D)
ALDVGKSAI

SEQ ID NO: 11940 - protein, 9 aa, Artificial Sequence
  Description of Artificial Sequence: Synthetic peptide
  Seed: AGDVGKSAL (KRAS G13D)
ALDVGKSAK

SEQ ID NO: 11941 - protein, 11 aa, Artificial Sequence
  Description of Artificial Sequence: Synthetic peptide
  Seed: AGDVGKSALTI (KRAS G13D)
ALDVGKSALTC

SEQ ID NO: 11942 - protein, 11 aa, Artificial Sequence
  Description of Artificial Sequence: Synthetic peptide
  Seed: AGDVGKSALTI (KRAS G13D)
ALDVGKSALTF

SEQ ID NO: 11943 - protein, 11 aa, Artificial Sequence
  Description of Artificial Sequence: Synthetic peptide
  Seed: AGDVGKSALTI (KRAS G13D)
ALDVGKSALTI

SEQ ID NO: 11944 - protein, 11 aa, Artificial Sequence
  Description of Artificial Sequence: Synthetic peptide
  Seed: AGDVGKSALTI (KRAS G13D)
ALDVGKSALTL

SEQ ID NO: 11945 - protein, 11 aa, Artificial Sequence
  Description of Artificial Sequence: Synthetic peptide
  Seed: AGDVGKSALTI (KRAS G13D)
ALDVGKSALTM

SEQ ID NO: 11946 - protein, 11 aa, Artificial Sequence
  Description of Artificial Sequence: Synthetic peptide
  Seed: AGDVGKSALTI (KRAS G13D)
ALDVGKSALTV

SEQ ID NO: 11947 - protein, 11 aa, Artificial Sequence
  Description of Artificial Sequence: Synthetic peptide
  Seed: AGDVGKSALTI (KRAS G13D)
ALDVGKSALTW

SEQ ID NO: 11948 - protein, 11 aa, Artificial Sequence
  Description of Artificial Sequence: Synthetic peptide
  Seed: AGDVGKSALTI (KRAS G13D)
ALDVGKSALTY

SEQ ID NO: 11949 - protein, 9 aa, Artificial Sequence
  Description of Artificial Sequence: Synthetic peptide
  Seed: AGDVGKSAL (KRAS G13D)
ALDVGKSAR

SEQ ID NO: 11950 - protein, 9 aa, Artificial Sequence
  Description of Artificial Sequence: Synthetic peptide
  Seed: AGDVGKSAL (KRAS G13D)
ALDVGKSAV

SEQ ID NO: 11951 - protein, 9 aa, Artificial Sequence
  Description of Artificial Sequence: Synthetic peptide
  Seed: AGDVGKSAL (KRAS G13D)
ALDVGKSAW

SEQ ID NO: 11952 - protein, 9 aa, Artificial Sequence
  Description of Artificial Sequence: Synthetic peptide
  Seed: AGDVGKSAL (KRAS G13D)
ALDVGKSAY

SEQ ID NO: 11953 - protein, 9 aa, Artificial Sequence
  Description of Artificial Sequence: Synthetic peptide
  Seed: AGDVGKSAL (KRAS G13D)
AMDVGKSAA

SEQ ID NO: 11954 - protein, 9 aa, Artificial Sequence
  Description of Artificial Sequence: Synthetic peptide
  Seed: AGDVGKSAL (KRAS G13D)
AMDVGKSAC

SEQ ID NO: 11955 - protein, 9 aa, Artificial Sequence
  Description of Artificial Sequence: Synthetic peptide
  Seed: AGDVGKSAL (KRAS G13D)
AMDVGKSAI

SEQ ID NO: 11956 - protein, 9 aa, Artificial Sequence
  Description of Artificial Sequence: Synthetic peptide
  Seed: AGDVGKSAL (KRAS G13D)
AMDVGKSAK

SEQ ID NO: 11957 - protein, 11 aa, Artificial Sequence
  Description of Artificial Sequence: Synthetic peptide
  Seed: AGDVGKSALTI (KRAS G13D)
AMDVGKSALTC

SEQ ID NO: 11958 - protein, 11 aa, Artificial Sequence
  Description of Artificial Sequence: Synthetic peptide
  Seed: AGDVGKSALTI (KRAS G13D)
AMDVGKSALTF

SEQ ID NO: 11959 - protein, 11 aa, Artificial Sequence
  Description of Artificial Sequence: Synthetic peptide
  Seed: AGDVGKSALTI (KRAS G13D)
AMDVGKSALTI

SEQ ID NO: 11960 - protein, 11 aa, Artificial Sequence
  Description of Artificial Sequence: Synthetic peptide
  Seed: AGDVGKSALTI (KRAS G13D)
AMDVGKSALTL

SEQ ID NO: 11961 - protein, 11 aa, Artificial Sequence
  Description of Artificial Sequence: Synthetic peptide
  Seed: AGDVGKSALTI (KRAS G13D)
AMDVGKSALTM

SEQ ID NO: 11962 - protein, 11 aa, Artificial Sequence
  Description of Artificial Sequence: Synthetic peptide
  Seed: AGDVGKSALTI (KRAS G13D)
AMDVGKSALTV

SEQ ID NO: 11963 - protein, 11 aa, Artificial Sequence
  Description of Artificial Sequence: Synthetic peptide
  Seed: AGDVGKSALTI (KRAS G13D)
AMDVGKSALTW

SEQ ID NO: 11964 - protein, 9 aa, Artificial Sequence
  Description of Artificial Sequence: Synthetic peptide
  Seed: AGDVGKSAL (KRAS G13D)
AMDVGKSAR

SEQ ID NO: 11965 - protein, 9 aa, Artificial Sequence
  Description of Artificial Sequence: Synthetic peptide
  Seed: AGDVGKSAL (KRAS G13D)
AMDVGKSAV

SEQ ID NO: 11966 - protein, 9 aa, Artificial Sequence
  Description of Artificial Sequence: Synthetic peptide
  Seed: AGDVGKSAL (KRAS G13D)
AMDVGKSAW

SEQ ID NO: 11967 - protein, 9 aa, Artificial Sequence
  Description of Artificial Sequence: Synthetic peptide
  Seed: AGDVGKSAL (KRAS G13D)
AMDVGKSAY

SEQ ID NO: 11968 - protein, 9 aa, Artificial Sequence
  Description of Artificial Sequence: Synthetic peptide
  Seed: AGDVGKSAL (KRAS G13D)
ANDVGKSAF

SEQ ID NO: 11969 - protein, 9 aa, Artificial Sequence
  Description of Artificial Sequence: Synthetic peptide
  Seed: AGDVGKSAL (KRAS G13D)
ANDVGKSAI

SEQ ID NO: 11970 - protein, 9 aa, Artificial Sequence
  Description of Artificial Sequence: Synthetic peptide
  Seed: AGDVGKSAL (KRAS G13D)
ANDVGKSAK

SEQ ID NO: 11971 - protein, 9 aa, Artificial Sequence
  Description of Artificial Sequence: Synthetic peptide
  Seed: AGDVGKSAL (KRAS G13D)
ANDVGKSAL

SEQ ID NO: 11972 - protein, 11 aa, Artificial Sequence
  Description of Artificial Sequence: Synthetic peptide
  Seed: AGDVGKSALTI (KRAS G13D)
ANDVGKSALTF

SEQ ID NO: 11973 - protein, 11 aa, Artificial Sequence
  Description of Artificial Sequence: Synthetic peptide
  Seed: AGDVGKSALTI (KRAS G13D)
ANDVGKSALTI

SEQ ID NO: 11974 - protein, 11 aa, Artificial Sequence
  Description of Artificial Sequence: Synthetic peptide
  Seed: AGDVGKSALTI (KRAS G13D)
ANDVGKSALTL

SEQ ID NO: 11975 - protein, 11 aa, Artificial Sequence
  Description of Artificial Sequence: Synthetic peptide
  Seed: AGDVGKSALTI (KRAS G13D)
ANDVGKSALTM

SEQ ID NO: 11976 - protein, 11 aa, Artificial Sequence
  Description of Artificial Sequence: Synthetic peptide
  Seed: AGDVGKSALTI (KRAS G13D)
ANDVGKSALTV

SEQ ID NO: 11977 - protein, 9 aa, Artificial Sequence
  Description of Artificial Sequence: Synthetic peptide
  Seed: AGDVGKSAL (KRAS G13D)
ANDVGKSAM

SEQ ID NO: 11978 - protein, 9 aa, Artificial Sequence
  Description of Artificial Sequence: Synthetic peptide
  Seed: AGDVGKSAL (KRAS G13D)
ANDVGKSAR

SEQ ID NO: 11979 - protein, 9 aa, Artificial Sequence
  Description of Artificial Sequence: Synthetic peptide
  Seed: AGDVGKSAL (KRAS G13D)
ANDVGKSAV

SEQ ID NO: 11980 - protein, 9 aa, Artificial Sequence
  Description of Artificial Sequence: Synthetic peptide
  Seed: AGDVGKSAL (KRAS G13D)
ANDVGKSAY

SEQ ID NO: 11981 - protein, 9 aa, Artificial Sequence
  Description of Artificial Sequence: Synthetic peptide
  Seed: AGDVGKSAL (KRAS G13D)
APDVGKSAF

SEQ ID NO: 11982 - protein, 9 aa, Artificial Sequence
  Description of Artificial Sequence: Synthetic peptide
  Seed: AGDVGKSAL (KRAS G13D)
APDVGKSAI

SEQ ID NO: 11983 - protein, 9 aa, Artificial Sequence
  Description of Artificial Sequence: Synthetic peptide
  Seed: AGDVGKSAL (KRAS G13D)
APDVGKSAK

SEQ ID NO: 11984 - protein, 9 aa, Artificial Sequence
  Description of Artificial Sequence: Synthetic peptide
  Seed: AGDVGKSAL (KRAS G13D)
APDVGKSAL

SEQ ID NO: 11985 - protein, 11 aa, Artificial Sequence
  Description of Artificial Sequence: Synthetic peptide
  Seed: AGDVGKSALTI (KRAS G13D)
APDVGKSALTF

SEQ ID NO: 11986 - protein, 11 aa, Artificial Sequence
  Description of Artificial Sequence: Synthetic peptide
  Seed: AGDVGKSALTI (KRAS G13D)
APDVGKSALTI

SEQ ID NO: 11987 - protein, 11 aa, Artificial Sequence
  Description of Artificial Sequence: Synthetic peptide
  Seed: AGDVGKSALTI (KRAS G13D)
APDVGKSALTL

SEQ ID NO: 11988 - protein, 11 aa, Artificial Sequence
  Description of Artificial Sequence: Synthetic peptide
  Seed: AGDVGKSALTI (KRAS G13D)
APDVGKSALTM

SEQ ID NO: 11989 - protein, 11 aa, Artificial Sequence
  Description of Artificial Sequence: Synthetic peptide
  Seed: AGDVGKSALTI (KRAS G13D)
APDVGKSALTV

SEQ ID NO: 11990 - protein, 9 aa, Artificial Sequence
  Description of Artificial Sequence: Synthetic peptide
  Seed: AGDVGKSAL (KRAS G13D)
APDVGKSAM

SEQ ID NO: 11991 - protein, 9 aa, Artificial Sequence
  Description of Artificial Sequence: Synthetic peptide
  Seed: AGDVGKSAL (KRAS G13D)
APDVGKSAV

SEQ ID NO: 11992 - protein, 9 aa, Artificial Sequence
  Description of Artificial Sequence: Synthetic peptide
  Seed: AGDVGKSAL (KRAS G13D)
APDVGKSAY

SEQ ID NO: 11993 - protein, 9 aa, Artificial Sequence
  Description of Artificial Sequence: Synthetic peptide
  Seed: AGDVGKSAL (KRAS G13D)
AQDVGKSAC

SEQ ID NO: 11994 - protein, 9 aa, Artificial Sequence
  Description of Artificial Sequence: Synthetic peptide
  Seed: AGDVGKSAL (KRAS G13D)
AQDVGKSAI

SEQ ID NO: 11995 - protein, 9 aa, Artificial Sequence
  Description of Artificial Sequence: Synthetic peptide
  Seed: AGDVGKSAL (KRAS G13D)
AQDVGKSAK

SEQ ID NO: 11996 - protein, 11 aa, Artificial Sequence
  Description of Artificial Sequence: Synthetic peptide
  Seed: AGDVGKSALTI (KRAS G13D)
AQDVGKSALTF

SEQ ID NO: 11997 - protein, 11 aa, Artificial Sequence
  Description of Artificial Sequence: Synthetic peptide
  Seed: AGDVGKSALTI (KRAS G13D)
AQDVGKSALTI

SEQ ID NO: 11998 - protein, 11 aa, Artificial Sequence
  Description of Artificial Sequence: Synthetic peptide
  Seed: AGDVGKSALTI (KRAS G13D)
AQDVGKSALTL

SEQ ID NO: 11999 - protein, 11 aa, Artificial Sequence
  Description of Artificial Sequence: Synthetic peptide
  Seed: AGDVGKSALTI (KRAS G13D)
AQDVGKSALTM

SEQ ID NO: 12000 - protein, 11 aa, Artificial Sequence
  Description of Artificial Sequence: Synthetic peptide
  Seed: AGDVGKSALTI (KRAS G13D)
AQDVGKSALTV

SEQ ID NO: 12001 - protein, 9 aa, Artificial Sequence
  Description of Artificial Sequence: Synthetic peptide
  Seed: AGDVGKSAL (KRAS G13D)
AQDVGKSAR

SEQ ID NO: 12002 - protein, 9 aa, Artificial Sequence
  Description of Artificial Sequence: Synthetic peptide
  Seed: AGDVGKSAL (KRAS G13D)
AQDVGKSAV

SEQ ID NO: 12003 - protein, 9 aa, Artificial Sequence
  Description of Artificial Sequence: Synthetic peptide
  Seed: AGDVGKSAL (KRAS G13D)
AQDVGKSAW

SEQ ID NO: 12004 - protein, 9 aa, Artificial Sequence
  Description of Artificial Sequence: Synthetic peptide
  Seed: AGDVGKSAL (KRAS G13D)
AQDVGKSAY

SEQ ID NO: 12005 - protein, 9 aa, Artificial Sequence
  Description of Artificial Sequence: Synthetic peptide
  Seed: AGDVGKSAL (KRAS G13D)
ARDVGKSAA

SEQ ID NO: 12006 - protein, 9 aa, Artificial Sequence
  Description of Artificial Sequence: Synthetic peptide
  Seed: AGDVGKSAL (KRAS G13D)
ARDVGKSAC

SEQ ID NO: 12007 - protein, 9 aa, Artificial Sequence
  Description of Artificial Sequence: Synthetic peptide
  Seed: AGDVGKSAL (KRAS G13D)
ARDVGKSAF

SEQ ID NO: 12008 - protein, 9 aa, Artificial Sequence
  Description of Artificial Sequence: Synthetic peptide
  Seed: AGDVGKSAL (KRAS G13D)
ARDVGKSAI

SEQ ID NO: 12009 - protein, 9 aa, Artificial Sequence
  Description of Artificial Sequence: Synthetic peptide
  Seed: AGDVGKSAL (KRAS G13D)
ARDVGKSAL

SEQ ID NO: 12010 - protein, 11 aa, Artificial Sequence
  Description of Artificial Sequence: Synthetic peptide
  Seed: AGDVGKSALTI (KRAS G13D)
ARDVGKSALTC

SEQ ID NO: 12011 - protein, 11 aa, Artificial Sequence
  Description of Artificial Sequence: Synthetic peptide
  Seed: AGDVGKSALTI (KRAS G13D)
ARDVGKSALTF

SEQ ID NO: 12012 - protein, 11 aa, Artificial Sequence
  Description of Artificial Sequence: Synthetic peptide
  Seed: AGDVGKSALTI (KRAS G13D)
ARDVGKSALTI

SEQ ID NO: 12013 - protein, 11 aa, Artificial Sequence
  Description of Artificial Sequence: Synthetic peptide
  Seed: AGDVGKSALTI (KRAS G13D)
ARDVGKSALTL

SEQ ID NO: 12014 - protein, 11 aa, Artificial Sequence
  Description of Artificial Sequence: Synthetic peptide
  Seed: AGDVGKSALTI (KRAS G13D)
ARDVGKSALTM

SEQ ID NO: 12015 - protein, 11 aa, Artificial Sequence
  Description of Artificial Sequence: Synthetic peptide
  Seed: AGDVGKSALTI (KRAS G13D)
ARDVGKSALTV

SEQ ID NO: 12016 - protein, 9 aa, Artificial Sequence
  Description of Artificial Sequence: Synthetic peptide
  Seed: AGDVGKSAL (KRAS G13D)
ARDVGKSAM

SEQ ID NO: 12017 - protein, 9 aa, Artificial Sequence
  Description of Artificial Sequence: Synthetic peptide
  Seed: AGDVGKSAL (KRAS G13D)
ARDVGKSAV

SEQ ID NO: 12018 - protein, 9 aa, Artificial Sequence
  Description of Artificial Sequence: Synthetic peptide
  Seed: AGDVGKSAL (KRAS G13D)
ARDVGKSAW

SEQ ID NO: 12019 - protein, 9 aa, Artificial Sequence
  Description of Artificial Sequence: Synthetic peptide
  Seed: AGDVGKSAL (KRAS G13D)
ARDVGKSAY

SEQ ID NO: 12020 - protein, 9 aa, Artificial Sequence
  Description of Artificial Sequence: Synthetic peptide
  Seed: AGDVGKSAL (KRAS G13D)
ASDVGKSAA

SEQ ID NO: 12021 - protein, 9 aa, Artificial Sequence
  Description of Artificial Sequence: Synthetic peptide
  Seed: AGDVGKSAL (KRAS G13D)
ASDVGKSAC

SEQ ID NO: 12022 - protein, 9 aa, Artificial Sequence
  Description of Artificial Sequence: Synthetic peptide
  Seed: AGDVGKSAL (KRAS G13D)
ASDVGKSAH

SEQ ID NO: 12023 - protein, 9 aa, Artificial Sequence
  Description of Artificial Sequence: Synthetic peptide
  Seed: AGDVGKSAL (KRAS G13D)
ASDVGKSAK

SEQ ID NO: 12024 - protein, 11 aa, Artificial Sequence
  Description of Artificial Sequence: Synthetic peptide
  Seed: AGDVGKSALTI (KRAS G13D)
ASDVGKSALTA

SEQ ID NO: 12025 - protein, 11 aa, Artificial Sequence
  Description of Artificial Sequence: Synthetic peptide
  Seed: AGDVGKSALTI (KRAS G13D)
ASDVGKSALTC

SEQ ID NO: 12026 - protein, 11 aa, Artificial Sequence
  Description of Artificial Sequence: Synthetic peptide
  Seed: AGDVGKSALTI (KRAS G13D)
ASDVGKSALTF

SEQ ID NO: 12027 - protein, 11 aa, Artificial Sequence
  Description of Artificial Sequence: Synthetic peptide
  Seed: AGDVGKSALTI (KRAS G13D)
ASDVGKSALTI

SEQ ID NO: 12028 - protein, 11 aa, Artificial Sequence
  Description of Artificial Sequence: Synthetic peptide
  Seed: AGDVGKSALTI (KRAS G13D)
ASDVGKSALTL

SEQ ID NO: 12029 - protein, 11 aa, Artificial Sequence
  Description of Artificial Sequence: Synthetic peptide
  Seed: AGDVGKSALTI (KRAS G13D)
ASDVGKSALTM

SEQ ID NO: 12030 - protein, 11 aa, Artificial Sequence
  Description of Artificial Sequence: Synthetic peptide
  Seed: AGDVGKSALTI (KRAS G13D)
ASDVGKSALTV

SEQ ID NO: 12031 - protein, 11 aa, Artificial Sequence
  Description of Artificial Sequence: Synthetic peptide
  Seed: AGDVGKSALTI (KRAS G13D)
ASDVGKSALTW

SEQ ID NO: 12032 - protein, 11 aa, Artificial Sequence
  Description of Artificial Sequence: Synthetic peptide
  Seed: AGDVGKSALTI (KRAS G13D)
ASDVGKSALTY

SEQ ID NO: 12033 - protein, 9 aa, Artificial Sequence
  Description of Artificial Sequence: Synthetic peptide
  Seed: AGDVGKSAL (KRAS G13D)
ASDVGKSAR

SEQ ID NO: 12034 - protein, 9 aa, Artificial Sequence
  Description of Artificial Sequence: Synthetic peptide
  Seed: AGDVGKSAL (KRAS G13D)
ASDVGKSAT

SEQ ID NO: 12035 - protein, 9 aa, Artificial Sequence
  Description of Artificial Sequence: Synthetic peptide
  Seed: AGDVGKSAL (KRAS G13D)
ASDVGKSAW

SEQ ID NO: 12036 - protein, 9 aa, Artificial Sequence
  Description of Artificial Sequence: Synthetic peptide
  Seed: AGDVGKSAL (KRAS G13D)
ASDVGKSAY

SEQ ID NO: 12037 - protein, 9 aa, Artificial Sequence
  Description of Artificial Sequence: Synthetic peptide
  Seed: AGDVGKSAL (KRAS G13D)
ATDVGKSAA

SEQ ID NO: 12038 - protein, 9 aa, Artificial Sequence
  Description of Artificial Sequence: Synthetic peptide
  Seed: AGDVGKSAL (KRAS G13D)
ATDVGKSAC

SEQ ID NO: 12039 - protein, 9 aa, Artificial Sequence
  Description of Artificial Sequence: Synthetic peptide
  Seed: AGDVGKSAL (KRAS G13D)
ATDVGKSAH

SEQ ID NO: 12040 - protein, 9 aa, Artificial Sequence
  Description of Artificial Sequence: Synthetic peptide
  Seed: AGDVGKSAL (KRAS G13D)
ATDVGKSAK

SEQ ID NO: 12041 - protein, 11 aa, Artificial Sequence
  Description of Artificial Sequence: Synthetic peptide
  Seed: AGDVGKSALTI (KRAS G13D)
ATDVGKSALTA

SEQ ID NO: 12042 - protein, 11 aa, Artificial Sequence
  Description of Artificial Sequence: Synthetic peptide
  Seed: AGDVGKSALTI (KRAS G13D)
ATDVGKSALTC

SEQ ID NO: 12043 - protein, 11 aa, Artificial Sequence
  Description of Artificial Sequence: Synthetic peptide
  Seed: AGDVGKSALTI (KRAS G13D)
ATDVGKSALTF

SEQ ID NO: 12044 - protein, 11 aa, Artificial Sequence
  Description of Artificial Sequence: Synthetic peptide
  Seed: AGDVGKSALTI (KRAS G13D)
ATDVGKSALTI

SEQ ID NO: 12045 - protein, 11 aa, Artificial Sequence
  Description of Artificial Sequence: Synthetic peptide
  Seed: AGDVGKSALTI (KRAS G13D)
ATDVGKSALTL

SEQ ID NO: 12046 - protein, 11 aa, Artificial Sequence
  Description of Artificial Sequence: Synthetic peptide
  Seed: AGDVGKSALTI (KRAS G13D)
ATDVGKSALTM

SEQ ID NO: 12047 - protein, 11 aa, Artificial Sequence
  Description of Artificial Sequence: Synthetic peptide
  Seed: AGDVGKSALTI (KRAS G13D)
ATDVGKSALTV

SEQ ID NO: 12048 - protein, 11 aa, Artificial Sequence
  Description of Artificial Sequence: Synthetic peptide
  Seed: AGDVGKSALTI (KRAS G13D)
ATDVGKSALTW

SEQ ID NO: 12049 - protein, 11 aa, Artificial Sequence
  Description of Artificial Sequence: Synthetic peptide
  Seed: AGDVGKSALTI (KRAS G13D)
ATDVGKSALTY

SEQ ID NO: 12050 - protein, 9 aa, Artificial Sequence
  Description of Artificial Sequence: Synthetic peptide
  Seed: AGDVGKSAL (KRAS G13D)
ATDVGKSAR

SEQ ID NO: 12051 - protein, 9 aa, Artificial Sequence
  Description of Artificial Sequence: Synthetic peptide
  Seed: AGDVGKSAL (KRAS G13D)
ATDVGKSAT

SEQ ID NO: 12052 - protein, 9 aa, Artificial Sequence
  Description of Artificial Sequence: Synthetic peptide
  Seed: AGDVGKSAL (KRAS G13D)
ATDVGKSAW

SEQ ID NO: 12053 - protein, 9 aa, Artificial Sequence
  Description of Artificial Sequence: Synthetic peptide
  Seed: AGDVGKSAL (KRAS G13D)
ATDVGKSAY

SEQ ID NO: 12054 - protein, 9 aa, Artificial Sequence
  Description of Artificial Sequence: Synthetic peptide
  Seed: AGDVGKSAL (KRAS G13D)
AVDVGKSAA

SEQ ID NO: 12055 - protein, 9 aa, Artificial Sequence
  Description of Artificial Sequence: Synthetic peptide
  Seed: AGDVGKSAL (KRAS G13D)
AVDVGKSAC

SEQ ID NO: 12056 - protein, 9 aa, Artificial Sequence
  Description of Artificial Sequence: Synthetic peptide
  Seed: AGDVGKSAL (KRAS G13D)
AVDVGKSAH

SEQ ID NO: 12057 - protein, 9 aa, Artificial Sequence
  Description of Artificial Sequence: Synthetic peptide
  Seed: AGDVGKSAL (KRAS G13D)
AVDVGKSAK

SEQ ID NO: 12058 - protein, 11 aa, Artificial Sequence
  Description of Artificial Sequence: Synthetic peptide
  Seed: AGDVGKSALTI (KRAS G13D)
AVDVGKSALTA

SEQ ID NO: 12059 - protein, 11 aa, Artificial Sequence
  Description of Artificial Sequence: Synthetic peptide
  Seed: AGDVGKSALTI (KRAS G13D)
AVDVGKSALTC

SEQ ID NO: 12060 - protein, 11 aa, Artificial Sequence
  Description of Artificial Sequence: Synthetic peptide
  Seed: AGDVGKSALTI (KRAS G13D)
AVDVGKSALTF

SEQ ID NO: 12061 - protein, 11 aa, Artificial Sequence
  Description of Artificial Sequence: Synthetic peptide
  Seed: AGDVGKSALTI (KRAS G13D)
AVDVGKSALTI

SEQ ID NO: 12062 - protein, 11 aa, Artificial Sequence
  Description of Artificial Sequence: Synthetic peptide
  Seed: AGDVGKSALTI (KRAS G13D)
AVDVGKSALTL

SEQ ID NO: 12063 - protein, 11 aa, Artificial Sequence
  Description of Artificial Sequence: Synthetic peptide
  Seed: AGDVGKSALTI (KRAS G13D)
AVDVGKSALTM

SEQ ID NO: 12064 - protein, 11 aa, Artificial Sequence
  Description of Artificial Sequence: Synthetic peptide
  Seed: AGDVGKSALTI (KRAS G13D)
AVDVGKSALTV

SEQ ID NO: 12065 - protein, 11 aa, Artificial Sequence
  Description of Artificial Sequence: Synthetic peptide
  Seed: AGDVGKSALTI (KRAS G13D)
AVDVGKSALTW

SEQ ID NO: 12066 - protein, 11 aa, Artificial Sequence
  Description of Artificial Sequence: Synthetic peptide
  Seed: AGDVGKSALTI (KRAS G13D)
AVDVGKSALTY

SEQ ID NO: 12067 - protein, 9 aa, Artificial Sequence
  Description of Artificial Sequence: Synthetic peptide
  Seed: AGDVGKSAL (KRAS G13D)
AVDVGKSAR

SEQ ID NO: 12068 - protein, 9 aa, Artificial Sequence
  Description of Artificial Sequence: Synthetic peptide
  Seed: AGDVGKSAL (KRAS G13D)
AVDVGKSAT

SEQ ID NO: 12069 - protein, 9 aa, Artificial Sequence
  Description of Artificial Sequence: Synthetic peptide
  Seed: AGDVGKSAL (KRAS G13D)
AVDVGKSAW

SEQ ID NO: 12070 - protein, 9 aa, Artificial Sequence
  Description of Artificial Sequence: Synthetic peptide
  Seed: AGDVGKSAL (KRAS G13D)
AVDVGKSAY

SEQ ID NO: 12071 - protein, 9 aa, Artificial Sequence
  Description of Artificial Sequence: Synthetic peptide
  Seed: AGDVGKSAL (KRAS G13D)
AWDVGKSAA

SEQ ID NO: 12072 - protein, 9 aa, Artificial Sequence
  Description of Artificial Sequence: Synthetic peptide
  Seed: AGDVGKSAL (KRAS G13D)
AWDVGKSAC

SEQ ID NO: 12073 - protein, 9 aa, Artificial Sequence
  Description of Artificial Sequence: Synthetic peptide
  Seed: AGDVGKSAL (KRAS G13D)
AWDVGKSAF

SEQ ID NO: 12074 - protein, 9 aa, Artificial Sequence
  Description of Artificial Sequence: Synthetic peptide
  Seed: AGDVGKSAL (KRAS G13D)
AWDVGKSAI

SEQ ID NO: 12075 - protein, 9 aa, Artificial Sequence
  Description of Artificial Sequence: Synthetic peptide
  Seed: AGDVGKSAL (KRAS G13D)
AWDVGKSAK

SEQ ID NO: 12076 - protein, 9 aa, Artificial Sequence
  Description of Artificial Sequence: Synthetic peptide
  Seed: AGDVGKSAL (KRAS G13D)
AWDVGKSAL

SEQ ID NO: 12077 - protein, 11 aa, Artificial Sequence
  Description of Artificial Sequence: Synthetic peptide
  Seed: AGDVGKSALTI (KRAS G13D)
AWDVGKSALTC

SEQ ID NO: 12078 - protein, 11 aa, Artificial Sequence
  Description of Artificial Sequence: Synthetic peptide
  Seed: AGDVGKSALTI (KRAS G13D)
AWDVGKSALTF

SEQ ID NO: 12079 - protein, 11 aa, Artificial Sequence
  Description of Artificial Sequence: Synthetic peptide
  Seed: AGDVGKSALTI (KRAS G13D)
AWDVGKSALTI

SEQ ID NO: 12080 - protein, 11 aa, Artificial Sequence
  Description of Artificial Sequence: Synthetic peptide
  Seed: AGDVGKSALTI (KRAS G13D)
AWDVGKSALTL

SEQ ID NO: 12081 - protein, 11 aa, Artificial Sequence
  Description of Artificial Sequence: Synthetic peptide
  Seed: AGDVGKSALTI (KRAS G13D)
AWDVGKSALTM

SEQ ID NO: 12082 - protein, 11 aa, Artificial Sequence
  Description of Artificial Sequence: Synthetic peptide
  Seed: AGDVGKSALTI (KRAS G13D)
AWDVGKSALTV

SEQ ID NO: 12083 - protein, 11 aa, Artificial Sequence
  Description of Artificial Sequence: Synthetic peptide
  Seed: AGDVGKSALTI (KRAS G13D)
AWDVGKSALTW

SEQ ID NO: 12084 - protein, 11 aa, Artificial Sequence
  Description of Artificial Sequence: Synthetic peptide
  Seed: AGDVGKSALTI (KRAS G13D)
AWDVGKSALTY

SEQ ID NO: 12085 - protein, 9 aa, Artificial Sequence
  Description of Artificial Sequence: Synthetic peptide
  Seed: AGDVGKSAL (KRAS G13D)
AWDVGKSAM

SEQ ID NO: 12086 - protein, 9 aa, Artificial Sequence
  Description of Artificial Sequence: Synthetic peptide
  Seed: AGDVGKSAL (KRAS G13D)
AWDVGKSAT

SEQ ID NO: 12087 - protein, 9 aa, Artificial Sequence
  Description of Artificial Sequence: Synthetic peptide
  Seed: AGDVGKSAL (KRAS G13D)
AWDVGKSAV

SEQ ID NO: 12088 - protein, 9 aa, Artificial Sequence
  Description of Artificial Sequence: Synthetic peptide
  Seed: AGDVGKSAL (KRAS G13D)
AWDVGKSAW

SEQ ID NO: 12089 - protein, 9 aa, Artificial Sequence
  Description of Artificial Sequence: Synthetic peptide
  Seed: AGDVGKSAL (KRAS G13D)
AWDVGKSAY

SEQ ID NO: 12090 - protein, 9 aa, Artificial Sequence
  Description of Artificial Sequence: Synthetic peptide
  Seed: AGDVGKSAL (KRAS G13D)
AYDVGKSAA

SEQ ID NO: 12091 - protein, 9 aa, Artificial Sequence
  Description of Artificial Sequence: Synthetic peptide
  Seed: AGDVGKSAL (KRAS G13D)
AYDVGKSAC

SEQ ID NO: 12092 - protein, 9 aa, Artificial Sequence
  Description of Artificial Sequence: Synthetic peptide
  Seed: AGDVGKSAL (KRAS G13D)
AYDVGKSAF

SEQ ID NO: 12093 - protein, 9 aa, Artificial Sequence
  Description of Artificial Sequence: Synthetic peptide
  Seed: AGDVGKSAL (KRAS G13D)
AYDVGKSAI

SEQ ID NO: 12094 - protein, 9 aa, Artificial Sequence
  Description of Artificial Sequence: Synthetic peptide
  Seed: AGDVGKSAL (KRAS G13D)
AYDVGKSAK

SEQ ID NO: 12095 - protein, 11 aa, Artificial Sequence
  Description of Artificial Sequence: Synthetic peptide
  Seed: AGDVGKSALTI (KRAS G13D)
AYDVGKSALTA

SEQ ID NO: 12096 - protein, 11 aa, Artificial Sequence
  Description of Artificial Sequence: Synthetic peptide
  Seed: AGDVGKSALTI (KRAS G13D)
AYDVGKSALTC

SEQ ID NO: 12097 - protein, 11 aa, Artificial Sequence
  Description of Artificial Sequence: Synthetic peptide
  Seed: AGDVGKSALTI (KRAS G13D)
AYDVGKSALTF

SEQ ID NO: 12098 - protein, 11 aa, Artificial Sequence
  Description of Artificial Sequence: Synthetic peptide
  Seed: AGDVGKSALTI (KRAS G13D)
AYDVGKSALTI

SEQ ID NO: 12099 - protein, 11 aa, Artificial Sequence
  Description of Artificial Sequence: Synthetic peptide
  Seed: AGDVGKSALTI (KRAS G13D)
AYDVGKSALTL

SEQ ID NO: 12100 - protein, 11 aa, Artificial Sequence
  Description of Artificial Sequence: Synthetic peptide
  Seed: AGDVGKSALTI (KRAS G13D)
AYDVGKSALTM

SEQ ID NO: 12101 - protein, 11 aa, Artificial Sequence
  Description of Artificial Sequence: Synthetic peptide
  Seed: AGDVGKSALTI (KRAS G13D)
AYDVGKSALTV

SEQ ID NO: 12102 - protein, 11 aa, Artificial Sequence
  Description of Artificial Sequence: Synthetic peptide
  Seed: AGDVGKSALTI (KRAS G13D)
AYDVGKSALTW

SEQ ID NO: 12103 - protein, 11 aa, Artificial Sequence
  Description of Artificial Sequence: Synthetic peptide
  Seed: AGDVGKSALTI (KRAS G13D)
AYDVGKSALTY

SEQ ID NO: 12104 - protein, 9 aa, Artificial Sequence
  Description of Artificial Sequence: Synthetic peptide
  Seed: AGDVGKSAL (KRAS G13D)
AYDVGKSAR

SEQ ID NO: 12105 - protein, 9 aa, Artificial Sequence
  Description of Artificial Sequence: Synthetic peptide
  Seed: AGDVGKSAL (KRAS G13D)
AYDVGKSAT

SEQ ID NO: 12106 - protein, 9 aa, Artificial Sequence
  Description of Artificial Sequence: Synthetic peptide
  Seed: AGDVGKSAL (KRAS G13D)
AYDVGKSAV

SEQ ID NO: 12107 - protein, 9 aa, Artificial Sequence
  Description of Artificial Sequence: Synthetic peptide
  Seed: AGDVGKSAL (KRAS G13D)
AYDVGKSAW

SEQ ID NO: 12108 - protein, 9 aa, Artificial Sequence
  Description of Artificial Sequence: Synthetic peptide
  Seed: AGDVGKSAL (KRAS G13D)
AYDVGKSAY

SEQ ID NO: 12109 - protein, 9 aa, Artificial Sequence
  Description of Artificial Sequence: Synthetic peptide
  Seed: DVGKSALTI (KRAS G13D)
DAGKSALTA

SEQ ID NO: 12110 - protein, 9 aa, Artificial Sequence
  Description of Artificial Sequence: Synthetic peptide
  Seed: DVGKSALTI (KRAS G13D)
DAGKSALTC

SEQ ID NO: 12111 - protein, 9 aa, Artificial Sequence
  Description of Artificial Sequence: Synthetic peptide
  Seed: DVGKSALTI (KRAS G13D)
DAGKSALTF

SEQ ID NO: 12112 - protein, 9 aa, Artificial Sequence
  Description of Artificial Sequence: Synthetic peptide
  Seed: DVGKSALTI (KRAS G13D)
DAGKSALTI

SEQ ID NO: 12113 - protein, 9 aa, Artificial Sequence
  Description of Artificial Sequence: Synthetic peptide
  Seed: DVGKSALTI (KRAS G13D)
DAGKSALTL

SEQ ID NO: 12114 - protein, 9 aa, Artificial Sequence
  Description of Artificial Sequence: Synthetic peptide
  Seed: DVGKSALTI (KRAS G13D)
DAGKSALTM

SEQ ID NO: 12115 - protein, 9 aa, Artificial Sequence
  Description of Artificial Sequence: Synthetic peptide
  Seed: DVGKSALTI (KRAS G13D)
DAGKSALTW

SEQ ID NO: 12116 - protein, 9 aa, Artificial Sequence
  Description of Artificial Sequence: Synthetic peptide
  Seed: DVGKSALTI (KRAS G13D)
DAGKSALTY

SEQ ID NO: 12117 - protein, 9 aa, Artificial Sequence
  Description of Artificial Sequence: Synthetic peptide
  Seed: DVGKSALTI (KRAS G13D)
DCGKSALTV

SEQ ID NO: 12118 - protein, 9 aa, Artificial Sequence
  Description of Artificial Sequence: Synthetic peptide
  Seed: DVGKSALTI (KRAS G13D)
DEGKSALTI

SEQ ID NO: 12119 - protein, 9 aa, Artificial Sequence
  Description of Artificial Sequence: Synthetic peptide
  Seed: DVGKSALTI (KRAS G13D)
DEGKSALTL

SEQ ID NO: 12120 - protein, 9 aa, Artificial Sequence
  Description of Artificial Sequence: Synthetic peptide
  Seed: DVGKSALTI (KRAS G13D)
DEGKSALTV

SEQ ID NO: 12121 - protein, 9 aa, Artificial Sequence
  Description of Artificial Sequence: Synthetic peptide
  Seed: DVGKSALTI (KRAS G13D)
DGGKSALTI

SEQ ID NO: 12122 - protein, 9 aa, Artificial Sequence
  Description of Artificial Sequence: Synthetic peptide
  Seed: DVGKSALTI (KRAS G13D)
DGGKSALTL

SEQ ID NO: 12123 - protein, 9 aa, Artificial Sequence
  Description of Artificial Sequence: Synthetic peptide
  Seed: DVGKSALTI (KRAS G13D)
DGGKSALTV

SEQ ID NO: 12124 - protein, 9 aa, Artificial Sequence
  Description of Artificial Sequence: Synthetic peptide
  Seed: DVGKSALTI (KRAS G13D)
DIGKSALTF

SEQ ID NO: 12125 - protein, 9 aa, Artificial Sequence
  Description of Artificial Sequence: Synthetic peptide
  Seed: DVGKSALTI (KRAS G13D)
DIGKSALTI

SEQ ID NO: 12126 - protein, 9 aa, Artificial Sequence
  Description of Artificial Sequence: Synthetic peptide
  Seed: DVGKSALTI (KRAS G13D)
DIGKSALTL

SEQ ID NO: 12127 - protein, 9 aa, Artificial Sequence
  Description of Artificial Sequence: Synthetic peptide
  Seed: DVGKSALTI (KRAS G13D)
DIGKSALTM

SEQ ID NO: 12128 - protein, 9 aa, Artificial Sequence
  Description of Artificial Sequence: Synthetic peptide
  Seed: DVGKSALTI (KRAS G13D)
DIGKSALTV

SEQ ID NO: 12129 - protein, 9 aa, Artificial Sequence
  Description of Artificial Sequence: Synthetic peptide
  Seed: DVGKSALTI (KRAS G13D)
DIGKSALTW

SEQ ID NO: 12130 - protein, 9 aa, Artificial Sequence
  Description of Artificial Sequence: Synthetic peptide
  Seed: DVGKSALTI (KRAS G13D)
DIGKSALTY

SEQ ID NO: 12131 - protein, 9 aa, Artificial Sequence
  Description of Artificial Sequence: Synthetic peptide
  Seed: DVGKSALTI (KRAS G13D)
DLGKSALTF

SEQ ID NO: 12132 - protein, 9 aa, Artificial Sequence
  Description of Artificial Sequence: Synthetic peptide
  Seed: DVGKSALTI (KRAS G13D)
DLGKSALTI

SEQ ID NO: 12133 - protein, 9 aa, Artificial Sequence
  Description of Artificial Sequence: Synthetic peptide
  Seed: DVGKSALTI (KRAS G13D)
DLGKSALTL

SEQ ID NO: 12134 - protein, 9 aa, Artificial Sequence
  Description of Artificial Sequence: Synthetic peptide
  Seed: DVGKSALTI (KRAS G13D)
DLGKSALTV

SEQ ID NO: 12135 - protein, 9 aa, Artificial Sequence
  Description of Artificial Sequence: Synthetic peptide
  Seed: DVGKSALTI (KRAS G13D)
DLGKSALTW

SEQ ID NO: 12136 - protein, 9 aa, Artificial Sequence
  Description of Artificial Sequence: Synthetic peptide
  Seed: DVGKSALTI (KRAS G13D)
DLGKSALTY

SEQ ID NO: 12137 - protein, 9 aa, Artificial Sequence
  Description of Artificial Sequence: Synthetic peptide
  Seed: DVGKSALTI (KRAS G13D)
DMGKSALTF

SEQ ID NO: 12138 - protein, 9 aa, Artificial Sequence
  Description of Artificial Sequence: Synthetic peptide
  Seed: DVGKSALTI (KRAS G13D)
DMGKSALTI

SEQ ID NO: 12139 - protein, 9 aa, Artificial Sequence
  Description of Artificial Sequence: Synthetic peptide
  Seed: DVGKSALTI (KRAS G13D)
DMGKSALTL

SEQ ID NO: 12140 - protein, 9 aa, Artificial Sequence
  Description of Artificial Sequence: Synthetic peptide
  Seed: DVGKSALTI (KRAS G13D)
DMGKSALTV

SEQ ID NO: 12141 - protein, 9 aa, Artificial Sequence
  Description of Artificial Sequence: Synthetic peptide
  Seed: DVGKSALTI (KRAS G13D)
DMGKSALTW

SEQ ID NO: 12142 - protein, 9 aa, Artificial Sequence
  Description of Artificial Sequence: Synthetic peptide
  Seed: DVGKSALTI (KRAS G13D)
DMGKSALTY

SEQ ID NO: 12143 - protein, 9 aa, Artificial Sequence
  Description of Artificial Sequence: Synthetic peptide
  Seed: DVGKSALTI (KRAS G13D)
DNGKSALTV

SEQ ID NO: 12144 - protein, 9 aa, Artificial Sequence
  Description of Artificial Sequence: Synthetic peptide
  Seed: DVGKSALTI (KRAS G13D)
DPGKSALTI

SEQ ID NO: 12145 - protein, 9 aa, Artificial Sequence
  Description of Artificial Sequence: Synthetic peptide
  Seed: DVGKSALTI (KRAS G13D)
DPGKSALTL

SEQ ID NO: 12146 - protein, 9 aa, Artificial Sequence
  Description of Artificial Sequence: Synthetic peptide
  Seed: DVGKSALTI (KRAS G13D)
DPGKSALTM

SEQ ID NO: 12147 - protein, 9 aa, Artificial Sequence
  Description of Artificial Sequence: Synthetic peptide
  Seed: DVGKSALTI (KRAS G13D)
DPGKSALTV

SEQ ID NO: 12148 - protein, 9 aa, Artificial Sequence
  Description of Artificial Sequence: Synthetic peptide
  Seed: DVGKSALTI (KRAS G13D)
DQGKSALTI

SEQ ID NO: 12149 - protein, 9 aa, Artificial Sequence
  Description of Artificial Sequence: Synthetic peptide
  Seed: DVGKSALTI (KRAS G13D)
DQGKSALTL

SEQ ID NO: 12150 - protein, 9 aa, Artificial Sequence
  Description of Artificial Sequence: Synthetic peptide
  Seed: DVGKSALTI (KRAS G13D)
DQGKSALTM

SEQ ID NO: 12151 - protein, 9 aa, Artificial Sequence
  Description of Artificial Sequence: Synthetic peptide
  Seed: DVGKSALTI (KRAS G13D)
DQGKSALTV

SEQ ID NO: 12152 - protein, 9 aa, Artificial Sequence
  Description of Artificial Sequence: Synthetic peptide
  Seed: DVGKSALTI (KRAS G13D)
DSGKSALTF

SEQ ID NO: 12153 - protein, 9 aa, Artificial Sequence
  Description of Artificial Sequence: Synthetic peptide
  Seed: DVGKSALTI (KRAS G13D)
DSGKSALTI

SEQ ID NO: 12154 - protein, 9 aa, Artificial Sequence
  Description of Artificial Sequence: Synthetic peptide
  Seed: DVGKSALTI (KRAS G13D)
DSGKSALTL

SEQ ID NO: 12155 - protein, 9 aa, Artificial Sequence
  Description of Artificial Sequence: Synthetic peptide
  Seed: DVGKSALTI (KRAS G13D)
DSGKSALTV

SEQ ID NO: 12156 - protein, 9 aa, Artificial Sequence
  Description of Artificial Sequence: Synthetic peptide
  Seed: DVGKSALTI (KRAS G13D)
DSGKSALTW

SEQ ID NO: 12157 - protein, 9 aa, Artificial Sequence
  Description of Artificial Sequence: Synthetic peptide
  Seed: DVGKSALTI (KRAS G13D)
DSGKSALTY

SEQ ID NO: 12158 - protein, 9 aa, Artificial Sequence
  Description of Artificial Sequence: Synthetic peptide
  Seed: DVGKSALTI (KRAS G13D)
DTGKSALTF

SEQ ID NO: 12159 - protein, 9 aa, Artificial Sequence
  Description of Artificial Sequence: Synthetic peptide
  Seed: DVGKSALTI (KRAS G13D)
DTGKSALTI

SEQ ID NO: 12160 - protein, 9 aa, Artificial Sequence
  Description of Artificial Sequence: Synthetic peptide
  Seed: DVGKSALTI (KRAS G13D)
DTGKSALTL

SEQ ID NO: 12161 - protein, 9 aa, Artificial Sequence
  Description of Artificial Sequence: Synthetic peptide
  Seed: DVGKSALTI (KRAS G13D)
DTGKSALTM

SEQ ID NO: 12162 - protein, 9 aa, Artificial Sequence
  Description of Artificial Sequence: Synthetic peptide
  Seed: DVGKSALTI (KRAS G13D)
DTGKSALTV

SEQ ID NO: 12163 - protein, 9 aa, Artificial Sequence
  Description of Artificial Sequence: Synthetic peptide
  Seed: DVGKSALTI (KRAS G13D)
DTGKSALTW

SEQ ID NO: 12164 - protein, 9 aa, Artificial Sequence
  Description of Artificial Sequence: Synthetic peptide
  Seed: DVGKSALTI (KRAS G13D)
DTGKSALTY

SEQ ID NO: 12165 - protein, 9 aa, Artificial Sequence
  Description of Artificial Sequence: Synthetic peptide
  Seed: DVGKSALTI (KRAS G13D)
DVGKSALTL

SEQ ID NO: 12166 - protein, 9 aa, Artificial Sequence
  Description of Artificial Sequence: Synthetic peptide
  Seed: DVGKSALTI (KRAS G13D)
DVGKSALTM

SEQ ID NO: 12167 - protein, 9 aa, Artificial Sequence
  Description of Artificial Sequence: Synthetic peptide
  Seed: DVGKSALTI (KRAS G13D)
DVGKSALTV

SEQ ID NO: 12168 - protein, 9 aa, Artificial Sequence
  Description of Artificial Sequence: Synthetic peptide
  Seed: DVGKSALTI (KRAS G13D)
DVGKSALTW

SEQ ID NO: 12169 - protein, 10 aa, Artificial Sequence
  Description of Artificial Sequence: Synthetic peptide
  Seed: GAGDVGKSAL (KRAS G13D)
GAGDVGKSAA

SEQ ID NO: 12170 - protein, 10 aa, Artificial Sequence
  Description of Artificial Sequence: Synthetic peptide
  Seed: GAGDVGKSAL (KRAS G13D)
GAGDVGKSAF

SEQ ID NO: 12171 - protein, 10 aa, Artificial Sequence
  Description of Artificial Sequence: Synthetic peptide
  Seed: GAGDVGKSAL (KRAS G13D)
GAGDVGKSAH

SEQ ID NO: 12172 - protein, 10 aa, Artificial Sequence
  Description of Artificial Sequence: Synthetic peptide
  Seed: GAGDVGKSAL (KRAS G13D)
GAGDVGKSAI

SEQ ID NO: 12173 - protein, 10 aa, Artificial Sequence
  Description of Artificial Sequence: Synthetic peptide
  Seed: GAGDVGKSAL (KRAS G13D)
GAGDVGKSAK

SEQ ID NO: 12174 - protein, 10 aa, Artificial Sequence
  Description of Artificial Sequence: Synthetic peptide
  Seed: GAGDVGKSAL (KRAS G13D)
GAGDVGKSAM

SEQ ID NO: 12175 - protein, 10 aa, Artificial Sequence
  Description of Artificial Sequence: Synthetic peptide
  Seed: GAGDVGKSAL (KRAS G13D)
GAGDVGKSAR

SEQ ID NO: 12176 - protein, 10 aa, Artificial Sequence
  Description of Artificial Sequence: Synthetic peptide
  Seed: GAGDVGKSAL (KRAS G13D)
GAGDVGKSAV

SEQ ID NO: 12177 - protein, 10 aa, Artificial Sequence
  Description of Artificial Sequence: Synthetic peptide
  Seed: GAGDVGKSAL (KRAS G13D)
GAGDVGKSAW

SEQ ID NO: 12178 - protein, 10 aa, Artificial Sequence
  Description of Artificial Sequence: Synthetic peptide
  Seed: GAGDVGKSAL (KRAS G13D)
GAGDVGKSAY

SEQ ID NO: 12179 - protein, 9 aa, Artificial Sequence
  Description of Artificial Sequence: Synthetic peptide
  Seed: GAGDVGKSA (KRAS G13D)
GAGDVGKSC

SEQ ID NO: 12180 - protein, 9 aa, Artificial Sequence
  Description of Artificial Sequence: Synthetic peptide
  Seed: GAGDVGKSA (KRAS G13D)
GAGDVGKSF

SEQ ID NO: 12181 - protein, 9 aa, Artificial Sequence
  Description of Artificial Sequence: Synthetic peptide
  Seed: GAGDVGKSA (KRAS G13D)
GAGDVGKSH

SEQ ID NO: 12182 - protein, 9 aa, Artificial Sequence
  Description of Artificial Sequence: Synthetic peptide
  Seed: GAGDVGKSA (KRAS G13D)
GAGDVGKSI

SEQ ID NO: 12183 - protein, 9 aa, Artificial Sequence
  Description of Artificial Sequence: Synthetic peptide
  Seed: GAGDVGKSA (KRAS G13D)
GAGDVGKSK

SEQ ID NO: 12184 - protein, 9 aa, Artificial Sequence
  Description of Artificial Sequence: Synthetic peptide
  Seed: GAGDVGKSA (KRAS G13D)
GAGDVGKSL

SEQ ID NO: 12185 - protein, 9 aa, Artificial Sequence
  Description of Artificial Sequence: Synthetic peptide
  Seed: GAGDVGKSA (KRAS G13D)
GAGDVGKSQ

SEQ ID NO: 12186 - protein, 9 aa, Artificial Sequence
  Description of Artificial Sequence: Synthetic peptide
  Seed: GAGDVGKSA (KRAS G13D)
GAGDVGKSR

SEQ ID NO: 12187 - protein, 9 aa, Artificial Sequence
  Description of Artificial Sequence: Synthetic peptide
  Seed: GAGDVGKSA (KRAS G13D)
GAGDVGKST

SEQ ID NO: 12188 - protein, 9 aa, Artificial Sequence
  Description of Artificial Sequence: Synthetic peptide
  Seed: GAGDVGKSA (KRAS G13D)
GAGDVGKSV

SEQ ID NO: 12189 - protein, 9 aa, Artificial Sequence
  Description of Artificial Sequence: Synthetic peptide
  Seed: GAGDVGKSA (KRAS G13D)
GAGDVGKSW

SEQ ID NO: 12190 - protein, 9 aa, Artificial Sequence
  Description of Artificial Sequence: Synthetic peptide
  Seed: GAGDVGKSA (KRAS G13D)
GAGDVGKSY

SEQ ID NO: 12191 - protein, 10 aa, Artificial Sequence
  Description of Artificial Sequence: Synthetic peptide
  Seed: GAGDVGKSAL (KRAS G13D)
GCGDVGKSAF

SEQ ID NO: 12192 - protein, 10 aa, Artificial Sequence
  Description of Artificial Sequence: Synthetic peptide
  Seed: GAGDVGKSAL (KRAS G13D)
GCGDVGKSAK

SEQ ID NO: 12193 - protein, 10 aa, Artificial Sequence
  Description of Artificial Sequence: Synthetic peptide
  Seed: GAGDVGKSAL (KRAS G13D)
GCGDVGKSAL

SEQ ID NO: 12194 - protein, 10 aa, Artificial Sequence
  Description of Artificial Sequence: Synthetic peptide
  Seed: GAGDVGKSAL (KRAS G13D)
GCGDVGKSAM

SEQ ID NO: 12195 - protein, 10 aa, Artificial Sequence
  Description of Artificial Sequence: Synthetic peptide
  Seed: GAGDVGKSAL (KRAS G13D)
GCGDVGKSAR

SEQ ID NO: 12196 - protein, 10 aa, Artificial Sequence
  Description of Artificial Sequence: Synthetic peptide
  Seed: GAGDVGKSAL (KRAS G13D)
GCGDVGKSAY

SEQ ID NO: 12197 - protein, 9 aa, Artificial Sequence
  Description of Artificial Sequence: Synthetic peptide
  Seed: GAGDVGKSA (KRAS G13D)
GCGDVGKSF

SEQ ID NO: 12198 - protein, 9 aa, Artificial Sequence
  Description of Artificial Sequence: Synthetic peptide
  Seed: GAGDVGKSA (KRAS G13D)
GCGDVGKSK

SEQ ID NO: 12199 - protein, 9 aa, Artificial Sequence
  Description of Artificial Sequence: Synthetic peptide
  Seed: GAGDVGKSA (KRAS G13D)
GCGDVGKSM

SEQ ID NO: 12200 - protein, 9 aa, Artificial Sequence
  Description of Artificial Sequence: Synthetic peptide
  Seed: GAGDVGKSA (KRAS G13D)
GCGDVGKSR

SEQ ID NO: 12201 - protein, 9 aa, Artificial Sequence
  Description of Artificial Sequence: Synthetic peptide
  Seed: GAGDVGKSA (KRAS G13D)
GCGDVGKSY

SEQ ID NO: 12202 - protein, 10 aa, Artificial Sequence
  Description of Artificial Sequence: Synthetic peptide
  Seed: GAGDVGKSAL (KRAS G13D)
GDGDVGKSAK

SEQ ID NO: 12203 - protein, 10 aa, Artificial Sequence
  Description of Artificial Sequence: Synthetic peptide
  Seed: GAGDVGKSAL (KRAS G13D)
GDGDVGKSAR

SEQ ID NO: 12204 - protein, 10 aa, Artificial Sequence
  Description of Artificial Sequence: Synthetic peptide
  Seed: GAGDVGKSAL (KRAS G13D)
GDGDVGKSAY

SEQ ID NO: 12205 - protein, 9 aa, Artificial Sequence
  Description of Artificial Sequence: Synthetic peptide
  Seed: GAGDVGKSA (KRAS G13D)
GDGDVGKSF

SEQ ID NO: 12206 - protein, 9 aa, Artificial Sequence
  Description of Artificial Sequence: Synthetic peptide
  Seed: GAGDVGKSA (KRAS G13D)
GDGDVGKSK

SEQ ID NO: 12207 - protein, 9 aa, Artificial Sequence
  Description of Artificial Sequence: Synthetic peptide
  Seed: GAGDVGKSA (KRAS G13D)
GDGDVGKSR

SEQ ID NO: 12208 - protein, 9 aa, Artificial Sequence
  Description of Artificial Sequence: Synthetic peptide
  Seed: GAGDVGKSA (KRAS G13D)
GDGDVGKSY

SEQ ID NO: 12209 - protein, 10 aa, Artificial Sequence
  Description of Artificial Sequence: Synthetic peptide
  Seed: GAGDVGKSAL (KRAS G13D)
GEGDVGKSAF

SEQ ID NO: 12210 - protein, 10 aa, Artificial Sequence
  Description of Artificial Sequence: Synthetic peptide
  Seed: GAGDVGKSAL (KRAS G13D)
GEGDVGKSAK

SEQ ID NO: 12211 - protein, 10 aa, Artificial Sequence
  Description of Artificial Sequence: Synthetic peptide
  Seed: GAGDVGKSAL (KRAS G13D)
GEGDVGKSAL

SEQ ID NO: 12212 - protein, 10 aa, Artificial Sequence
  Description of Artificial Sequence: Synthetic peptide
  Seed: GAGDVGKSAL (KRAS G13D)
GEGDVGKSAM

SEQ ID NO: 12213 - protein, 10 aa, Artificial Sequence
  Description of Artificial Sequence: Synthetic peptide
  Seed: GAGDVGKSAL (KRAS G13D)
GEGDVGKSAR

SEQ ID NO: 12214 - protein, 10 aa, Artificial Sequence
  Description of Artificial Sequence: Synthetic peptide
  Seed: GAGDVGKSAL (KRAS G13D)
GEGDVGKSAW

SEQ ID NO: 12215 - protein, 10 aa, Artificial Sequence
  Description of Artificial Sequence: Synthetic peptide
  Seed: GAGDVGKSAL (KRAS G13D)
GEGDVGKSAY

SEQ ID NO: 12216 - protein, 9 aa, Artificial Sequence
  Description of Artificial Sequence: Synthetic peptide
  Seed: GAGDVGKSA (KRAS G13D)
GEGDVGKSF

SEQ ID NO: 12217 - protein, 9 aa, Artificial Sequence
  Description of Artificial Sequence: Synthetic peptide
  Seed: GAGDVGKSA (KRAS G13D)
GEGDVGKSK

SEQ ID NO: 12218 - protein, 9 aa, Artificial Sequence
  Description of Artificial Sequence: Synthetic peptide
  Seed: GAGDVGKSA (KRAS G13D)
GEGDVGKSM

SEQ ID NO: 12219 - protein, 9 aa, Artificial Sequence
  Description of Artificial Sequence: Synthetic peptide
  Seed: GAGDVGKSA (KRAS G13D)
GEGDVGKSR

SEQ ID NO: 12220 - protein, 9 aa, Artificial Sequence
  Description of Artificial Sequence: Synthetic peptide
  Seed: GAGDVGKSA (KRAS G13D)
GEGDVGKSY

SEQ ID NO: 12221 - protein, 10 aa, Artificial Sequence
  Description of Artificial Sequence: Synthetic peptide
  Seed: GAGDVGKSAL (KRAS G13D)
GFGDVGKSAF

SEQ ID NO: 12222 - protein, 10 aa, Artificial Sequence
  Description of Artificial Sequence: Synthetic peptide
  Seed: GAGDVGKSAL (KRAS G13D)
GFGDVGKSAK

SEQ ID NO: 12223 - protein, 10 aa, Artificial Sequence
  Description of Artificial Sequence: Synthetic peptide
  Seed: GAGDVGKSAL (KRAS G13D)
GFGDVGKSAL

SEQ ID NO: 12224 - protein, 10 aa, Artificial Sequence
  Description of Artificial Sequence: Synthetic peptide
  Seed: GAGDVGKSAL (KRAS G13D)
GFGDVGKSAM

SEQ ID NO: 12225 - protein, 10 aa, Artificial Sequence
  Description of Artificial Sequence: Synthetic peptide
  Seed: GAGDVGKSAL (KRAS G13D)
GFGDVGKSAR

SEQ ID NO: 12226 - protein, 10 aa, Artificial Sequence
  Description of Artificial Sequence: Synthetic peptide
  Seed: GAGDVGKSAL (KRAS G13D)
GFGDVGKSAY

SEQ ID NO: 12227 - protein, 9 aa, Artificial Sequence
  Description of Artificial Sequence: Synthetic peptide
  Seed: GAGDVGKSA (KRAS G13D)
GFGDVGKSF

SEQ ID NO: 12228 - protein, 9 aa, Artificial Sequence
  Description of Artificial Sequence: Synthetic peptide
  Seed: GAGDVGKSA (KRAS G13D)
GFGDVGKSK

SEQ ID NO: 12229 - protein, 9 aa, Artificial Sequence
  Description of Artificial Sequence: Synthetic peptide
  Seed: GAGDVGKSA (KRAS G13D)
GFGDVGKSR

SEQ ID NO: 12230 - protein, 9 aa, Artificial Sequence
  Description of Artificial Sequence: Synthetic peptide
  Seed: GAGDVGKSA (KRAS G13D)
GFGDVGKSY

SEQ ID NO: 12231 - protein, 10 aa, Artificial Sequence
  Description of Artificial Sequence: Synthetic peptide
  Seed: GAGDVGKSAL (KRAS G13D)
GGGDVGKSAF

SEQ ID NO: 12232 - protein, 10 aa, Artificial Sequence
  Description of Artificial Sequence: Synthetic peptide
  Seed: GAGDVGKSAL (KRAS G13D)
GGGDVGKSAK

SEQ ID NO: 12233 - protein, 10 aa, Artificial Sequence
  Description of Artificial Sequence: Synthetic peptide
  Seed: GAGDVGKSAL (KRAS G13D)
GGGDVGKSAL

SEQ ID NO: 12234 - protein, 10 aa, Artificial Sequence
  Description of Artificial Sequence: Synthetic peptide
  Seed: GAGDVGKSAL (KRAS G13D)
GGGDVGKSAM

SEQ ID NO: 12235 - protein, 10 aa, Artificial Sequence
  Description of Artificial Sequence: Synthetic peptide
  Seed: GAGDVGKSAL (KRAS G13D)
GGGDVGKSAR

SEQ ID NO: 12236 - protein, 10 aa, Artificial Sequence
  Description of Artificial Sequence: Synthetic peptide
  Seed: GAGDVGKSAL (KRAS G13D)
GGGDVGKSAY

SEQ ID NO: 12237 - protein, 9 aa, Artificial Sequence
  Description of Artificial Sequence: Synthetic peptide
  Seed: GAGDVGKSA (KRAS G13D)
GGGDVGKSF

SEQ ID NO: 12238 - protein, 9 aa, Artificial Sequence
  Description of Artificial Sequence: Synthetic peptide
  Seed: GAGDVGKSA (KRAS G13D)
GGGDVGKSH

SEQ ID NO: 12239 - protein, 9 aa, Artificial Sequence
  Description of Artificial Sequence: Synthetic peptide
  Seed: GAGDVGKSA (KRAS G13D)
GGGDVGKSK

SEQ ID NO: 12240 - protein, 9 aa, Artificial Sequence
  Description of Artificial Sequence: Synthetic peptide
  Seed: GAGDVGKSA (KRAS G13D)
GGGDVGKSL

SEQ ID NO: 12241 - protein, 9 aa, Artificial Sequence
  Description of Artificial Sequence: Synthetic peptide
  Seed: GAGDVGKSA (KRAS G13D)
GGGDVGKSM

SEQ ID NO: 12242 - protein, 9 aa, Artificial Sequence
  Description of Artificial Sequence: Synthetic peptide
  Seed: GAGDVGKSA (KRAS G13D)
GGGDVGKSR

SEQ ID NO: 12243 - protein, 9 aa, Artificial Sequence
  Description of Artificial Sequence: Synthetic peptide
  Seed: GAGDVGKSA (KRAS G13D)
GGGDVGKSY

SEQ ID NO: 12244 - protein, 10 aa, Artificial Sequence
  Description of Artificial Sequence: Synthetic peptide
  Seed: GAGDVGKSAL (KRAS G13D)
GHGDVGKSAF

SEQ ID NO: 12245 - protein, 10 aa, Artificial Sequence
  Description of Artificial Sequence: Synthetic peptide
  Seed: GAGDVGKSAL (KRAS G13D)
GHGDVGKSAK

SEQ ID NO: 12246 - protein, 10 aa, Artificial Sequence
  Description of Artificial Sequence: Synthetic peptide
  Seed: GAGDVGKSAL (KRAS G13D)
GHGDVGKSAL

SEQ ID NO: 12247 - protein, 10 aa, Artificial Sequence
  Description of Artificial Sequence: Synthetic peptide
  Seed: GAGDVGKSAL (KRAS G13D)
GHGDVGKSAM

SEQ ID NO: 12248 - protein, 9 aa, Artificial Sequence
  Description of Artificial Sequence: Synthetic peptide
  Seed: GAGDVGKSA (KRAS G13D)
GIGDVGKSA

SEQ ID NO: 12249 - protein, 10 aa, Artificial Sequence
  Description of Artificial Sequence: Synthetic peptide
  Seed: GAGDVGKSAL (KRAS G13D)
GIGDVGKSAF

SEQ ID NO: 12250 - protein, 10 aa, Artificial Sequence
  Description of Artificial Sequence: Synthetic peptide
  Seed: GAGDVGKSAL (KRAS G13D)
GIGDVGKSAH

SEQ ID NO: 12251 - protein, 10 aa, Artificial Sequence
  Description of Artificial Sequence: Synthetic peptide
  Seed: GAGDVGKSAL (KRAS G13D)
GIGDVGKSAI

SEQ ID NO: 12252 - protein, 10 aa, Artificial Sequence
  Description of Artificial Sequence: Synthetic peptide
  Seed: GAGDVGKSAL (KRAS G13D)
GIGDVGKSAK

SEQ ID NO: 12253 - protein, 10 aa, Artificial Sequence
  Description of Artificial Sequence: Synthetic peptide
  Seed: GAGDVGKSAL (KRAS G13D)
GIGDVGKSAL

SEQ ID NO: 12254 - protein, 10 aa, Artificial Sequence
  Description of Artificial Sequence: Synthetic peptide
  Seed: GAGDVGKSAL (KRAS G13D)
GIGDVGKSAM

SEQ ID NO: 12255 - protein, 10 aa, Artificial Sequence
  Description of Artificial Sequence: Synthetic peptide
  Seed: GAGDVGKSAL (KRAS G13D)
GIGDVGKSAR

SEQ ID NO: 12256 - protein, 10 aa, Artificial Sequence
  Description of Artificial Sequence: Synthetic peptide
  Seed: GAGDVGKSAL (KRAS G13D)
GIGDVGKSAW

SEQ ID NO: 12257 - protein, 10 aa, Artificial Sequence
  Description of Artificial Sequence: Synthetic peptide
  Seed: GAGDVGKSAL (KRAS G13D)
GIGDVGKSAY

SEQ ID NO: 12258 - protein, 9 aa, Artificial Sequence
  Description of Artificial Sequence: Synthetic peptide
  Seed: GAGDVGKSA (KRAS G13D)
GIGDVGKSF

SEQ ID NO: 12259 - protein, 9 aa, Artificial Sequence
  Description of Artificial Sequence: Synthetic peptide
  Seed: GAGDVGKSA (KRAS G13D)
GIGDVGKSH

SEQ ID NO: 12260 - protein, 9 aa, Artificial Sequence
  Description of Artificial Sequence: Synthetic peptide
  Seed: GAGDVGKSA (KRAS G13D)
GIGDVGKSI

SEQ ID NO: 12261 - protein, 9 aa, Artificial Sequence
  Description of Artificial Sequence: Synthetic peptide
  Seed: GAGDVGKSA (KRAS G13D)
GIGDVGKSK

SEQ ID NO: 12262 - protein, 9 aa, Artificial Sequence
  Description of Artificial Sequence: Synthetic peptide
  Seed: GAGDVGKSA (KRAS G13D)
GIGDVGKSL

SEQ ID NO: 12263 - protein, 9 aa, Artificial Sequence
  Description of Artificial Sequence: Synthetic peptide
  Seed: GAGDVGKSA (KRAS G13D)
GIGDVGKSM

SEQ ID NO: 12264 - protein, 9 aa, Artificial Sequence
  Description of Artificial Sequence: Synthetic peptide
  Seed: GAGDVGKSA (KRAS G13D)
GIGDVGKSR

SEQ ID NO: 12265 - protein, 9 aa, Artificial Sequence
  Description of Artificial Sequence: Synthetic peptide
  Seed: GAGDVGKSA (KRAS G13D)
GIGDVGKSV

SEQ ID NO: 12266 - protein, 9 aa, Artificial Sequence
  Description of Artificial Sequence: Synthetic peptide
  Seed: GAGDVGKSA (KRAS G13D)
GIGDVGKSW

SEQ ID NO: 12267 - protein, 9 aa, Artificial Sequence
  Description of Artificial Sequence: Synthetic peptide
  Seed: GAGDVGKSA (KRAS G13D)
GIGDVGKSY

SEQ ID NO: 12268 - protein, 10 aa, Artificial Sequence
  Description of Artificial Sequence: Synthetic peptide
  Seed: GAGDVGKSAL (KRAS G13D)
GKGDVGKSAL

SEQ ID NO: 12269 - protein, 10 aa, Artificial Sequence
  Description of Artificial Sequence: Synthetic peptide
  Seed: GAGDVGKSAL (KRAS G13D)
GLGDVGKSAF

SEQ ID NO: 12270 - protein, 10 aa, Artificial Sequence
  Description of Artificial Sequence: Synthetic peptide
  Seed: GAGDVGKSAL (KRAS G13D)
GLGDVGKSAI

SEQ ID NO: 12271 - protein, 10 aa, Artificial Sequence
  Description of Artificial Sequence: Synthetic peptide
  Seed: GAGDVGKSAL (KRAS G13D)
GLGDVGKSAK

SEQ ID NO: 12272 - protein, 10 aa, Artificial Sequence
  Description of Artificial Sequence: Synthetic peptide
  Seed: GAGDVGKSAL (KRAS G13D)
GLGDVGKSAL

SEQ ID NO: 12273 - protein, 10 aa, Artificial Sequence
  Description of Artificial Sequence: Synthetic peptide
  Seed: GAGDVGKSAL (KRAS G13D)
GLGDVGKSAM

SEQ ID NO: 12274 - protein, 10 aa, Artificial Sequence
  Description of Artificial Sequence: Synthetic peptide
  Seed: GAGDVGKSAL (KRAS G13D)
GLGDVGKSAR

SEQ ID NO: 12275 - protein, 10 aa, Artificial Sequence
  Description of Artificial Sequence: Synthetic peptide
  Seed: GAGDVGKSAL (KRAS G13D)
GLGDVGKSAY

SEQ ID NO: 12276 - protein, 9 aa, Artificial Sequence
  Description of Artificial Sequence: Synthetic peptide
  Seed: GAGDVGKSA (KRAS G13D)
GLGDVGKSF

SEQ ID NO: 12277 - protein, 9 aa, Artificial Sequence
  Description of Artificial Sequence: Synthetic peptide
  Seed: GAGDVGKSA (KRAS G13D)
GLGDVGKSH

SEQ ID NO: 12278 - protein, 9 aa, Artificial Sequence
  Description of Artificial Sequence: Synthetic peptide
  Seed: GAGDVGKSA (KRAS G13D)
GLGDVGKSK

SEQ ID NO: 12279 - protein, 9 aa, Artificial Sequence
  Description of Artificial Sequence: Synthetic peptide
  Seed: GAGDVGKSA (KRAS G13D)
GLGDVGKSL

SEQ ID NO: 12280 - protein, 9 aa, Artificial Sequence
  Description of Artificial Sequence: Synthetic peptide
  Seed: GAGDVGKSA (KRAS G13D)
GLGDVGKSM

SEQ ID NO: 12281 - protein, 9 aa, Artificial Sequence
  Description of Artificial Sequence: Synthetic peptide
  Seed: GAGDVGKSA (KRAS G13D)
GLGDVGKSR

SEQ ID NO: 12282 - protein, 9 aa, Artificial Sequence
  Description of Artificial Sequence: Synthetic peptide
  Seed: GAGDVGKSA (KRAS G13D)
GLGDVGKSY

SEQ ID NO: 12283 - protein, 10 aa, Artificial Sequence
  Description of Artificial Sequence: Synthetic peptide
  Seed: GAGDVGKSAL (KRAS G13D)
GMGDVGKSAF

SEQ ID NO: 12284 - protein, 10 aa, Artificial Sequence
  Description of Artificial Sequence: Synthetic peptide
  Seed: GAGDVGKSAL (KRAS G13D)
GMGDVGKSAH

SEQ ID NO: 12285 - protein, 10 aa, Artificial Sequence
  Description of Artificial Sequence: Synthetic peptide
  Seed: GAGDVGKSAL (KRAS G13D)
GMGDVGKSAI

SEQ ID NO: 12286 - protein, 10 aa, Artificial Sequence
  Description of Artificial Sequence: Synthetic peptide
  Seed: GAGDVGKSAL (KRAS G13D)
GMGDVGKSAK

SEQ ID NO: 12287 - protein, 10 aa, Artificial Sequence
  Description of Artificial Sequence: Synthetic peptide
  Seed: GAGDVGKSAL (KRAS G13D)
GMGDVGKSAL

SEQ ID NO: 12288 - protein, 10 aa, Artificial Sequence
  Description of Artificial Sequence: Synthetic peptide
  Seed: GAGDVGKSAL (KRAS G13D)
GMGDVGKSAM

SEQ ID NO: 12289 - protein, 10 aa, Artificial Sequence
  Description of Artificial Sequence: Synthetic peptide
  Seed: GAGDVGKSAL (KRAS G13D)
GMGDVGKSAR

SEQ ID NO: 12290 - protein, 10 aa, Artificial Sequence
  Description of Artificial Sequence: Synthetic peptide
  Seed: GAGDVGKSAL (KRAS G13D)
GMGDVGKSAY

SEQ ID NO: 12291 - protein, 9 aa, Artificial Sequence
  Description of Artificial Sequence: Synthetic peptide
  Seed: GAGDVGKSA (KRAS G13D)
GMGDVGKSF

SEQ ID NO: 12292 - protein, 9 aa, Artificial Sequence
  Description of Artificial Sequence: Synthetic peptide
  Seed: GAGDVGKSA (KRAS G13D)
GMGDVGKSH

SEQ ID NO: 12293 - protein, 9 aa, Artificial Sequence
  Description of Artificial Sequence: Synthetic peptide
  Seed: GAGDVGKSA (KRAS G13D)
GMGDVGKSK

SEQ ID NO: 12294 - protein, 9 aa, Artificial Sequence
  Description of Artificial Sequence: Synthetic peptide
  Seed: GAGDVGKSA (KRAS G13D)
GMGDVGKSL

SEQ ID NO: 12295 - protein, 9 aa, Artificial Sequence
  Description of Artificial Sequence: Synthetic peptide
  Seed: GAGDVGKSA (KRAS G13D)
GMGDVGKSM

SEQ ID NO: 12296 - protein, 9 aa, Artificial Sequence
  Description of Artificial Sequence: Synthetic peptide
  Seed: GAGDVGKSA (KRAS G13D)
GMGDVGKSR

SEQ ID NO: 12297 - protein, 9 aa, Artificial Sequence
  Description of Artificial Sequence: Synthetic peptide
  Seed: GAGDVGKSA (KRAS G13D)
GMGDVGKSY

SEQ ID NO: 12298 - protein, 10 aa, Artificial Sequence
  Description of Artificial Sequence: Synthetic peptide
  Seed: GAGDVGKSAL (KRAS G13D)
GNGDVGKSAF

SEQ ID NO: 12299 - protein, 10 aa, Artificial Sequence
  Description of Artificial Sequence: Synthetic peptide
  Seed: GAGDVGKSAL (KRAS G13D)
GNGDVGKSAK

SEQ ID NO: 12300 - protein, 10 aa, Artificial Sequence
  Description of Artificial Sequence: Synthetic peptide
  Seed: GAGDVGKSAL (KRAS G13D)
GNGDVGKSAL

SEQ ID NO: 12301 - protein, 10 aa, Artificial Sequence
  Description of Artificial Sequence: Synthetic peptide
  Seed: GAGDVGKSAL (KRAS G13D)
GNGDVGKSAR

SEQ ID NO: 12302 - protein, 10 aa, Artificial Sequence
  Description of Artificial Sequence: Synthetic peptide
  Seed: GAGDVGKSAL (KRAS G13D)
GNGDVGKSAY

SEQ ID NO: 12303 - protein, 9 aa, Artificial Sequence
  Description of Artificial Sequence: Synthetic peptide
  Seed: GAGDVGKSA (KRAS G13D)
GNGDVGKSF

SEQ ID NO: 12304 - protein, 9 aa, Artificial Sequence
  Description of Artificial Sequence: Synthetic peptide
  Seed: GAGDVGKSA (KRAS G13D)
GNGDVGKSK

SEQ ID NO: 12305 - protein, 9 aa, Artificial Sequence
  Description of Artificial Sequence: Synthetic peptide
  Seed: GAGDVGKSA (KRAS G13D)
GNGDVGKSL

SEQ ID NO: 12306 - protein, 9 aa, Artificial Sequence
  Description of Artificial Sequence: Synthetic peptide
  Seed: GAGDVGKSA (KRAS G13D)
GNGDVGKSM

SEQ ID NO: 12307 - protein, 9 aa, Artificial Sequence
  Description of Artificial Sequence: Synthetic peptide
  Seed: GAGDVGKSA (KRAS G13D)
GNGDVGKSR

SEQ ID NO: 12308 - protein, 9 aa, Artificial Sequence
  Description of Artificial Sequence: Synthetic peptide
  Seed: GAGDVGKSA (KRAS G13D)
GNGDVGKSY

SEQ ID NO: 12309 - protein, 9 aa, Artificial Sequence
  Description of Artificial Sequence: Synthetic peptide
  Seed: GAGDVGKSA (KRAS G13D)
GPGDVGKSA

SEQ ID NO: 12310 - protein, 10 aa, Artificial Sequence
  Description of Artificial Sequence: Synthetic peptide
  Seed: GAGDVGKSAL (KRAS G13D)
GPGDVGKSAA

SEQ ID NO: 12311 - protein, 10 aa, Artificial Sequence
  Description of Artificial Sequence: Synthetic peptide
  Seed: GAGDVGKSAL (KRAS G13D)
GPGDVGKSAC

SEQ ID NO: 12312 - protein, 10 aa, Artificial Sequence
  Description of Artificial Sequence: Synthetic peptide
  Seed: GAGDVGKSAL (KRAS G13D)
GPGDVGKSAF

SEQ ID NO: 12313 - protein, 10 aa, Artificial Sequence
  Description of Artificial Sequence: Synthetic peptide
  Seed: GAGDVGKSAL (KRAS G13D)
GPGDVGKSAI

SEQ ID NO: 12314 - protein, 10 aa, Artificial Sequence
  Description of Artificial Sequence: Synthetic peptide
  Seed: GAGDVGKSAL (KRAS G13D)
GPGDVGKSAK

SEQ ID NO: 12315 - protein, 10 aa, Artificial Sequence
  Description of Artificial Sequence: Synthetic peptide
  Seed: GAGDVGKSAL (KRAS G13D)
GPGDVGKSAL

(The sequence listing continues in the following parts.)

What is claimed is:

1. An immunogenic composition comprising nucleic acid sequences encoding two or more amino acid sequences selected from the group consisting of SEQ ID NOs: 141 to 148, 150 to 161, 163 to 165, 168 to 177, 179 to 185, 187 to 190, 192 to 206, 208 to 209, and 211 to 272.

2. The immunogenic composition of claim 1, wherein the immunogenic composition is administered to a subject.

3. The immunogenic composition of claim 1, wherein the nucleic acid sequences are administered in a construct for expression in vivo.

4. The immunogenic composition of claim 3, wherein the in vivo administration of the nucleic acid sequences causes one or more peptides that is displayed by an HLA class I molecule to be expressed in a subject.

5. The immunogenic composition of claim 4, wherein each of the two or more amino acid sequences is a modified or an unmodified fragment of a mutated RAS protein.

6. The immunogenic composition of claim 5, wherein the mutated RAS protein is a mutated KRAS protein, and wherein the mutated KRAS protein is selected from the group consisting of KRAS G12A, KRAS G12C, KRAS G12D, KRAS G12R, KRAS G12S, KRAS G12V, and KRAS G13D.

7. The immunogenic composition of claim 5, wherein the two or more amino acid sequences are selected based on the mutated RAS protein that is expressed in the subject, wherein the immunogenic composition is administered in an effective amount to the subject to treat cancer, and wherein the cancer is associated with the mutated RAS protein that is expressed in the subject.

8. The immunogenic composition of claim 5, wherein the two or more amino acid sequences are selected based on a prevalence of the mutated RAS protein in a risk group that the subject belongs to, wherein the immunogenic composition is administered in an effective amount to the subject to promote an immune response against cancer or to treat cancer in the subject, and wherein the cancer is associated with the mutated RAS protein.

\* \* \* \* \*